United States Patent 7,365,185 (GENOMIC PLANT SEQUENCES AND USES THEREOF) - sequence listing, part 49

SEQ ID NO: 66477 - DNA, 19750 bp, Oryza sativa
tcccctccaatccctccctcttggggattaaccgaataagatcttagtaagtgggggaagagaggtcaccataccctggcaacaaccccagttactgtggataaccgcggtaaacgtgaaaaacaggaaaaaaaataccaaaaaaaaataatttttgtttaaatatttttgaacttggtggggttattgggcccttaccgttaccggaccctggcggtcagggaaaccatgggatccgctctgttattggttgttgccccttgctggctacggtgctctgcgttagttccctgtgagacctttgatctcgacaccaagtcctcatggtctcgtgcagcagagtcatgctgaatcggtcgatagatgcagtcatgaagagagtagatagaaagagagcatggggggaggggattagctaggccatatactgttgaacactaggggaattggagttcgccctaggagattgataaattggtccatccttcccgactgcacaagtgcattacctgatgggaattggagaatacgatttgagatggatatatactatacctagtcttctgtcgaaaatattgggggtgcagtactacatagctctgcccctgctaccaaatatattgacactgactttttgtgaaaccaatgatgatggtggaaatactgccgatgactcctaaacagcatcaaacactaaatctctcttgtagaacaaggtgatgcgattgtgtcttgcaggtaggtaggaggaatatagaataattggcgaaggattgtagtgggtctacctaaggatttaattctggaaaaccatctggtaggatccgaaagaggaacacctagaccttcttctgagcaaagttttccatgaccaacccattctgtggattatgtggcaatcggtaccatcgttgaagttgatgatgttgctagccatcacacatgccagtctgagatgcccagagggtttgacctagactttgtcgagaaattgaatcttctctcataccatgcgagtgagcctcagtggacaaaagtttgctctttatcctgttgttcaggatctcgcaaatagccccagtgataaggtcagctaggcagatttcagggggcctatctcctgttatgaaacctgactttgaggtgtagagaaccataaagagctatgttatatatgatttcttaataaataagtcagtagtgtagtatcatcaatgtgatatctaagacagcattatatgtgcttatgaataagttacagcatactaaactctgaaaatttctgcttgcacactgcatttacttagctggtcatggtgcaatggtgttaagtgatcatatccattacattcagtcattggcttaattgtatgaaatagatcattgatgaaaagatcgctagtgtttgttttttaattgtgcaaaagtttacatacaactatctgatgcaaatgtttttttttctcacaaaaagaagaatttccaccgttatgcatcctaaattctctaatatttttatcttgcaattaattagacatacttctctaacatccgtttttgattttcagaagtgatgaacggcgagcttaaacttatggcttcctatgtgagcaagcttaagttcatcttgcaaaaagatcagcagcaggagccccatactgcgaaccttctagtcctacttgggagtagcaatcaggacaaaagaaatggcctctcacagggagaaaacagaatggacacttgtaccagaaagaagccaagaagataccaactcctcaccatgcaacaaaaagaaacgcttaatcggtacgcagtgcagttagcaaaatcagcctgttatgtactgtctcaaaatataagagacgtgatttaatataattagtttgtttgctgtttcgtcccagtgcatttcaatcatgtccgaaccctgatagaaatgacttgaagaagttggccaaggaactaaacatgactgagacccaaatcaaatattggttccagaactgcaggacaaagatgaaggtatattgtgtataaacttctctgttttcaaaataaattgctccctgagtaaatcatttatcttcttgatgtagaaattcaagaacaatgaggagcgcaaactactgcagaaggagaatgaggagctaaagaaggagaatgcagagttgagaaataggatgaagaactcaacatgccgcgcttgtgacctccctttgttccatatagattgccgtcattgggagaatccaatgctcaacaagggtaatcatggcgttacaagtaatctcattcctcaggcagtgtcatccttgctccccagctcaagtggttttgtagcttcaggctccaatcttagtagcaatgctgtgctcatgcccgtatctgccatgccatcatcagttttgcagcctgctccagccgtctctggtgccaattttcccatcttgcacaatctatctgccaatgcaaatgatggctatacggaaaaaaacgtacttcttgatctggcgaaccgtgcaatggaagagttctttagtctaatgaaggagaatgagtctcttcttgtcaaaaaaaaggagaatgggccttctggctcccacacatggatattctgggagtcgaatcacttaactaccaggaataccttgcaaaatccaggacgattggacaaaaacctgttgacttcaaagtggccgtcaccagggacactgccattgtcaatggtagctgtgttgacctcgtcaaaagccttttggatgctgtatgtatgcaactactatgtgctgcatatttaattagtatcatggtttgcctgcatatcttaaacatgttctttatgcagaaccgctggagagagttgtttccaggcatcgtggcaagtgcaaacaccaccaagatcatctctactgggccctctaacttgcacgacgggttgcttcaattggtgggttacatatcataatctcttctgatgtggttatccatatactcgactgcttgcatgtggtggattgatgtgcagaaaaatttgcagatgcgtgcagagctccaggtaatgtcacctgaagtcccagtttgcgatgtgacattcttgaggcagagtgtgcagtttggaagtggactgtggtgtgtggttgatgtgtctattgataccatccttcctggagagagtaaaacagctcagtccagtgtgcagaccagcagtacagctgccagacgcatggaagtcaggctgttgccatcaggctgtgttattgaagaaatggagaatggctattccaaggtgctttgcttcctcattgactcaatcactggtacaaggtgttaattattgttggtttcctcagtcactgatgtgatgtatagaaatttgtgtttgacaactattgaggatgtttaattctcaggaacatatgaaatgagaatcagtcacataacatgacaaaatgtagcagtagttttgaacactagtatagatactaacgtttgtcagagaacccactctattatcccagcatgtaaagcatgtaataaaatgactaatatacccacctgcatttgtgctagccataccattgcattgcaaaaggaagaggaaacaggcacactaaccaacaagttttcagtagaaaacagaacaaaactacattcaagcatcacttaaaaacaacactgtagatatactgacaaagatggctgtagtttcctgttttaggggtgccttactagatatggtcttgttcttgtagaatgaagtcactactatcggtctctggcccttgttgaacattgtacgaacacactatcatgtcaaaaaatctctaaactaaagtacattcatttttttattttattattattcttgacgggaagtgcattgaactcatatttcaaacaacagaatcagctaacctttttagcatcatttttcgtgggcaggtgacctggatggtgcatgcagcttatgatgagagagcagtgccagtgctttatcattcacttctccgctctgcaaaagcccttggtgcgtgccgctgggtagcatcactccagagacacagccagttcctttccggcctgcacaaatacatcttttgtcctgacagcacaagtgagtgaccgactggtgctattatatatgcaaaagaattaactaatctgcacatattgatattaacagtcagttaacactatgccacatcatgttttttatataggggattttcgatagtgacagcaggcatgatgcgaagaaaagtcctgtacctggtgaagcagatgacgagcagcttcacaggcctatttgcgtcgatgtctaaggccacgctgcaagatggtgatgatactcacttcgcgcatcagatagttggtggtgcaacaggtgaacctgccggactgctgctgagcgccaccacaaccatatggctccccggcgtgaacccgaggcacgtgtatgaccacctgcgtgatgagcagtgccatggtgaatggcgctgcctcctcggtgagcagctgcatcagggcaatgccttgccgtatggtgcccccctgaatggtgagaccgtgccagagttctatcgcatggtgaacgggctgcatgaagggcatgctatctccctgatcagccccagagtaagctccttactagttattgtttccctgtaactattaagttgcatacttccagtacagtgcagttttagctagaaagaaacttccattgattgttactccctatatcctacagtaatacagtctcgagtgcctttcaccaaggaatatgttgctgccaaaacttttttcatctttgataattcttgttcagtgaatcattgatcacattaaaagtcattaaagtatgcttatataaggatattatagtttgctcagacacactttgatgaggactaatattcaactttaatctagaagataatatcaagttcctgtgaccaaaggattaataatttatgtcacgcgtaggtgctgcattcatccaaaatccagttgaggtgccagcgcccataaaaatgtattgttgatatatcagtaggacagcaatgtgataatctagacctcctctggttttttcttgaaaagtcacttttgagtcttgaccagtaggatgtttttcgggaagttggtttaatatttagcgaattcctttataagttctcataaagaattaactcttatctgcaaaacaattactttattaatactctgcatcgcatgtggtctttagtttactaaacccctattttacacatgcaggaaatgggtggtaacataagcaacactctgctcctgcaagaggcaagaactgatctttctggctccctcatagtttacgccaggacagatgtgaacaccgtgcattccatcatgaacagtggcctcaaccctgccaccgtcttcctcgtatcctctggatgtgccattcttcctgattgcctggaatcattccctctacacccagctgcaactgcagatcaggccggcacctccagtgccgctatcgctagcaggagcgaaaccggtgggtcattcgtcaccgtcacttaccagatgtttttcagcagccaaggtggcgcagcacctgccagctcatcaattcatcaaggccgtgatgcgctcaagaaagccaccgacattttcaaggtggtcctcgacactctcaccgtggcatagcgcaataccccaggggtagcatttgcatgcgaaagtgaaatccagatcgagttaaatttcagtgtttaagactatgttgtttctgttgttcaggggatggctttatctctgatagacccgtggatcatgctgtttaccttgtttaccattttcagactatcgatttgaaatgttgatcagacatttataataattggaactttgagacatcaatgtttctctggtttctgctttttatttttatttttttacttttttgcaaagggaagccttcagtttctgcaatggtacaatgaaaatggtaagtttacgtccaggttgtttgatgatgattgattgatctattggtgtttcttgttatgttcagtagtcagactgagacgagcggcaacgcaatttgaaaatatgagaattgtatctatatggaagcaatcgtcatcccaccacaattgctggggctatctagttgacaaatgaacgaaaataatttttcaatcgatcaattttttgtagtcagatcccatattgtttctgcagagttttcggttaggctgtggtatgtatgtggttaatgtctgtttagaaacttatttatggcacatatatcttccagatagagagttgctatcttgttctattattattgtatacgtgaagtttctttggacttttggcctcccaattcttgctgttcctttgaggcatagaaaaaaaaaagataaagtccatcttactcctcaaatttaaagcctatttttcactcctaacttttggaaccggaatatagcctaaatcatagtgattttcgctatcattaacttcaattatataagtgttgttgttgtagacctttgagtaacttttgcatcgacaaaaacatgtatagcggacggtccataaccaccttcgattaaatagcagacaattaatatgaactaatagagcaattaaattagtagtcttgttttcaattaaactatgattttttaatttacagttattcaacctataatctttacaattattgattataacttcatgaaacaaatgttaataaaatttattatctaaaaaactaattgtgcaatcgtataagcccaatttcatgtcctcttagaacaagtttaatagtagagctaactaatagctataagttaatctaaaagttaacatatataatagattagctataaaagcaagtttaatagtagatatgttactcaatgttaaaatcaatattgattcaaaggaaccataggaattttgaaggattttattcttgtaggattttttttcctatatacccctttaaattaaaggaatgaatcatattgaatactatgaaatttctacagaataactcattacatacaagttttcgaggaaattaaacatgaggtagaacctcatggaaagttatctttgagtctttatttcttctcaaattcctgtgttttttcctacggtctaatcaaccggtcattcctttaagtttttatttttttccattcctacgatttaaaggaataatgtattggtcttggaacatatgtaaagctagcttttgcatgagagctaacagtctaacacctttttttttgttttctcttttatccacataagtttttatagttggtttatagttcactattatctttgttctgtggttatctctattttctctctatatataaataatgcatttgcttagaagaacgtactccctccgtttcacaatgtaagactttctagcattacccacatacatatagatgttaatgaatctaaacatatacacatgtctagattcattaacatctaaatgaatgtgagcaacgctagaaagtcttacattgtgaaacggaggaagtatatagctagctagctcctgtatgaaaggtagcactcactattttttttctcaactccaggtaagcatgctattgaacttgctcttaggtaaaaatcgacaaccataaaaaccgcctggcttttctctggtttttcgggtcttttttttttttttgctagagctactaggctctccgtcctccgatcctccatccatttctcctctctctctctctctatccatttcctatctaccgcctccgggcgagattgccttcccacgggcacaacctcctttccagtgcggcgggggcctccacggggcgcgtaggtctgtgggaggaggcgacatggaggctgacttctcctgcaagtagtgccacctacctccatctttgctgcaatcgagctcaaggtactcaaggtactcctcattctcccctcgtttccgcggcagttcatcagccgcacttgagcatattggaaatgtatcccaaattgaatccccttgggatagaaaaagaaacaaaagggaaaagagagagaagtttttaatcggtttacctggtgtcaattcatatttgttgtgtgttgttaattgttatgaattaaagtatctgcgagaattggagtattttttttagtttgaataagtggtggacgtaggattttataaatgggggtacgataaactaatttatttataaaactgtttgatgaaaacaaaacaacaaacacatggaaaatagggaaaccttatattttattaatcatgattcattaacatgaatgtttatagatacatgggggctcccgtaggaattcgccttttgccttcgtgaggaatgcttaataaaaaggtatgctgactggagattgcttgtagtccgttgattcccagcgcctagtaatgaggctaccggttaatttcatccatagaacgagcctatggaacacctccgattaagctgtgcttgtgatcgtcgtcttcagaattatttgctcaccgagggttgaggttggtgcaaatttaatggtgaatatagtgaatgtggaacgggtggctttgtttcgccaaaacctggtcacggtacactaccatcacgtcggcgtgaagagggaatttggtgaagcggggtgacctttgcctcatcggtgcccagtcatgaaccctgccttcatcaaacatagattttgtgggtgcttttgcctcgttggtgcttagcaacggtgtctccgattcccatccattttagacgtgttaatagtatagtgacctagccttgttggctctatagtttcgtctagcctcgtcggtcatagacagatggaatgagtgaatggctagagcgttgttagcttttagccaacatgtcgtccagccttggacgcaacgccttcgtagttggtgtatgcatgagtcaagaacagctcccgtgcatatgcatgggtcaaaatatattttaattatgaaaacaacgcttagatagtccgatcgtatgagggccggacatatctagtaccattgttattggtatcatagtaattgatagacgatccgatctctaatgagggctagacgcctaattttaatcatagaaaatatcaaatggcacttagatgatccgatcgccaatgagggccagaccagcctaataccattgattatataaatgcagtctgatcatagccgtgtttcggctctcatcgatctgactttaatcatggtgacagattaagaacacgtagatgtccaatcgccaatgagggccgaacatcgtgtttaatctaaaagattaatatttattcaatgtacccaccgtccagcgcaaatatcctgaacggtggcatgttgtggataaataaaccaacttgacaaaggacgccggctgtggtgtttaattttatccgcaatggcgcaggttctgctatcaccggcaggcttcgatcttttgattttcctaatccaccaacaatcagagagatgagacgaatgaaaataatagttgggtgcctcctgtggcgtcttccacgtctccggctcgagatggggtctgcgccttttatatagaggcagaggcgacggcggcctcgcctaatcacagcgaatgtgttaatctaccgacctgctgcagataaagaaagtcatgtgcattgctgattagatgatcatgggattaatgatgcttatgacaggtgggtcccatgcatcacacgcgtttgccgatgtttatctcctagttacagataataaccatgtgcttaactttagcgacaaacaaaaacaacatactgcatgctagctagtactagttaatctcttctcttttcaagcgcatatctcttcaattgtgcattaaatttaaattctatttgaaccattattttctgtttgaaatatacaacaaaacaagtccaatattgattatatttggacatcgtgtgatatttgaatcttccgggtccacacgtcacagagacacgcctcatatgtattcagtaaaattgggctgcaaataatattctcatataaaattaaatacccaataatttattatattttctatgatttttagaaaaaaaattcatcaaacaaaaataataaattatctaattattatataatattatttctaaagaaatgtaaaagatccgatacatcataaagaaccagactagaaataaactaaatcttatttttatatgtagatgtcattgtaatgcataggcatgtaactggtaaatagtgaatttcacaactcacttgaacaatatatatagtgcattatgatcattggattcattacaagtgttgatcactagttcatccaaaaaaaattatatgactatatcgtttaatattaataacctttatagcattctagattatatttagcaaaaatatatttctcttaaaaaacctagtcatgtaccttttataaatacaatatcattaaatttcctcatgtaaaaacatagataatatatattacggagcacacacacatgagctagcttgcttagtattcatatgcaagtaatagtgttggctgtagcaatattataataaaaaataaataagaatgagaaaacaagaagaagatggaacaacagaagaatataaggttaaagtttttagtttcacaccatttactacaatgaacaattttaatactattagtatattatcgattaatgtgtgtatatatcataccatggatgtgagcaaccaccctcatgtgtttgggctagtgactaacctcctctttttcttacttctttcgaagttctctgaacgtatttaggtaaaagatgttttggtttcaataaaaaagaaacaatttaactagattattttttagagagaatccatcctgtgccgctgactttgtccttgttctataatatgccactgagttttgttaagttctacagtatgtcattgtatttttcttaaattctataatatactatctgtaacgccccgattttcgttcaggattaaaaatcaattaataatgcattttctagaaattaaataaaagttaaagcaatttaatcaagtgaaattattgagggaattaaaaatttcctttaaaaatcattggccggaaatattttgtaatattctccgtgccctaaaatactctccggattttttcgcgaatttttggagctcaagaagtaattttaaaatcacaaagttcatttaaccaattaaaatgaaaagaaaacaaataaaatccccttcccaccctcttgggctcggcccaagcctccccttccccttcccggcccggccgccccctctctctcccaggccggccgtcccttcctctccctcagccgctcggccctctcctccccttccccgaagtccactttgcctccccagccggcctccctctcccctttggccgataggtgggacccgtgggctccacctgtcatccccgacctcaagcctggccggcaaccgccgccatggccgcccactccgccgccaaatacgcctcgtcccgcccgcgcctctcatccaaaacgtgtggacatggatcccctccacctcctccaccaaatccccactcgtcccgcaaaaatcggcgccggttaaccctacttcctccccaacgtcggtgtcccactccgccgccggttgccacctctcccgggccgccccgtcgccccgagccctataaaaaccatccacgtgccatcctttctcgtttcccctcctcacccaggctcatcgcgccttcccccgctctctccacgccgcccccatctccgcagctcttcggcgagctccggccgcctctagccgccactcttgccgtcgccgcgctgtgctgtcgccccaccggcttcgccgctccatgccgcaccccggcctccacctctcctcctcaaaccgccgccgaaaccccgccgccacctctaacccgagtcgccacctcctccatcgcctccagccacgcgccgctgtcgcatggcgccggtgccacctctgggttcaccacactgccccgcacgtcgtccgccgctccactcccctaatctgccaccgaaaccccgccgccaccacaccacccgaaccaccaccatagcagccacctccagccgcctctcgccgccgtccttatccaccccgtgctgcgctgtcgccttcctcagcaccgcagccatcgtgcgcagcccggccgcccctctacattcgccaaaggtcgccggaactccgcttcctccgcccaagatcgaggacgagcccgtccgcctcttcctgagcgccacccgccgccggtgacgtcgttccaccgtctcccgtgccgccgccggttgcttccctggtgccgtctcaccgtcgccgccctcgcgtgtagaatccgtcgtttcggaagcccgcggtcgcgaggaaaagagttcagaagattgtttgaagaagcaaagcaagtcacacattccccttgagcatgttgatcccaatttacaaatgttttaccgtttgcaaataaatatgcatattttgttaattacatgggatcagggttttcctatctgctcgcttgtaccatgtttactatatctgtcctttgtcaaccttgggtgataaatcgactagatcgtgttacttatgtgacctagctagaattatttgcttagccatgcttaatcatcactagctcagttgatgggataattgcagtattagaccttctagtatcttgacgagctgcgtgctcgagacacccgaccatgtttcattggtcgtaactatccaactaaaatacgactgaatggtgggctgtgggtgcgtggttttgcgagtcgcacccatggcatttaaggaccggttcacgggaaaccctggaagacttaccgcgcttgccacaagcgggagtgggtaactacttgatttgaagtatagctcgaccctttcctaggcaccggtggcgagggtgggcgtgatggagttgggtcggccggggtatccggttgtccagctgacggattcaccgtggcgcacgaggggactgcccacctccggggtagggggtgggggtgaaaccttagcgtggtgtggatggttaggggagggttatgcggagggtcttgtcacaatcactcgacatggtgacgtgtctgcgcaggcacggtgacatgccggtggattgtgttttgtgggtatagttgtgcacctctggccagagtaaaactattcgaatagccgtgcccgcggttatgggcgatcgaccggattcaccgtgattagtctcacacttaataaattgacccaatgtactgtagttcaggagggttggttgggcctgttcaacgtggtgtagcgttgatcagtggagatttaatattaccttaattacttaactgttttactgttttgcgcaataaatgttttacaaccgcctttatgcaaatagccacaaacctccctttgtgtccccttgcatgtctgcatcgttggtgtggcttgctgagtacgatggttgtactcagccttgctatttcccccttttcataagtgtagtgcttctgagctgaagacgaagttagaagaccaaggctcagaccccagttgagttttgcctatggagtggagctgaagccctgctaggatcgcctttttccgctgctgctattttcttttcggtgtaaggactaggtgcctcttctgtaagtatgtacgctttatttacgtttggatttgtttattacttgtcgttttgtgtaccctggctggtcctggacagggatttaatacacaaaatagtctagaaatttgggctaaatttctgggcgtgacactatcgctgtccatttagatcccgttagtactgtataattttgtcctaatgattgaaatatccctaggacaaaaattttcaaaatttggctaaaaattctaaaatatcatattataaattaggcagagaagttgtccatctcaaactctttaagttttacaatctgtattataaaattgtacaatgctaacggaggctaactagacgacgatgttatattatagaagttaagcaaaatgcgatgccatattagaacttgacaaacccaatgacatattgcagagcagggacaaaatcagtgacacaatggattgtctctgtttttttatggttgttcggttaactacctatctactgtgatgcggcatttttagaaaaaattaaatcttatactataagtccatatcttacacattaaattgcatactgaaagttcaagtgccattaatttggttttgatgattaatggcaaatccaattacatgagactaatattgttataagcatttctttgtctactagtctcatatggatatgaaagtggaatatgtgaaaggtgatttctggacttcatatgagttgagagagaaacgttcattgatggtgtacctaaatcacaaggatgaaatgcatggagatcaagctatatgtatcactctttctatccatgcacatattgatatattcatatataatattttcatgtgattacataagcatgtgagactaatgttttgtttgagccatatcttgtttagtctctttacattgagaacatggagatgatgaaggtatgtttttattttattgtctatatttgataaatgccttctattcttgtataggataagctctcaatgtttaatatcttattatgcatacttttgcttcacacaaatattttgtattcatacatttagggggagcaaatcctatactttagttatgcatgtaatcgatccaagttattcaccttcatttaattgggatctttacatttgaacatatatttgagtatatgacacttgtggtgttgattaatactcatcatttattcatatccttttatacatgcgatcggttggtcaacatatggaggttgacaaccggatcattgggactaataattttattgagttaaatgaaagaaataggtcccaaggattacaaaagtgtttatgctcaagtggtatcattacacctaacaacaccaagaatgacagagtgaagatattgaagatgtgtgatacgaagtggctattatggcaaagacggtgaagggcaagcgatgctcggtcacgatggaccatgcggcggtgaaggacaagcaaggggcttggcgctaaagaaccaaatctggtggtgaagggcgagcgacggctttatcatgatggaccgtgcgagacatttgaagctacaagtaaccgcatcaatcatttgaagaatatatggtgaaacggtatcggcattggcgtccctcaagacaatgaaagaaagatgaaaaaaagacattcctaatggtataattctcttcttatttacatttgagtttaggaatgccgtattattaagagggatgcaacgtcgaggtgtttgtgtatgtctcggtgctcaaagtgacctatcatagtgctaccttgagagaaacccaagctttaacctatcctttgagtggttttagaccttgtttttggttgagttgggtagtcctctgggtgagctttccatagagtccaagatcatcaaaaaccgactcctgagcgaaaagttatagtcgttttactctgtgtttttcggaaagtccgaaaaattatcggaaaattcgaaaattttcggacattccgaaaatggctgcgaatatgatatttgcttctgtagattttcggacttgtccgaaaatgcttttcggaaactccgaaaattacagtcttggtctccaacggctagtttttgaggggctcgggtatataaactcctccactcctcctttgagtggctagtgttcttaggcaacattagacacatccaaagccaaatagccatccccattgccttacctttgtggtgcctctttgtgaggggggtttgagaaggggagagagttggattgagagagtgaggagttgagagctagtgagattcactccatcctttgtggtgcctctttgtgagagggatttgagaaggggaaagggttggattgagtgattgagaagttgagagctagtgagcttcactccatactttgagcacttgagttcatagcaagcaaatcttcgattgtgtttgttactcttggggactaaggtctcctagacgtttaggcgttgccggtgagcacccaaggttgtggtgtgctacggaaagtttgtgaaggcttcgatttcgcctccgcaagggaagaaatcaagagtgaaaccgaggagtgcatttgtgcaacctcgtgaggaaagggttgaaataggcccggcccttgtggctcctcaacggagacgtaggatccgtggatccgaacttcgggaaacaaatcatgcgtctcctctcttggcttgcccatttgtgcattctctcatattgtgcttgagcttgtttttacccgatctacttgcatgcttaattgatttagttggtgaccttatatcttgtttagataccttatttgtcaccttttgattcgtatacattttgtttatttgagctacaagttcataactagtgttttattccattatccgccgaatttttcggttgagaccggaacttccaatctgatatcggaagttcctatttgaaccgaaagttctcatcattctaatatgctatgaagttgtgataatttttaggaacgcctattcaccccccctctaggcgacgttaaggtcttttcacatacacttataatataattttcaaattataaaatgccctattctcattttataggagaaatatggaaaatgatttattatctatttaattacgaaaataatattagtccaaattaacatatatgtagaaaataaaaaacaatatgaaagaattacggaaatacgtactaatgtagtcatcatgtataatgcaatgagaaaagaagaccatagtcgaatgctttattattgagcaaaaatgatggtattatttttatcatcttttagcggaatctatctaaccataattaataagcccgtgttagtagaagtctatgtcgtcatgcatcaacatatcatgagactattagttgtagctaagtacaccggcccaaccatacttagcatatcacaagactatcgggtaatggacaattatctttaattgtgctagagaaaaaaaagtactcccttcgttccataaaaaaccaatctaggactggatatgacacttcctagtaaaacgaatctagacatgcatatgttcagatttgttgtactagaatgtgccacaccagttctagattcgtttttttttgggacaaatggagtgaattacaatccatactatatattcttgaaaatttttaaaagttttcatataatattatcctttaaccattattttcatttacacaatagctaactttacattcaatttggaccaccatattctatccatatccaaatccggtgactcagtaatcactctgcatattaactctctctctctctccattttctttttccctccgatagttggataaccgatagatctagcaagaaggagcctggatatatagcgccttccctcttcgtcaggtcagctcctgcctcctaaagtccctgcaagcccgacatccctgacctcaacggcaaccataacaatagtgcgcatcatgatagggaaggacaaaaagacatgtttgttactagagggtaagtatgcgcatgtaaaggcaaatggaaggaacgatggtggctcatggagaaagagcggtgatagcggtgcgtagagtggcagttagcggttgctggtggtatgaggaatttgttgtcgacacaatcacttaatttttccctaaatattgattatacgtgggttaccagttatataaagaaatagcactagctagttttaaaatactacctatgtcccaaaataagtgcaaccgtgaaaattcgtgtcgaacttttgaacgcccatctttgaaaagttaatgaaaaagttaaaataaattagtcaaatgtaaaatattattcatgttttatcatctaataaaaacaaaaatactaatcataaaaaaatttcaaataagacaaaaggttaaacgttagatatgaaccgtgtaaaactgcatttattttgggaggaaggagtagttaataaaaatagggactgtctaagtacaatccggtttaaaaaaaatttgtatctcagcggcttttttttggtactaccgtacaaagggtctctgtatcgatgacgctagatggcgtcatgcacaaaaatattgtctctgttttttgtccttttttttgttgggccacagcccacatcatcttatttgtgataacccagaaacccttgtagcccacaacccactggttcgtgtgctcatatcccacaacccaccacatgattgaaaaaagcccaatactagaataaatcaattatatcagtgatacagcccacgacagcccatggcccacggcttttataactattaagtttagaaacttacatacaatacaaatcattcatacagactgttttgtatgcatggcatacatacaaatcattcacgcataagtataatcataggctatttgttttctgggataaaaacactgctacatatgctacagtataatcatagagcacacacatttacaaaatccatcaggacacacacatgcaaagaaaagggtgtacagataggcatatgtacatggtacacacattcataaatccatcagggtgcacacatcagggcacacaaaaatgtacaatgtagtgatgcattgcagagagccccatcaagcatcagctagcaaaaaaaaactcataaaaatcgtccaacatattcagagtgataaaaatgggcttcatctctgatttagacgccctgccagcctgcctgttgcatggctgctgcaatgcactgctatgcatgcttaccaaagctaccaaatagaaatctaaaaacaatgtgtaacttatgcacagagatgcagtagtgaaaaatttatcacaaaaccaaatagtggtgtttctggaggagtcaacagcctgtgaacccaaaaaaaagttaagatgacagaactataattattgaaactgaaaataaatgaccaatagaactttacatacagaggtttacatacagataagcctataggagcatatagtataggagctatacaataaaaaaaatacaaagctatagtataggagcatcagaagttcagaccacaaaaatatgcatcttacaaggattatttgatatatgaattagataccaaggctttttctgtcatagcattagataaacatgcaccttataagtattatttgacataagactgtttttgacaaaagcatggacgttagaattgagagatttttatggcaagcaaacaacggaattttgaacgatttccagtggttaggctatgacctaaataagcgataaactgattaatatgtaccaaaattataaaaatctaacaaagacaaaaaaaaacaaaaatatatacaaaaacaaaaatacatcatttctgaaactatactgatttcttacaaagtaaaatttttggacaaaaacaaacacaaaatcaaaaatacaaaaaaacaaaactgagagagtaaacacaacgctgacacaacataacttcttcagacaaaactaacaaaactaagtgatattcactaaaattatgaggtgatgcagtctt

SEQ ID NO: 66478 - DNA, 2820 bp, Oryza sativa
atgttttttttaactcgatgacaagttcagggacctttggtgtactttttccttattgttaatcgaagaaagtttacagcccacgtatctgctatatatgggccgggcttagtactgagcccaaattagtcgtctagtcgtcggtgaattcaacaccccacgctagacggccgccatggccttctcctcctcgcctcctcggtgactccgcccgccgccgctggctgccggcgcagcgccaccctacaagtcaccgccccaccgcgagaggagggcgggcatggccttgccctgctcctatggctcccactgcgccgccctgcccttccccgccgtggtctccagggcggcctcctcgccgccaccgcgctcccgggggagaaggcccagcctaccacccgccggatgcttccacgccgcgccaagggacgccgctctggtgtccggctccgctgctggtggcgtgagcaggaggaggtttggtgccccgtgaatctcctagtatacctagtttctttcgaatgcctaatttattgctccaaatgggaaggaagaaaccgtgtcagtgtcgttgtttcgattgtattagttgatgatgtatttctggtttatgatttgatttaaccggtcttgctggtcattcggttgaattcatcagcacgaacaatccacaaatggctttgttttgctcaaagagttgttctgtacaaactttagaactctcaaagcttcactgttttttgggaagcagcaaactgaatttgaacctgatgtgtagtagaattgtggcattctactagaaaattgtgttgcctgcttgccactgattgttctgactatgtggttgtattcaacaggtgtgagttatttgacctccatcagcacatcgttccatttgcggaatcttgggcttggcagcagtccattgtgacaaggaggaaagggttggtaggcacggatgaagatcactccgacaccttaatcgcgctgcagcatccaccagtttatacgctaggcactgacagcaccgaggactacctccatttcgatgttaaagatgctccttttgaggttcaccgtattgaccgtggtggggaggtgacatatcatggtcctggacaggtatgtaccataatgtcagtgaagctcatattgttacatatcacgaatcgtggttcatttcttttacttgtgaataagctgtatggttctccattatcatctagacatctagttatagatagttaaaacttcaagtataggcctagctgtgcaatctggttaccagaatgtgatgaaatcttgattttcactaaggcagaagattgtggcttgttttgctacaatttatgatgtattctacctagttaaacttcatgtatatccctagctgtggttaatctggttatcaaaatatgtgataaaatcctggttttcccggaagattgtggcttcgattcctattggatactcaatctttgcatgaaattcgtttatagctaatatctgtgcttctgacagtcattttattgtctccttagcttgtaatgtacccgattatcaacttgcgatatcatcaaatggaccttcattggtactttagatcacttgaagaggtgatcattcgtgcccttcagtccgcattttccatcaaggcatctagggtagaaggtctaaccggtgtctgggttggtatggtactatccttttggaaattgtgatattattttgaattttctgtgagatataatgacgtgttactaatatatcccctctatttactttttaggagataagaaagttgcagcaataggaattcatgtctcacgatggatagcatatcatggtctagcactcaacgtaaccactgacttaacaccatttcaactcattgttccctgcggcataaaagatcgtggcgttgggagcatcaaagagatattgcaaatagcatctgatggaaaagagatagacgaaacagcattgatcgataaagcctacagaaccctgcttaaagagtttgctgaagttttccagctctctttatatcacaaccctaactgggatcttcaggaaagcaaaaattttagttaactgcagaatattttattggattcttgaaattcaacttgcattgaagtcagaaaccagtacaggtggatagagaggcaaacataattagatcaaagtgaagtctccttcactctaatatcaccaaaactgcagaactagtcatccatgtgcgcaagctcaaacttttgcttcacctgccaatcagataacgctatcagttttgaagatgatggtaatatgtaggagaggtgagaagttcagccaagccaattaaccttctgttaggagccatgtgggctgcaatatgggctggatcagctactttccaaagaagtccaagcaagcccaagaggcaaccatatataagtagcagtagcacttctaggaggggacgaacagattgattggccaaggcggcgaacggcggcggcggcgacctggaggctggctggcctctttgtcgatctctcctctatctcccttcttctctactagtctagaagctactagaaccttctagcccttgtatccttccatcttccacctcaaaaccactccactattgtaacagacttggttgttccctgtgttggatttggcactgctatttctgaaattacattgttgggtgggtctctaacaatctggtatcagagccaacaatccccactgagttcaccaagcaagctgccatggcaagtgaacataagttggatatgattttgaggcgaatggaagagtttgaac

SEQ ID NO: 66479 - DNA, 13059 bp, Oryza sativa
gcggtggaggatgggcggccgcttgacggcaaggtaggcgatagcggcccccgtgtccgccgcgacgccgagccgcgcgcgccatgggagccccccaccggcgaggtggtgggcgagcgtgccgttggggacgaactcgtagacgaggatctgctcgccgcggtctaggcagcagccgagcaggcggacgaggcccgggtggctcagcgacgagatgagcttcacctcgttgaggagcaccgccacggcggcgtcgtcgtcgccgtcgtcgtgccgccgccgcatccgcttgatcgccaccagcgacggcgagctcgccggcagcttgccgacgtagaccgtgccgtaggcgcccgtgccgaggcggtgcgtgtgggagaaggagttggtggcgcgcgccacctcgtggtacgagtacaccggcacgccgctcgacgacgccgcctccgacagcagccgcttcgccgccagcctgtcgaagccggaccggccgccgccgccgccggatcgccggcaacgcgcgcagcagaggaagagcactccggccgccaccgttcccgccaagacacctgaaattaattaattaattaattaacccaagcaatcatgataattagttggtcaaagattaaatagtactctcctaattacacttccagtccactgtaattatgctactccgctcataatactcgttgttgttttagataaaggtaaagttaaactttaaaatatttgattataaattattttaaaaatattcgtcttttaaatatgttaactacatgtatagaaaagtatttaaaaagtactttactaaaaccatatatttcttaacacttttatatatattataataaaaaaataatggtcaaaatttgtttttttagaccgtgctcttatccaaaataataagtattattaaccgggggagtaattagttatttggtcaaagattaattagtcctacactcctaattacacttccagtctacttagttcactgtaattatgctaattaatttggattactgcgagctaaatttgaccttttccacgaggtacatcttatgaaattctcatgacaattatgcgcttaacccaagtgtaagtcaatcttctcatgcggcaaaaacaaatacgcagaattgttggatgcaaaagggggcgttttttttttttgctccaaagaatattcttgatttttttccttagagtttccaggtcaggagtcagcatgcatggcagccattccacgtaagttgtagaaataaaaatttacgacaaacttgacttgatcgcaacaatttgactctacgcagcgtcgtacacgatactgtattgtgacagattaacgttatacggagtaaactccaacatgtattaaaaagaacagtaaaactcaagcataaggcaaggagtaacatttttttttacctccaactatgataaggattttcttcgtagagctcttcttagctgcaaaaatggagagaaaaaaaaattggtcagaccttcatatttatttcagtttgcaaaatatgggcagaattggccatgctgaacatcataaattggatcaggtttttggtagcagttggttggttttctgttaagagcaaaattgacttgatttatgacaaaattgtctctccacgtgaggatagctcccaccaaaattgtctatgcattaagatgagaaaattcaacagataaattttccaaatacagaccactgaaccaaaagaaggtggaattcaatttgagtactgatgcttgaaaatttggtgtttttcttctaaaaataactaaattccggtcaaagagtttgatgaggctatttattgccgtaggcattgatcggtatcatcagatgcatcatgtcaaaatgtgacaaactaatatgctgatttatgcagacaattcttgttgttcaaaccaaagtcgccatctttgaaaatcgcacgcttacagctatacaaaatcggcagctatttctctcataaggctattttgaagcacaacaattttactgaactattaactcattacttaaaaattgcagcaaaattcctctgttcctaataaaaggctttagttggtctgaaactcatttcttcccttaccaaatcgatcggcttataattttataattataaaatgtgggagtatctcaaaatactgctacagttttgagtaaaaaactttcagatgtaactatgatataatttaatgtaactgcattataatcgtattataactatattgtaactacaatataatttatataaaacttacattaaaccacggtttagttagttagcactagtatcttaattacacgtgacatgcgtgaaaacttatttttaatattttttctcttcctgtacaaatctcgagaagatctgattgccacgaatctaaaatttcttttgacaagaaaaacatacgaaagttttctagcaaatctgaaaaatgcaatccacttttccaatgaaattccaaacagaccaaagcaaagcagagcccctagattgtctcgcccgtgattgaccgcaccgatgactttcatgaatggagctgacgtggagcgccgggaagtgggccccacccacctacgacggccgaaagctatagagaggactcaccgggaaagtggcatccttcgccggcggcgaacccgtcgccgtccatcccctccagacacctgcactggtgtccccacgccccgctcggggtccgcacgtcgtggcacgtcgcgttcgccgcgcacagcccgacgaggtcagcggcggcggcgctgtggttgctgcagttcccgttgacccaccaccccatctccgccacggcgatctccagcgtgaacaccccatcgttcgtcgtctcgccgtacacggatgtcagcaggttgtcgcatctaggctcctcgaccttgtcccactgcgcgaacaggcccacacccttcgccatgtccgcctccgtcgacatcgtcgggatgcacgtcaccggcgacgacgcggttccgttgccgccgccgccgccgccgcacttggctgtggtgagcatcgaggacatggcttcggcggggacgctgcagctgttgttcttcgcgttctgacagccgcggacgaacaggccggtgctcgacgacacgccgtagttggcgccggtgagccacagcctcgcgtcggagacggtgcggttgcaggaaggcaggagggagacgacgaaggtggaggcggtcgagttgaacgacttgccgacgacggcgtacgacaacggctccatggtcgtcgacgtgccgttggtcgggcggagcagcgccgccgtggagttgccctcgtcgcaggccagcaggatggggcagtcgccggagaagccgaaagggtaggggacatccaacccaccgcacttcctcctgcaccgctcatctccgccggtggcggcggcggcggggctggcggagagagctccataggggagaatcaagaggaattgcacgccgacgcagaggaggaggaggaggcggccgccggcgaggtgcatcttgagtttggctagctcggcaggcgagcgaaactaatatttcagccaccgggaaggaattggctggagcatatatgttgaaatgtttgaatggacctggggttgcggtggctaaagctttgattagtcaagcaaaacatggtcaatctagagagtacgtaattttaagaacgaccatatccttgtgagtactacacgagggaggggcaatatggaaggtaattccatgggcctagcttctacaccttccgttcaagaaaaaccccaaatttaatcctagctacgaaacttaacacacatgtactcacattcatagttaggattgattttttttaatgggatgggtggaatacctctttatcttgagaaaaaaaactaatggttaacttaaaacctctttgtcttgaaaaagaataatataactgttaacttaggatcatgagagtaaatataaaatagatcaaaataaaaatttaaggacatgtaaggatatgattaaggaggtaaagagaaactctaggaggcgcacaaggaactttgtcttattttttattttgtcttcactattttactataacaactactctctcatttttcacgcgcttacttccaaaactgctaaacgatattatttttaaaagaattataaaggaaagttgttctaaatatatattttcaagtctttaagctaatacttaattagagcctgtttggcacagcctggagctcatccaaacagtttcagctccactaaaaataggagcagagttggatggagctctcttacaaaatgaattagagatgtggagctgggtttaggcagctacataactccactatagatctaactcctgaagctaaatttagaagttggacctctaccaaacatgttaattactcattttcgccttttcggtgtagagggaataacatcccaaccttgaggtttgaactgatctttagacatctttatacagagactgggtcatggagtgcctaaggcttagggtcaaaagcccatgggccacaacacttctttccattttaggccgagctcttcacaaattgatggaggctggctcgagtcttaactttaagctaggtcgatttttaatgttaactcatttttttttggcaagttacttttctcgttcattaatagacgcgtacaaaacatgcagttaaattttgaaaccaaacaaaaattatagttcaatatatgaaaatagaattagtagttacttcctccgtttcatattataagattttctagtagatatttgtaaaaaaatatacacattaatattttaaatacttttctgaacacatgattaaaaacaaaatgatcaaatatgtagatgctgtactgtcgacatattaaagaacgagtaattgacctatgatgtagcagcctagcaggttgaattcaaatgcgagaagccatgctagaaaaattggtggtttctcccaaaaagaaataatggcaggtcaaagagtttgatgtggctatttattaattttttttgacgtgagatgtggctatttatcaccgtaggcatcagcatcatcagatgcatcgtgtcaaaagtatgactagttgacaatcatatttttttgcaaacaatttctgttgatcaaattaatcaaatcgccatttttgaaaatctcacacctatagctctaaaaatttgtcaggtattttcctcacagttctttttaaagtatttctctcacaaaaattttacggctccttgaacttattttaaaatttcttttccaaatcgatcaactaaatttaaccttaacgttttctataaaatgcactccactgtcactctgtcagctagctttaggtgcgaaattgtgaactagtacatgattagattagctcgcgcgtgattgaccgcagcaacgactttcgcgagtgctgctgacgtggaacgcgggggagtggggcccactcacctacaccgcttgaaagcttagagaggagatatatcaggagaggactcaccggcaaagtagcatccctcgccggcggcgaacccgtcgccgaccatcccgtgcaggcacttgcactgatgcccccacccgccggtcggtgtctgcacgttgaggcacgtcgcgttcggcgcgcaccgccaggcgaggtcgccgccgccgccgccgtgggtgcagttcccgttgacccaccaccccatctccgccaccgagaactccagagagaacaccccctcccgtgtgtcaccgtacacggacgtcagcaggttgtcgcagctaggttcctcgagcttcttccactccgcgaacaggcctactatccccgaccccgacgacgactctggctttgctgggtccggcgccggcgaggtcgacgtgacgcaagtcagcgccgacgcggttgtgttgccttcggcgccgcagctcgccgtggggaccatcctggacatggtttcggcggggatgctgcagttggtggcgttcgaggcgctgctgtttctatggcagtcgccgcggaggaacaggccggtgcgcgacgacacgccgtagttggcgccagagagccaccgcctcgcctcggagacggtgcggctgcaggacggcgggagggcgacgacgaacgtcgacctgctggcgttgaagttgctggcggtatacgagtacgacgaggtcgtcgtcgtggcgttgccgccgccgccgccgccagggaggatcaacgcggccgtggagttgccggcgtcgacgcaggccagcaggatggggcagctgccggagaatcccagagggtaggggacaaccaacccgccgcactgccgcctgcaccgctcgccgccgccgccgggggccgagagagccccatcgggaggaatcaagaacaggtgcacgcagaggaggaagacgaagccgccggcgaggcgcatctctagctactagactatacttgagaggtagcttagctaactcggcaagcgagcctaatgtttcagccactggggacgaacgattttggctggagctgttgcttcttgaatgggctgagtggtggtggactggtgggtgatccggtgatggactgatggtggctaagcttgattattagtcaggcaaaatcatggtcaaattggtcatggagtatcttgaaaatggccatcctttgttatgattttgtgctctcgttttacttttacttttttcctttagctagattgtttttgttgctgttttgactgctggtgatttatgttcatacgtaaatccgtgggtttgatcttactctctcctgttgaccttggggtcatgtcggtattagtaattctcattacttcaaccttctagacttttttcttgttagtttttcttatatttgatcaaacttataaaaaaaattagtaacacttacagcattagattagtctcattatatattttgataatatgtttaatttatgttaaaaatattattatatttttctataaactaaataaaaaagtttgattagaagatagttaaagcgacttatagtgtaaaatgaatagaatacattttccaagtgtgtttctaagtactcccttcatttcatattataagtcgttactctaagtttgattaaacttataaaaaatatagtagtatttttaacacaaaacaaacatattatcaaaatatatttgatgttaaattttatgaaactaatttcatatgtccccagcggcggcggcggcggcggctggggacggcacggatggcagcggcggtggcggctgggacggcgcggacggcggcggcggtcgcagctggggacggcgcggacgatggcggcggtcgtgcctggctccagcgcggacggcggcagcgatcattgctggctccagcgcggacggcgatggtggtcgtggctggttccagcgcggacgacggcggctgtcacggctggtgatgcgcgcggacggcggcggtggtcgcggctggctccagcacctctctcctgcgtgccgtcgctgttcacgagtgcccctgccgcagccttcttgctctagccagggggagagggagagatggggtgggagggggagtggtggggcccacgaatagctaggcagagagagtctccaagtttggccagtgagggatgagatttggccatccggatgtcttggctagtcggatggagagactgttggagggtatttttctcccatacttactaaattttagcttggccagccatttagccattctagttgctctttagatacggctaaatagagacggcaccaggcctaggatcaaaagcacatgggccgcgacactttttcttaatcatagtggaccaagctcttgacaaataaatgtagcgtagcccaaatcttgattttagtctatgtctatatctaccattaactaacttatctatctactatatattattttatttttttagataatatctattttttatagttcaccgactacagtcctacaaaccttattcatcaaatccgatgatctaaattcatggagtccaatggccggctctgatcgcccacgtctcccccttagactcccctccccgcacccatcctctcacgcagacgacaccgcctccaccctcctctatcttgcactcacccgccgccgctgcctttgccctcttctctctcgcactcacccgacatcatcgacgccctacccagcgtagatcgccatcgcgcgcccctccgtcgtcatcgcatccctcccacgccatccctctacggtgaacttcttccgttcattaatactccctagacttgtatatgacatgtagttaaatttgaaaataaataaaatggtttaatatacgaaaatagcattggtagctagagacttgtaaaaaaaccattaatattttaatgccttttctgaataggtgattaaaagcgaaatgaccaaatgtgttggatgttatactattgatgtactacctccgtcccaaattagtggttgctttcactttttttaacgtttaaatattcatattatttaaaaaattagtgtaaatataaaaaaagataagtcatacttaaagtattttgttataataaaaacaagttacaaacaaaataaataatattttcataatttttttaataaaacgaatgatcaaacattataaataaaaactcaaagctacaaaagcgagacggaggtattaaacaacgagtaatcaacggagtagtagcaggttgaattcaactttaagaagcgatgctaaattatcacagtaggcatcagcatcatcagatgcgtcttgtcaaccagcctcatcgtttggcttaaacggccaaagaataagccgttaatgttggcttttaagtcgctacgaataaatctacaaaagttttacttataaattaattttaattttctaataagccaaataagccattttgggtaaaacgggcaaccgatgggagccaaagtatgacaagctgacaggctgatttttgcaaacaatttctgttgttcaaattaatcaaatcgccatttttgaaaacctcacacttacagctctaaaaacttgtagtattaatttcactcaccgtttctttttaaaagtatttctctaataaagattttagggccttttggacttatttaggttgtgttcttttcccctcttttccaactcatttccctcgtttttcacgcgcacgtttttcaaactgctaaacggtgcatttgttataaaaattttctatatgaaagttgatttaaaaaatcatattaatctttaagtttttttaactaatacttaattaatcccaccataatcgtgcgcttcgtttttcgtgtcaggagaccttgcctccgaacacaggctaaagttctttccaaatcgatcaactatatttaacattaacgttttataaaattcactccactgtcagctagctctaggtgcgaaattgtgaactattgattagattagctcgcgcgtgattgaccgcagcaacgactttcgcgagtgctgctgacgtggcaggcgaggccgtgggccctattcacctacaacgcccgaaagcttagagagtggaggactcaccggaaaggttgcatccgtcgccggcggcgaacccgtcgccggtaaaccccggcaggcacttgcactggtggccccactcgcctcccggggtctgcacgtcgtggcacgtcgcgttcgccgcgcatcgcccggagaggtcgccggcggcggcggcgctgtgtttgcagctcccgttgacccaccatcccagctccgccacggcgagctccagcgcgaacaccccctccggcgtctccccgtagaaggcggacgtcagcaggttgtcgcaccggggctcctcgaccgtgtcccaccgggcgaacatgccgacgccgagcgcctcggccgtggagttgggcgggatcgaggcgatgcacgtcagggacgacgccgacgcggcctcgtccccgccggcgcactgcgccgtgcggagcatcttggacatgacctcggcggggacgctgcaggcggtggcgcccgtcgcgttgcggcagccgccgcggaggaacatgccggtgcgcgacgacacgccgtagttggcgccggagagccgccgcctcgccccggcgacggtgcggttgcatgccggcgggagggagacgacgaaggtggaggcggtccggttgaacgaggaggccacgacggtgtacgactccgccgccgtatccgcagcggcgttgtctgggaggatcagcgccgccgtcgagccgctctcgttgcaggccagcttgatggggcagctgccggagaagccgaatgggtaggggacggcatccaacccgccgcactgccgcctgcaccgctcgccgccggcggcagcagggctggcggagagagctccatcatcgggaatagtcaagaggaggaggaggaggaggaggccgccggcgaggcgcatctctagctgctagcctaatcgacaagacttgaggtagcttagctaactcggcaagcgagcgagcgagctagcttaatatttcagccactggggacgaagagcccccatcagttcacccgataaaccaaagcaaaaagtcaaaatttaaatttttaaatttaaattttaagttagttttaagatattttcaatataatttgttttaacattgacttttaagtcgctatagatacatatataaaattttacttataaattaatatttattttctaatagattgtttggacttattacaaaatatataggcagctcgaacgattttagctcgagctgttgctcgttgaatgggctgagtggtggtgggtgatggactgatggtgactagagcttgattggcaaaacatgttcaaattggtcatggagtatcttgaaaatgaccatgcatcctttgctatcgttttactttacttttttttttgttttagcttagattggttttgttgctattttgactgctgccgatttatgttcatacgtaaatccgtgggtttgatcttactctctccagttgaccttggggtcatgttggtattagtagttcattagaacaatatactagttgttttagtactgttggaatagaagaatattcccacgaaattcatgaatcaaagttcaaactatacttgaatgaaaagttttctcgcatttcaaacaggaccacacagaacaaatgatccttcatttttgtatctgagctgtcatctctcgtcgtctctgtcgcccaatcactactcatcccctagtatttcactatcgtttttattttattttatttttaccgtgacatgaacatcacgcaaccgtgttgaaatagagataaataagaacaaactaagcatgtcaattaaggtggtgtttggatccataggcttaactttagtctctgtatttacatactaatttagagtattaaatatagactatttacaaaactaattacatcaatgaaagctaatttgcgagacaatttttttaaacctaattaatctataattaaagaatatttactgtagcatcacataacctaatcatggattaattgggctcaatagattcgtctcgcgaattggtccaagattatagatggattttattaatagtctatgtttaatatttataattagtgtccaaatatccgatgtgatagtgacttaaaagttttagtcccatttaaactgggtctaactaaagtcacacaagattttaagttcatggacatacgtacgagaagagatagaaacgtagtaataacaaaacaaaaaaagaagagtcgagaatctccctacagtgatttccgattgatgccatcatatcaacaaggtcgtaagtctcattaaacatacttgataaagcaatcaatcaattaactacatacaagtggttatatttgcgtcattagagactaaagaatattatttcatatagaaaagatagggacctacgcacctactagcttgacactcttgctctcttagggggtgttcagatggggctaaaactttttagcccatgtcacatcggatgtttagacgctaatttggagtattaaatctagactagtaaaaaaaactaatttcataaataagagctaatccgcgagacgaattttttaagcctaattaatccataattatcaaaagtttactgtagcatcacattgtcaaaatcatggcgtaattagactcaaaagattcgtctcgcgaattagtccaaggttatagaatgggttttgtaattagtgtatgtttaatactctaaattagtgtcaaaatatccgatgtgacagggacttggagtaagtctctagaaaccaaagcccttatacttccactcaatttctcctttttcttttaccttcggtttgcctaagcctagaagttgacagacctagttgactatcaggaaacagcttgtggtaatttttttttaccttttttggtatcgatctcatctcaccatagctgctcaaacatcttgaaatagcttggttgccaaattatcctatagttcacaaattaaattgttttagaaaacatgttgttaattaaaacctccaaattattaattcgctaatataaaatatgatatgtcaaaatagcatggatcataaaacactttcatacaattatatcttttaataatttttgcaaattaaagatacgattaaaagagaaatgatcaaacatgttgtatacaatgtgatattggtatatgccaaataaaaaggaacggctagtgtccattttttttcaccagagtaccaatacggagtaccaaaaggagtattctgtatcagcttttggtacttactccagcatagtgtagtgcacaaagaaacgaactgaatggcgtttagcaatgattgatgtcccattcactctgttttcttttttattaaatcatcccagggatagctgggatatatagcttggttgtttgatgtggctgaaaaacattcggcatatctctgtccgtgatggcaccct

SEQ ID NO: 66480 - DNA, 554 bp, Oryza sativa
gaattcgagctcggtacccactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagtgacccccgtgggcttatctccgccacttctcagtctggtgctccgcaatgaatcatgttatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccgatcacgattaaccatcgtgaaccatcattaaaccatcattaaataataatgaatca

SEQ ID NO: 66481 - DNA, 4756 bp, Oryza sativa
tcattttttttttaccgtaggtaatgataaatatggtaattgccttccttttcaactgtatgtcgattggaacgtttgcctttcgataatgacatggttgtcctacaacgactcaatgattcaatgaactatagttactttagacgacatagaaaaaccaatcaaatttatgtttttgaattaatataatcccaagccgtcagattatcaaacagctgctagatgagacaaagtctatcagtactgtgggcttacgtacttgggtgtaactaactaaactaagccgattgatctggtacgacatgctgccatatcgatggttcagattttggttagaattaattagcttaattgcatcggcacggacccaatcattgcgacatttatgtaacacaagatttctctccgtggcgtgcatgtgtcgtcactctcaatgtgtgtccatgtgattgatgtgtacatgacgatcgatgagcaattaagcgttgatcttggaaggccatcaacttaaggacatgttattttcctcttaatggattaataattcaccggcacactttgtaaactctcaaacagtacatgattctttcttttttttaaaaaaaactttaaccttatagatgaatttgttaaaacattaatttaagtccactttgtaacttaattaattcatttatctcttcagataattagagattgagatatatttgatagtgcagtgacaataagtatacggttttaattctgaggtccgtccctccaaatttctttatttttaatcttcatacaattatcacaaatcatatatctgaataaaagaacaccacccttaaattataaatcaaggtgggcacagccacgccattgtcgtgttcccgatgaggttggcgtatatacgtcatcgggtttgatcggtcggttgcgattgcatcatgcgcagtgtgcgacgcgctaccttgcgtgacggctccgcgcgcctccctcgccgtacggcacgtatcgagatgaacacacgggtcacgcttcagagttcacacctactacgaatcagcacgtacgtacaagagcactgttcacatttcgttttgggtagcctagtgagatggatttcacgaatttcaaacgaagttcacgtaggccgcggtgaatctgcgggtgcgttcagttcacgctaaaattaaaaatttggttgaaattaaaacgatgtgataaaaaagttaagaagtttgaagaaatggtttataactaaacaaaacctcgaatgaaattcggtaaaagtaaccgagggggttgatttgggagaggttctcagaatttatttttgtacggaccgagtggtaggttatttataatggaatatgttgatcatatttggggtatgtttagttcatgctaaaattagaagtttgattgaaatgaaatgatgtgattgaaaagttggaaatttgtgtgtaggaaaattttgatgtgatggaaaagttagaagtttgaagaaaaagttgggaactaaaccaggccatgaatgggtgcctgtatttatacctaatcatccattcggtaataagtgacgtaccaataagtaacgagacgtcttcgatgacttcgtcaatcttaaggtatattggtttagtcttcgaatatgtttattgaatagagtgtacctacgtctgtgtattcatacgtgtaagtgaccacgtgtgtatacgagcgcccacatctataccgtgtatcggaaaaaaataaaattctagacgacaaaagttaacatctaactagtgcttcttacacagatacagatggatgctatagaaatctcacgtgatggaaccaacccatccgagtccaagtctcagaggggggtatttggatactccaaattagcgttcaaacatccaatatggtaggggctaaaaagttttagcctatctaaacagagcctcagagttaatacatatatttgcatctacgattaattattcttttagtggtacgtgatatacatatcgacaacgagacgttcgtgacaatttcgtcgatcttaatatatgtccgttcatttttcaataatgtttaaaaggtaggacatacgtgtatatgtttacaggggacgagtatacgcgcgttattaccgctggaaaaaatcaatcaattataaccaggggaagaaccacgtcaagtagtgatcgtggggttgtttcgtggcccatgaacccacctactacgggcggccgtgggcccactaagttcgagtgggccatgttgggcttattatgttgttccacacaacttccatgctcacccaaccacacggtccacaccaacccacgcccttggacgcacttgcaggaggaatgatcttgtgaatgtgagatctcttctagaactgacatagatatatgtgcaacacatatgaacacaaatataccgatctacactttggaaacctcgaattgaaacatatccaatttgactccctagaatatatgtagaatctcgcatcacttaaccgtaaaatcaggtataatatctccaaatgttaaaaccggtatgaagtgactcccttgataatattgactgtggttttcgctgacgtggcacattgaccctagtcaaaccagcaaacgatgcaatgaatgcaaaaacaaaaagttaaaatgcattgtcccgcatgtaagtgaggtacccttcctttctactggccctctttctccccacgagtggcaagccagacataagataggcatgcagcatcgcagttggaaaatggtggtggtggtggtgacctgtgagcgagaacgaagcggtggcggacaactcggctagcgcggagggttgaatgcgggctagattttttgcggtggtgccatgaggccatccacaatgggtacccctgggtcgtgcccttgctcactgcgtccgtccgctatccgcgcgccgtgccctagaggggaacacaacccccacgagggggacgtgtggctttggctcctccaatccccttttcctgaggaacggctcaaaggaccccgttgtggcgacctcgatgccccatcccccgcctcctccccctgcattttcccttcttgccccccctctcagctgggcgtggtgaggcggagccggcgtagactgcgcggcctcgtcgatgtggtggacggcgacgggcggcgagagagagaggcggcgcggccagatctagcccaccgacagccggatctggagagagaggcaggagcttggacgccgtcggccaccgcactgtgctcttgctcccgcgctcgcgcgctgtccagcctcccgccgtcggccacatcgcccctcgcgccgctcgcccgccgaccagctctccggcacgcgcggagacgggcagccgaagggcggcggagggagcaacgacgagagagagggaggaaggcggccctcctcatcgcctcgcggctgccggcaacgagagagaggcgagcatcgagagggagatagagaggcgggcggtggcggtggctggggagagagggagatggatgcagggctggggagggcgaggagggaggcggtggcggtggctggggagggcgaggagggaagcggcggcggcgagcagcgggggagagaggaggaaggtggcggtggcggcgaatgggcgacgagggcgagaataagccataagagagaagaagcgaggaagaaaagagaaggaaaaaagaataatgggctggagaaggggtatttggggatttttcatctggggctactttgggccaagacacccattgtgggctataatacccttaccgggttgcttcagattttaaggagctcatccagggatacctcccattgcgagccgagttttctacgagtgtcctcggttagtgaggacactctaggagtgtctcacattgtggatgtcctaaggagctcagcagtggcgggagatagacgtcgtcctcactgcccccacgccttgctgccatatagattccaaggagcttcggaggtccatcgctgtcacatctgcatgccagctccgaaggcttgagctcgactagggaggtagacccggcaacatcacgacccttcgccactaggcggacccaccattcagttgttgttgcaaccgatgagaagctgttggacttgtgtgggggcactaccgagcctgactctgactttgcctcaccgtcgccatcgcccttgaccatcccgagtggtggactcctcgtggtatcgaccccttcccctccccttgaccatccccgccggctgaactgcaccagtcagattcagccataaagcgctaatggtgagccgacaaggacgggatgaaggtagaaaaagcctctcctgcctggggaagcaacaccatttccacccggtcttcttcttggcgcagaggatgacgctagagaaggtgtcagggataaagttgacaatgaagatggccatcgcgtggataaagcttagaagacgccaccaccgtctgctattgccaaagccaccctgttgcacacgagaagacgatatgagagacggagggggtaaagagggaggaatgacatgtgggggccactttttaaaaattctttttataagtaggtgtttttcttgttgattgcaggatcaaatcaactggcacgttcatacatctgaagacgagctttgaacctgcactggagtcatacatctgaagacgagctttgaacctgcactggagttaagcagatctcccaggcctcgtgttttctgtcaacagtag

SEQ ID NO: 66482 - DNA, 17168 bp, Oryza sativa
tcctgcaccccctgtggttagtgcaactcaactgtatagaattatgtttgtactacagctaaatgtggttagtgcgacacaaccgtataggattatgtttatactacagcttgctgctatagataatgtaggttttcatgttttgtgctttggtagactggtagtcgtatacaatgtgagtctgtttgtggaaatgttgcagcataggcacctatctaacctgttccatagaaaggtatgaatgatgttgtgtgcaaagtgcatatgcatataacagcttcatgatggatggttgaatttaatgtgtttaaccttctgcctattctgttctgtccttagatgttgcatataatcttggtcatggctgatgtcccaatagagtactttctagcttggaatcatgcatgctcacaggtgcacgccacttatatatccatctgatgactgatgagctgcacagctgattgtttagtaagcagcacatgacaatatgacatcagaacctgtcgtctcacaaatctgaagattaatgtttagcttcttgcttctagtgagagattacttggtctgtggccttctgtcaagtgccttgtgcatgtatgcatagtgagatgactgactgatacatctgtgattctgtgtacatgttgatgatggatgtaggctgcgtcgacgctggaaatggacgggctgagtgtactgtgtgcacagaagacggcggacgtcgtcaagaagcgcaccgtggaggaggtcaaggcgctgctcggcatcgccgacgtcggcatgacgccggaggaggagctcaagctccagcacgacaacgatgccatcctctgcctccgttaactacccgatctgccgatcatcatcatcatcatcgctacttttgtcgctgaagcattttgattccatctcgcctactatatatgatgtactttgaggtggtattgggttctctacgtctagatactagatatacagttttagcttgatgcacactggtagtagcaattctgagagaagtttggagtaattctgagagaagttttgccaggtgctcctgtgaacagtactaattgagagaaactattatagtgtatcatattaccatcgaagaacatgagttaattggtcataaaatcattgtgcatttcgaatactagcaaggttatatatgtcttactccatatccattagcaaggttattccgtcccaaaataagtgcagttttgtattggttatgtttaacatttgatagttcatcttattcaaaaaaaattatgattaattttttattgttattagatgataaaacatgaatagtgattatttttttataaattttataaataagacggacggttaaacgttggatacggatattcatggctgcacttattttggaagggtggtagtagtaatcaaggtgataataatgactagtaattcttgtcgagagatactcaattccaatgtcatcacgccgttcgaaaatttaaattctataaaactactcaagtttcttcgtgcaaaattttttacaatgtttatgtgaaatgttattatcacaagacgataatcttgagaataccaaagtatgaagaacaaaaattgaatcggcaaatatccagtactaccattttctcctttatcaaaaattgaatcggcaaatatccagtactaccattttctccccaagatgccgttgggcccacgccctgacaggcaggggatcacgtggcgtagcgggagggtggtgtagggaacccgtcccgtggctgcaggtggggccaggtataatcctgggcccacctgtaagtgagaggagtctgtatcaatataaccttctcgtaccttcacctcttcaacattgcgccaccttttcacccacccacttcacccccttccgctccctctccctcttcctcctcggcgacggcgatggagggcgcggcggcggcggcgggggcgggggcgggggcggggttgcccatggtgaagttgcggggaggcgacggcgtggagttctcggtgcaggcccggcggctggcggagctcgcgccgcgacacgtatgggacctgcccgccatcgagtccggcgacatctacgacaccgtgcagctctaccgcaggaacgccgagcgcttcacgagccgcgccaccggcgggctgcttccccagggggtcctgaacgtgcagaccatcttcgcgcagagagtcaacgacctcgacaccctcggccacctcacaagggtaagcgcccctcgctcctctccctctcctctcctctcctctcctctccggcaatggaggcatcttgcaattattagggatgttttccggactgtgtggtttgcgttgcgattttgtgtgcacttcgtcttcaaccctctcctctctttctcccgttgatcggaaccttccgcggattcagcagccagcgtcgcatccggcgacgggttggggtggtcgggggattggggggtaggaggaggaggggcctatgctgttccccgggcttagagtgatggccggggaggtcgcggcttggcggtggaaggggtcgtcgacggcgacggcgagggaaaccgtgtaggcggcgggctgcgccggtggagacggggaaggcgcagttgcgcagctaatcgatcggcgaggggagggagagagagagagagagagagagagagagagagttcactgttctagaggtagaagatgcacagaacccgttggatcttagaaccaacggcccaaattttggctgagatcttgcgaagaaaacaaacaagtagcagcttaatttgttttgtaagatattagtattatgtaagatatagtgactaaagtacttccacttttgaaactttgtcctagatatgctatagtaggctgcctgatttctctgttcagacagatgtttatgtttctaatctgatttctctgtacaggctgcgattgttctcggcatggaagatctcaaggatgaatgctacaataggatgctgcaagatcatcagatgggaccacagcaagtgaagctgtttttgcagaatgtgctgggacacccgtgaacggttccgcaaatggcatttttcctagttatcattagcagatcatcaccctggtctatacctagctagtgaagtatatactgcctatgtttcaggataggttaagtcttaagtacatacatggctagaactctgttaagccgactgcgtgcctgcgtgcactttatcaggtctagatgtgagagctacttgagttgtttggtgctaaggccgattcgaattgctcttatcaattcagaattcacaagcttaccagctctaccatgctattctgctttacttctgtttggatacatacagctttggttttctgaggtgttggaaatgtctgataataggtgaggccttctataatcatgctatgtcttttgctgctgttgtagaaatatggtgcactgctgcataggaattatgcctgtttgcattgtcatttgccagtgattcaaaaatttgcttttatctcaatacgagaatgtgattgaagccctcttctggtagaggatgatcgtgtggatattttctttcctgttgtaaattggctggttattttgaatattttatttttttgatcgcctggtggatctctgctgcgatgatgtgggcgcgctgataatgaaaagtattaattatgtaacctgggaatcagaatttgtgttgctctttcattttgttgatctgcttgaaatggatgtattcgggattgtatgaacctctggcttttgctcatttcattaatgaaatgggagggctctgcccctctttcccaattttgctggatgaaatggatgtacagaaattatcctgatatcttgattccacatctgtatgtttcaattttgcttctcaaatcactgatgatctctttggtttctggtgatgtacgagacactactattctatggaagcagcagccgactgatggagcaattctggttggctgatcctggcaaagggacagtctcaggggatcaaataaaacctattttatgaaccgtcaaaatatttggctgcagtgagatggttattgaatgaaatggaacaagtctatactatgcttatgctgttgtattctactctgttgctccatgatgtgtattctattctgctgtctgagcaaacatgtcctgaactctcttacaatttttgtgtgcctgaccactgaataagaactgacaatagattgcattgtcacttttggaaccttaaattgaggaagaataataaatggatttttttattcattttgcttaacaaaaccatgagttgtctactatctagtgatgtgcaagtcttgtggaaaatgtgtttgtggcattacagtatgatatgaattgcagaaatcttatcgacaaaaatctcatctgctgatgagataattgagaatggagacacctgtcgatggcttttctgctgacgccaacttgccaagtccacggcgaagtgactgtgaggtggcgctcggtgagtcgtccgatcaacattgtgcgccgtagatttgctactaaccgattagttttattctgtatttccagaagaagctgcagatttttttttcttcctattcggaattggacccagaccgtccgatcactaacgtgcgcaccagattgacaaaaaaaaaaacagagaaaaactctctgtatgaatatccaaccccagcaatatcgaaatttgaaaccgcagagagagagagagaggaggacgaggaggcaccgaggcagcttgctccacacgcctccgccgtgactcgccggagaggaatggaagaggcccgcgcgagagtcgtcgcctccgccgtggcgagaatgaagccaccgcgggcgacggtgacgcatgccactccggccgccgtcctcgcgccgcccgtcggcgacgtcccgcacgccgggtggcgggggctacccgacgacgtcgtcgccagggtgctcgtccacctccccgtcgtcgacctgttccgcctcggctacctcttctccccgcgctggctcgacatctggcgcgccgagccgctgtatctccacgaccgccagttcgtgtctcctcggatcgccgcagccgacgtcgccgacgccatagccaacgttctcgagctccacgtaggcgacggcgtccagttcgtaggcgtataaggagagagcgggagcgacgacgacgacgacgacgatgacgacgacgacgacgacgacgacgatgaagacgacgacgacgacgacgacgacgacgacgacgacgacggagatggaggtggaggcaacgaggtagttggcgcggatggccacgacctgggcgtcgtcgtccacccatggagagaggatgacgacgatgatagcgatgatcatgacgggggccccgacgacgccgaagacgaggcagcagttcaagacgccggagtcgtcgacgattctggacccggggtcgccgtcgaactagaacacgaggcagcagatcaaggcggtggagtccgagtcgtcgacgattctgacggcgaaggcgccgccggccgctgccgcctccgattccctggaggcataggcgccgacgacggcgtcatcagcgacgacgacctctacggccacgacgacatcccagatggtggttacgagatcggccgcgtctacagcttccgagtggagaccacgcggtggcgcgccgaccagctccaccgctggtgcgccgcgctccagcgcggccgtgttcgtgaggtcaccctcaccaacctcaccatggaagggttccccgacctcccccagggcatcctcgattgcggcacaagcctcaagggactccacgtcttcttcttcaccgtggaggccgaccacatcgaccccctcgtcaacctccgcgtcctcggggtgtacggctgcagcggcatgatcacgcgagcactccgccccgaatcggaaatccgggtgctgacgatcgacttcaaccatctgggagacgtcgtcgtccagaccacgcgcctccggtctctgtggatgttcaacaacgtggtgcagggcacggtcatcgtgaacgacgccctccaattccgggacctgcacctgttaccaccgacgaggccatccaggatcttcatcggtgacgcgcccagcctgcgaagcatcggctctctcgatctcttcaacaccgtcttcgtgatcaagggcattgtgattcaggtatgatcaaatcgatcaaatcgaatcgtgtccgtgtgcactgcatctgcatgcaaatcgatcgatcaaattcagacccctgcatgctgctcatccgattaactcaaatccaaatccaaattggctaattaacaattctatactctgatcatgcgcaggctgggatggtgcagcgtcctccaaagatgcgttctgtcaggattctcggcttacgggtgaactacacagatatgggtcacagagtgccccgtgagatagagcagattctgaagtgtttcccatgcttagagaaactggagatcatggtaataaacaaccaatccaaacaatcaatcgtttcattgtcctgaaatttgctgttatttgctctgcatcagtattagactatgtctgaattctgatttctgattgggttgtgcgtgcgtgcctttgctgcagaattactatcaactgtctctgtagttcaatggtaatatataatatgtctgaattctgtttgaattgtgcgtgacttgcagaattatcatgtctgaattctgattgaggtgtgcgtgtgtgcctttgctgcagagagacgatgaggttacaccagaagaagggctcctcaaagctgatggtgaacacatctatcaagggaacaatttcttccgtgaccttggttgtttcagccatcacctgaggtggatatatcttacaactttccgagggggcaagtatgaacttgctctgggcaaagccatcctcgacgaagctcgagccgggacaattttcagaatggtacccccaccaggcagcaataccgacaacatagttaaccagctaaggcgggctatgcaacatttcagaatgaccactccaaatcatgctgtcagagatcgacatgtgtccgttcttctaagtttggatggaacttgaagaaggctactccagggtgttgttctgcgctgttgtactactgtcagagagattttaggctgggctcttttcttcagtttgtctagcttgtcaaatgagcgaattgtgaatgatgctctctttgagtctgcatttgaacaaatccaaatcttgatagcagtaaaagtagatacaatatcttgatgagatgagcatgctgtttgtgctttgcttttaccggaaaatttgatcaacataaaagtgaattatttttcttagatgctaaacaactgtagtctgtagtgtacatgtatatttgttgatcatgatgctagacaaaccggaaaattatttgactgcggctagatttttatacaactaagtgacatgcatatacttgggtgcaattgtacctggtgcaaaaagaacgttctggttctccactgacctgtcaagcttctacatgtgtatggattgggcctaaagttaggctctaaactatacatgtagatttgttgatcatggtgcgtattgatttgttatgcatgtgtcaatgtctgtctatgtcgttcattttctcctactgatgttttttttttaatatgcgagacgcacatttttgtattaagaggaataaatgtatttacagagtgggcctgaaaaataaaaagaatgcgacatggtacaggagaggggaaaagaaaagcataagcctaatctcctaaatgatttggcgacccaagaacaaacgaaggaactgtcatggttggtatggctgatctagccatccgtcagaggtccgcttcccccatcatagccctggctatctccatccaaggtccgctcttctggttgaagacccgattgttcctttccttccagattgtccacgctaccagtgtcgcctcctactgatgtgttgagagtttctgaaatataattacatgtatctatctgaacgaacatgtactgcgggctcttacaatttttgtataggctgtgatggtttaccttaccagaccaccattaatcttacaatttttgtaagattggcctggcacttacataatcatataatgtatgaacttaactgtcagaaatattataccactattaattgttttggagccttgaattgaggaaggaatatttgaacttttttctttttttttttgcttaattaacaatcaacataactactaactagtgttgtttaccgtcttgtgaattgtgatgtggaactgtcaaccgtgtaaagtcttgtggcacttcagtatacgagttgcagagaaatctcatctcccaatgagattgctcatgctgttgagaaactctgcatttcacttttctccagcgttggaggatcatgtcgacggcgagcgccacctcttgcgctgccgctgacggtgttcttcagccaccaagttcacgccgatcgaagcgccggtgttctctctccggtggctaatcttagtccgtccgatcaacattgtgcgccggagatttactaagaagcgatttttctccagaagaatgctttggcttttccgtatatacagaagaagccgcggatccactccaaaactggatacaaaccgtccgatcagtaacgtgcgtactagattgaccagaaaaatctaaagcgcaaactcctctctataaatatccaaccccgcggctacattcctagccgtagccgatagcgagatcaaaatttgaaaccgcggagaggcggcagcttgcgccatacgcctcctcctccgccgcgtggagaggccgtcgccgaccaccagccaagtcgccggagcgagcccggtggccggagaggatggaccacgagagcatcgtcgccagcgacctgtccatctaccctctgccgcccgggacgcgcaccctggccactccgcgcgtcgtcctcgcgccgcctcccgtcaccgtcgtcaaccagccgcacgccgactggcgggggctcccggacgccgccgtctcccgcgtcctcgaccgcctccccgtcgtcgacctgttccgcctcggctacctcttctccccgcgctggctccacatctggcgcgcccggccgctgtatctccacgaccgccagttcaccaccccaccgatccccgccgccaacgtcgccaacgcaatcaccaacgtcctccaccaccacgtcggcgagggcgtccagctcctacccgtacaaggtggcggcggcggagggggaggccaaggtgaaggagcgctcgtgggcggcggcgatgccgatgaggccgtgaccagcgacgacgagatctacgaagacgaaggcatcatccagaacgccggtcacgagatcggccgcgtgtactgcttgcgagtagagaccacgcggtggagcctcgatcacctcgtccgctggtgcgccgagctccagcgcggcggtgctcgtgtgctcatgctcgccaacctcgccataccagagcaccccgaacttcctcaagccatcctcaactgtggcgccagccacctgggactccacgtcttcttcttcaccgtggaagcctaccacatcgcggccctcgtcgagctccgcgccctcgggctgtacggctgcatcgagggccacggcatgatcgaccgagtcctccaccccgaatcaccgattcggaagctggcaatccacggcggcatggggcgaactttcgccgtcgccggcgccacgcgcctccggtctctggtcttgttcgacaaccaggtgggcacggtcgccgtggacggcgccgcccgattccggaatctctacatgagcgatacgaagccatccaggatccgcatcggtgccgcgcccaggttgcgaagaatcctctcccttgacatcttcaacaccgtcttggtgatccaaggcttagcgattcaggtatgataaaatcgatcgatcaacctgcctgctcatttggttgacaccaattctgaatctctgatcgtgcgcgtgcagattgggatgatggagccgcctccacagatccgttctgtcaggcatctctgcttacgggtgaactacacagagatggacgtcaggttgccccgcttgatggagcagatcctgaagagtttcccacgcgtaaaatcactggatatcatggtaatgctaatgaacagccaatcctatccaataaattgttgcataattctgaatttgctgcttattaattgctctgcactgatatgtctgaattctgaattcgctgtcaattcctctgtacaaaagtgtgtgcattttgattttttctgactgagttgtggtctgaattctgaatttgctgctaattagtgatatgcgtggattctgattattctgatcgagttgtggtctgaattctatatttgctgtcaatggctctgcactaatttgtactatgcgttttgattttctgattgagtcgtgttgtgccctattgcagagatgcgatgacgttacacaagcagaagggctcctccagtggaacgatgcacactatgacgggaacaatttcttcgatggccttgagagtttcaactatcacctgaggtggatatatcttgaagatttcagaggaggcaagtgtgaagttgctctgatgaaagccatgctcgacaaagctagtgtcctgagacagttaatgatacaatactcgacaagcagcgtcccccagctcaccctgaatcagctcgacttgtctctccagaatttcaagctgcacactctaaatggtgccatcagaggcaatcttgtgtcctttgttgcagccgatgcttccggaagttgcgtacgactagcagcgcaaggctaggtcaggtgttgttctgtctgtgctctgcttcggggagagagagagagagagagaattttagggtggctcttctcaatttcttcaggtgttgctagtcaaatgatgctataactgatattctgctaagtgagtgaatgatgctctgagcatcaatgcagtgaatgatgatgccctctctcagtctgaacaatatgttagtattgagcaaagtcaaatcttgatagcagtaaaaatgtacagtatcttagcatctctgcaatagggcacaacacaactcaatcagaaaattctaaaattctgattgagttgtggtctgaattctgaatttctgcagtaatgtgtgtggaactctacattctgcttttctgatttgagttgtggtgtgctgcattgcagagagacgatgaggttacagtagcagaagggctcctcaaagcgacggatgaacacatctataaagggaacaatttcttccatggccttagaggtttcagagggggcaagcgtgaacttgctcttatcaaagccatcctcgacgaagctcgagctgggacacggttaaggatggaatactcaacaagaagcaaccccgagctcaccatggatcagctcgatcaacttgtctctccggattttcgagctgctcactccaaatgatgccgtcagaaacgatcgtgtatcctttgttgcagctgataattctggaacttgcgtacgaccagcagcataaggttaggtgttgttctgtgctctgttttgtcgacatcgagagagagagagaattttagggtggttctgtgagcgtcaattttttctgtgagccttaccactgaacatggcctgacacttgcaattttttttgacatatgaactggcagaaatatatcgaaataggctgtgtttagtttaacgccaaaattggaagtttgaataaattggaacgatgtgacataaaagttagaagtttgtgtgtaggtaagttcgatgtgacggaaaagttagaagtttaaagaaaaaagttgaaatctaaatagggccatagacactttttggaacattaaattgaggagaagcaatctgcgcgggcctttgcccccattggaaatggattaggatggatcagctagcaagaactggcaagcagcgccacctcttacacgaaggtaccttcaaatcagacgtccgatcctcttaggccttgtttagatctaaaaaatatttggtcaaaaacattaaatcaaatgtttggacacatgcatggggcattaaatgtggaaaaaaaccaattgcacagtttgcatgtaaattgcaagacgaatcttctgagtctaattacgttatgatttgacaatgtgatgctacagtaaacatttgctaatgacggattaattaggcttaataaattcgtctcgcggtttacaggcggaatctgtaatttattttgttattaatctacgtttaatactttaaatgtgtatccgtataattcaaaaactttacacacaaagaactaaacacacccttaaaaaaatcggtcagacaaatgtttcagttgaccaccagtaaagcattaaattatacatgataaacaaatcaatcattgaaacatttgattttttttgcaacacagtgaagacacacgttgaaacatgttgctatcacatatgaaacattgagtattaacgaactgaaacatacatttttttcatcagaacataaacatgcgatatcatattgtgaagatttagttacaacaaatacaacggtgttattggattgtagattagaaaagtagtttaagataaaaattattttgaaggttgctaaatccacgcatgcatgcatggatagtgatgagagagagagagtagggcaagtagctaaataatttttgtgaaacatagtgaatacatactttaaaacatgtcgttatcacataggaaacattaagttttaactaggggtgggcatgtggtctaaccgaaaaattcggttcggttcctcggtctttcgaaaatctcggtcttccgaatcacaagaccgatcggtcttcaagaaaacttaggaccgagcacttcggtcttcggttagttcggttcggtctcggtcatagaccgaactaaccataacagtggtttaaacagcaaaaaaaaaataatcacaaaaaaaattattccatacaagatcaatgaatcgaagcaactcagatgaagaactacaatatgatgccgctagagcatgattcaggaaaaaaaagaagcaaatcaaagcaaatcgatcttgccatgacttggatcccgtcgatctccacaattccacctaaagctccagatcccgtcgatctcccaccgtcgctttcatccccgaccggcctcctcagccatctaggtctccggtgcagcagggtcaccggagggagcacgatctcttccgccatgacaggtgaaagggcggcgccgaggcggaggcgtcctggccggaggcagcgtcgacgcggtggaggctagaggcggagggcggaggcggggcggtggaggcggaggccaagcggcggtgagcgtgaacgcacgatggatggggaggaatgcggcgctgaggagggagtgaggggcgtgacgcgtgaggtaggcagtgggagatagggtgggattagggtttatgttactgggcttattgggcctcataggtctattaggtcacaattcggttatctcggttaattcggttaaccgagcctaatgaccgaaagacctgaaataaattcggtcttttgatggctgagaccgaactactaaccaaatttctcggtctcggtcttgatcttttcggttcggtttttcggttcggtctaattgtgcccacctctagttttaacggtctgaaacatatatttttattttatcaaaaatataattatgtgatatattattttaaatatttaattgcaacaaattcaatcgtacgattggatcataatcggataagtagtttaggaaaaaaatatttacagtaatgagaaaaaaagaaaaaaaaactagctactacttattttgcatgcatgcaacagtagcaaggagcccatatttttttttcattcagatggggctaccgaacaagatgattttagctcttacactgacgatgaagtaaggcctggtttagttaccccaaaatttttcccaagaacatttcatcgaatctttagacacatgcatacaacattaaatatagattaaaaaactaattgcatagtttgtggggaaatcgcgagacgaatcttttgagcctaattagttcatgattagccataagtgctacaataacccactgtcacgccccgaactagtcccgaccggaactagcccgtgacgctccaaattaacctgttaatcgataccagtcccaggaaacagtgctggtatcacagggagacagaatatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactgggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacccgggcctagctgatcccgtcagctgctgatttttcaaacatcgaacccagtttcacaacagcaatttcacaagcagtagtcagacaaaactacgctaggaattacctcacatccgcccatgaccgtgggcacggctgttcgaatagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattctacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtttttacaaggggacatggtataacaattaacaaaggaaggatcaaatgcaacaaattaggtaggtctgccaatctgccttgcagacgggacaacagattaagtgtgatcctatcaatgcataatatttcgcaagcaatacaattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaaagacctttaagcgtgccactatatagatctcgagatttgggaaattttagaagttgaacggagtcaaacggaattacggttgggaagatattgaatttctaagattattggatttttggtctaaaggaaaaggatttaattaaatcctttttgaaaaagaaaagaaaagaaagaacagagggatggaaattagacttttcctcgggcggctagggcgcggcccaaggtaaatggagcggctcggccgagcttaacgggccggccggcccaagacggcccaagcgcgcgcgcgcgggagggaggagagagagtccggtggaccgggctcaccacgcgcggtcccgggtgggacccgcttgtcagccgctcggctcaccgtgcggagggagtacgtggctcatgcgcgcgggcggggaaaggacgcggtgcacgcgcgcggtccgtggtggacgcaggtgcggcgggcccacgagcagcctcacggctcgcggtggaacgcgcgcacggggagggactgaccggggtcggctcgatccggtctaggctgagctggcgccgacgtggcgcctacatggcggccacgtgggctggcgggaggtagacgacgacccggccacgaatggacggcgggcggcggcggcgagcggcggagcgaaccacggcgatacgggcaaaagcgtgcacaccgggcggttgcacgtgacaaggggagacgagccaacggctcggattcgccggaggttgctcgacggcggcggcaaccggcggcgggagaagagggaaacggcgacgaggtcacgagaggtcgattcccggcggtaagagcatctatgcggcttcgggaactcgacgctagcgtcggattgggcggaactacgccgagcgaggccggcgacgagcgggtgctacggagctcgagcggcgacggcggcgaacacacggcgagcgacggcaacggtcggggcggcgccggctaactacggggaggctactcaagctactaccgaaagctagggggaggagatggagcgaggaggaagaacggagagagacatcaccgagaagaggaggggtgctgtgacgagaggccggcggcgcgggagtaatctctccggcctcgggccggggaagaggaaggagagggcgcggccgaagtccccttccgcgtcctcgaacgcaccggctctcccggcgcttggcgaaggacggcggaggcgagacagagcacgcaacggcggcaagggctgcagga

SEQ ID NO: 66483 - DNA, 7934 bp, Oryza sativa
tccccctttttggtgattgatgacaacatggttaaagcttacaaaagattgaattaaattttgttttgaatggttagaggtgaatgaaactcccccttaatgtatgcatatggaagatatgagtggagctcatatgcatatatataagggagcaaccgaggagagtttccttcatccctactcattcgtgggatgcaaaaagcagtaagaatagatattatatgcaaaagatacgacgtggtgagcactcaaaaggataaaatcaacatcacatcacgaacaacaaataagacactcaaagcataaaagaaatgcaatatatataaagagcagctaagagcatctaacagtcattacatccacacaattagagaattattacatgtccataagttcttaagagtagaggccaaaggactgccaggtccggaacttccggataagatacccggaacttccggacaagcagacaagacaataaagcaaggaaactgccaggtccagaacttccggataagaggatccggaacttccggattaaacagacagagcaggtagcaagcatcaaaaacaaaattttgaccccccttaattgcaattttctccccctttggcatcaaggcaccaaaaaaagacaaaattacaagggaagaagaggatcaagcctcatcattatcgccatcagaaggaatgatctcagtgtcgctggagtgaggagagtcgatgtcttgctcggcggcgtccactgcctcatcgggatctgtaggaacattctcggtaggggcatctgactcctcatcatcactgctctcctcgagtgagaggactcctcattgaagaaacgagaagtgccagagggaccctcaccactagcaatgtctcgagcagtctcataagcagcaaaaggatcaacaaactcatcatcagaaatcaagccttttcttggtggtgccaaagaaagcagtggagtagaactatccaatcacttcctcattctaggaatactgcaaggccaacaaatctgccacgtgcttgcgctcacacaccttgcgtacctcattgaagactatgttgttctttgaggacatgtactgccaatctagccacttcatctctaccactggatgagatcttcccatgatcacagagttataccaatcaacctgcaccaaggtcctgaatctgtcatcctgagagtcagctggcagagtatcaggactaaccattctgtcctttccacacttgagtagatttttcagatagttcactcttgggcgtttaggatcaggatcaacagcccttgtcttgtacagcctcaaaggattgctttcagaaccaggctcatcctcattgccaccatcatctgactcagatgcagctggagagggagagcggggtgcatcacgaatgacaatgctaccagccctcctggaatggatcagaatctgactcccattgtaaaaatctccaactttttctttgcccaatctccccctaggaccacgaaccggggggctcgagtcaccaggaacatcttgagaaagcttctgtctcttctcacgaggcataatgaccactgcaacaagaatcaacaaggttggagtgcaatggttaaatgaaacagtagcagaatcaaggttactggctggctggacagagaccggaagttccgggccaagaacaccgaaacttccggcctgcaaaattgaagaacagaggatttaaccaggccagtgcatgtgacaaaatcctatagatcggcaatttacaaggtagcaggaacaattctatccaaaaggttttctccctaggttcacatatttagagatcggggcaaaaacatgatgaaccaaaggagaagatcaaaagtgctaccttgagggaaaatcgcaaatcgatcgcgggatgaacctcctagccaccaatgtggttgattccacggagaggaatcaaatttccacggttggaatagaaagtcgccgagaggagcactgtagcggcagctagggtttgggaatcggggaggagaagaagtaaggagagagaacaagctcgggctccccctgggtatttatacccccgacccccggaagttccggactgggatgaccggaacttccggcctgacagaacagagggcagtcaggcccaagttcaaaggaatagatgagaattcaatgatttagaaatgaaaacctatggacataaagagacttatgatgtatatgaccagccaacaatcaacattacataacaatggtcaatatacatcacaagaagggataaaaaccaaattttcgcaataaaaacacacaaaaattttcgcaaaatttcacaaaagggtttttggataatagagggaatgtttgagctttattcctggtatcaagaccatcttctacacaagaagtgatctcaagacacaaaagctcttttttttttaatttacattttagtgacacatgtttggctattaattagccaatcacccatcacctaatgttacgagagtctaagatattgagctcactcctaagctcgcaaaatcttttctcatctaaaggcttggtgaaaatgtcggctaattggctttcggttctcacatgggtaaggcatatgtctcctttagtctcatgatccctcaagaagtggtggcgaatgtctatgtgtttggttcgagagtgttgaacgggattaatggctattttgatggcactctcattgtcacataggagtgggatcttggtgaagttgtagccaaagtcttttagagtttgtttcatccaaaggagttgggcacaacaagaaccggcggcgacatattcggcttcagcggtggataatgcaatggaattttgcttcttggaggaccaagaaacaagggaccgcccaagaaattggcaagtcccggttgtgctttttctatcaaccttacacccggcataatccgaatcggaatagcccaaaagcttaaagtcacaacccttaggataccacaagccaagattaggagtatgaactaaatatcttagaattctcttgacggcaatcaaatggcactctttaggctccgcttgaaagcgagcacacatgcaaacactaagcatgatatcgggacgagatgcacatcagtaaagcaaagatcctatcatggagcgatataccttttggtccacacatttaccattatcgtcgaggtctaggtggccattagtaggcatgggcgtcttgataggtttggcaccctccatcccaaacttcttgagtatgtctttcacgtacttggtttgagagatgaaggtgccctcttgtgcttgcttcacttgtagcccgaggaagaaggtcaactcgcccatcatagacatctcgaaccttttagtcatgatactactaattcttcacaaaaagagacattagtagaaccaaatattatgacatcgacataaatttggcaaatgaataaatcactcttaaattttttagtgaagagagtagtatccgcctttccaatttcaaaactatttttcaaaagaaaatctcggagacattcataccaagctttaggggcttgtttgagcccgtagagcgccttgtggagcttgtacacatggtttggcaactttggatcctttaaccccggtggttgctccacatagactaactccgagataggtccattgagaaaggcactcttgacatccatttggaataacctgaaatcatggtgagcggcataggctaaaagaattctaattgactcaaggcgagtgataggtgcgaaggtttcaccaaaatcgagaccctcgacttggatgaacccttgcgcaactaaccaggctttgttccttacaaccaccccatgttcatcttgcttgttgcgaaagatccacttggtgccgatggcattttgcttgggtctctccaccaaagtccacacttgattgcgagcgaagttattcaattcctcttgtatagtgtcacgcccggaaattcactagtaatttccgaacttatttgtgcataaaatcctcgtccaggaatcagccgatgtacacaaactgacaatttaatataccaatccatcttaataataacgttacatacttacaaagaaaagaaaacagcagcggaattaacggtctagcgatggcttcagctccactcccacaggcagctcaactggggtataagccaaacgtcttctccttctggaccctttatcttcaactgaggtttgatgattattgcaaggtgagcatatgacatactcagcaagccacacagcaaatatgcaagtgcacaaggataccaaaggatggcataatataggctcatttgcaaaagcagcatttagcaaaacatttaagagaagtaaaacagtgaagtaattaatcagaaattttaatcaacactgaacagcacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataactgcgggcacggctattcgaatagttttactctggccagaggtgtaccactgtacccacaagacacgattccacacatgttgccatgccccgaaataccaccacagcattgcaaagggggaaatcgtgacaatacccttcgcacaacacaactcaccacagtgcaccattcctggatcataatcaccccctcaaaaaccagagacatggactccccagcgacccccacagacttctcgccgcttctcagtccggtgccccgtaatgaatcatgctatacaaaaggtaaagccgttgcccacgctggcttgtggttggcacggttaatgtctcacaacagtagctcgcgaaccggtccttaattgtcatgagcacaaccatcaaaaccatatgctcacaacccaccttaaccagattttaattatcaattaattaacatcacacgattaaccatcgtgagcgaccattaaatataaccataataataatataatataatatagtttataattaacccctttagttagctaatgtttctaagcatagctaagcaaacttacatatagcatttagctgaaccaatccaatatataaggttcatgctaatcaaattatacccataagaaaataagatcatcttcggccattaattaacggggaaaggttcaccacccgatgacattcaaaaataatgcatagttgaaacaaaataatagctttaaacgggttcaacatgctcaaagggttgtttgggatctgtgtgacttgccttgagcttccgcaaacacttccgaaccttgctcaacgaaaacgctctcctttagaacgtcggaaactaaagtaaaagaataaaaatcaacaaaacagtacaaaaacaagcataaacagtacatgtgaatatttttaacatgtagatcttgattttagaaaaatttagcaacttgaaccacctgaaacggatctacggttatttagttatgattttcagaagatttaatctattagaaaaaactggaaaaggagaagatgatgacgtcatgatgacatcatcaatggcggccggctcggatggcgacctcgccggagctagggtggtcggccgggattttggaggacacctatacgtagagaacgacgagacgaacccgatggtactcaccaatgcgtccaacgacgaccgacggcggccggcaacgacgcaagaggcggcggcagctcggttgaacggcggtgatggcgctacgacggccggcgacggcggagaaggggcggccgagcttccccgctcccgtgcgcacctaacggcggcaacgagaggcggcaacgacggcggacgcggcggcgcggcgtggccggaggatggccggcggcgacggcggcggcgacggagctacggagcacgggaaggcttgggaattggggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttggggataaggatagaggaggataagaggaatatttcccctcaactaattttaggaaaacacaagagaaaagatcagatttggaggggaaaaaccgagcccactcggtctcggttcggctgctagaggtagaagatgaacagtgcccagggaggaaaattagacttttggttggctgagaacagaacagagcacttgacttgggccggcttgggctgcacagcacgcgcgcgagggagagagaagaggaagaaatgggccgaaaagggcccaagctgaggaggaggatttttattacttttctaattaaaataatcacttaaatgatctttcaattgttaaaaatacttccaatgctcaaataattccaagaaaaatcttgaacatacttggacactcaaagtatttaatataataatatccagatcatttaatgattaatttattatttaaataattgctgaactgctctttgtatgattaaaattaataattgagctccgaaaaatccgagaaaattccagagagtataattaaccatggagaatttaataagaattaaatccatccatgctttatatttaggaaattttatttcccacatttaacttcacttgtaaattaatgaacatttaatataaattctaataataatttattaaataatttataaatcctgaaacaaaaatcaggatgtgacacatagccatcacccaatccggatcaccaagcgcatcttccaccctggttggttccaaagaagagacaaacgagaagtgttgacaaaaacttgcgacacgagagcgagtagttaccccttttcttatgtcaccaagtatgttgtcgacgggatgatctctttggacagtgtgatgtatccttagatggtgcactgggggggacctgagcctgatcagaatgctctaaagtgccctcaacatcgatcccatccacttgtgctgttgacacgtcttcactaccactggtctggaggttccggactgtagaacccggaacttccgggcctggagatgtccggaggttccgatcaataggacccggaacttccggctcagcagacacagcacttgtagggctattggatgtcgatgacggaggttgatccctatcttcttggtcatcctgcgtctcgactggtcgtatgtctccaatagccttagtacctatagcttgacttggatccacatcccctacaacatgtacaacaacttgctctccttgggagccattagattcatcaaatgtcacatccctagtgacttcaacaataccggaggttttgttaaagacacgataggcatgtgcatttgattcatagccaagtaagaatccctcatccacctcaggtgagaacttagatgagcgaggcctcttacttaaaataaaacatttgctcccaaagacacgaaaatatgaaacattaggcttcttaccactcaagagctcatatgaggttttctttaggatcttgtgtaggtacaagcgattgatggcatgacatgcggtactcacggcctccgcccaaaatacatccgaagtcttgtactcatcaagcattgcccttgcggcttcaatgagggttcggttcttcctctcaacaatgccgttttggggaggatcatagggggcggagaactcgtgcttgattccttcttcatcaagaaattcctccacttgagtgttcttgaattctcctccattgtcgcttcgcaccctcttgatagtgagatcatagaggttttgggc

SEQ ID NO: 66484 - DNA, 1786 bp, Oryza sativa
gagaagtggcggagataagcccacgggggtcactggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctcccacaataattatggatgttatacctggtaataatttgcttagctcctggtttggagttagatctgtacagccgggtatggttgttcaggatggttgggcctgtgcagcatgggtgtgctgttcagtgttgattaaaatttctgattaactactccactgttttatttcacttaaatgttttgctaaatgctgcttttgcaaatgaggctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagaatttattttccgctgcaattttcttcctggtgaggactaagtgcctcataagtaagtatttatcgttttagttaatttgatgaatctgtatattaaattgtcagtttgtgcacctcggctgattcctggacgaggattttatgcacaaataagttcggaaattactagtgaatttccggacgtgacaagttggtatcggagccatctcgactgtaggataagtcaaatggtcaaactttaaggacgaatttttccgacaaaaatgatttgtgaaaatttctcctttcttgcttatctagaattctttacaaattgtttcattgtctactcccgtctctctttcaacttgagtagttctgagacattgaaacttgaagacgccaatgtgtctacttgtggaggttaagtcaagtggatcgatgaataagaaggtgatggtcgatctgaagtgcccagatgtcaagatggaatgaagttggcatcctaccttagaacctatgccgccaaagtgtcgttgaagaatagttagtaggatagaacgtttgttgtttgctttgtgtgtaggtatggttgcattcccatcattggagtagttcagtgatgagcatgtaattatactaggttgcttgcttaatcaacttgaacaatataatggtctacacacaccagatcagtggtaacctggttaaggtcttaactttagtgtaacctctctccttctatcttctctaatatgcaacagatggtgaacactcgcgctagtggaagtggaaacaataacaatgaagggaacccaactcttgctcaagttctggctcaacagactcagttaatgaacatgatgatacagcagatgcagaaccagctcaaccaaggaaacaacaatgctccaccgccgcagaataagctagctgattttcttcgtgtgaggccacctaccttttctagcactaccaacccagtggaagcaggtgattggctgcacgctgttgagaaaaagtggaactgctccagtgcactgatcaggagaaagttgttttcgcttcacatcagttgcaaggatctgcttcagaaaggtgggatcatttccggatt

SEQ ID NO: 66485 - DNA, 19612 bp, Oryza sativa
aggcggcgggcgcctggggcagcgtggtgcggctagcccgggcgcggaggcggcgggcaggcgcagcctgcccagcgcggcagcagcggtgcggcggcttcgcgacggccgctcggcccggcaacccaagacgcggcgacgtctcctgggatgcgcgggacggcgcgagggccgcgcgtaggcggcggcaacggcgcgttggccatgcggaggtggcgggttggaggcgcgaccagcgacgctgggcggcctgggtcgccgttggtgggcggcgaggtggcggcggagcattggcttcggcgaggccgccgttgggcttggcggcggtgtggagcgcgctggcggcggggtcgtctttcccgtggttggccaggcggtcgctgtgttcgaagagctcctccccttctttgtggggagcttctaggcacggtgaaggcgttggccggtctaccagaaagactcaggttgccaaggcgaggttgttcccggtccggtcccataggtcggattcgacgtggaggctgaagggcggcgtggcggaggtggcctgggtcagcgtgctagggcgtggcggcggggtcgtcttccttgttgtcgaccaggctaaccctgtttggcgagctcctcccctctctgcggggagcttcttgacaggctggtggcggtggtcagttgacaaggaaaactcaggttgccgaggcaatgttgttccatgtccggactcccttaagttggattcaacggggaagccggcgggcggcgtggcagaggcggcttgggtcagctacctggcggaggtggttggtgctgtggcagtcttgtcgttggcaagactggaagccggccggcggtggggcgtcggttgggtgtggtggaagccatgtgccgccgatgtttagatggtggtttcggattgggcaacggaccatggcggtagggggtaccgagcgaaagcttagcccaacctttgggccaacagtgactacgctttcgggtcgctttcgggtgtggtaaccctcctgagggcatggttgaggtacccctcctcccttggcaaggagctctgggtgaaaaccttgttccgtttttgggacggatgacgacggcgtcttttggcgtcgcgaccttcctgagggcgtcgttttagagtcttcgcgtcgtggtggtgttgttggcccggtggcgatcggtctcgcatagcgacggccggttcggtgctcggctcccctctctgtagcgtgtgtttgcggttggcacttggttcggggcgtgtgctctagtgcacatccttcctcgacaaccagctatcgatgtaaaaccttttcttgtaaccttttcttccaatcttaattgaatgacctccttcggtctttccggcgaaaaaaaagtggccaacacgacaagttagcaacacccagcacctgaccgccgagagtttccgcactccgctcgcctgcgcggtgcaccggtgacactgtaccgaaccctgcgcaacccaatcacgtaagctcaactaaatttggcccaaccaaatgctcgctgctagtactagtacaagcgataggggggtctagaatgctcgctgtccatatattagatagataaactggtgagattttacagtcgacggcttgctgctcagcacttgcgctatatagaaagagaagtaatcaacattacagagaaaaaaacgtgcagattggtggcaggacacatattagttcatccagcaaaactttagactgtcacagacaacaaacgctatgtcacacaatgtatgtatagctccctctttgggatgtggacagcggacgtacagggttactatcagatactgcccaatgcaaaaactacaccagtacagaaaaattacagtggaacgcatacatctgcatatgaaaaaaatcgtcacactgaaaagaatcgaatccgacagatttatatagcaggaaaggtggtgctggtgatggctgtgttgaagatggcttatctgctgattcggtagaaggtgcaccattgtaacggtgatattagaatcaagatcacttgtcgcgtccgtcatcaccggtgctgctattttctcggcattgtctgctgcttctagctataccctctaagtgtttcagcaggagcaccttcaaatgtaggagctccagaggttccttgagtcagggagtgccctgcattatcgggtgccttgaatcataggagtgccatgggccattggagaaccttagcttctacctatccatcattgacccatcgatcagtcctcagcttcaggggtactatattgctaggcaggccaagttttcgcaccagatcttttaattgcaacaggaggtgcagatagaggaggccgaaaaacactgcagcagcatcagttccttaacagttggtgcgtgatccagctccttctgtagcatcttattccgcgttatgactaaattcctcaatgatagacgaccatgggctgaaaagtgaaagatcctttgtaagtgcttgataatacatatatttgagcacatttagtcaaataacaaatgaattctttagggcaacaacaacaacgaacagattgaataaaaaacacttaatggtttggctaaactcatgagagaggattggaaaatatgcaaatccttctctctctctctctctctctctctctctctctctctctctctctctctcttaaagaaatcaatgcacatcctctgtatttctaacaggttcatggttcattggtctgctcaagccatacgccctaaaataagtctaagcacatattcctattgacattttactgatcatgctatagcttgcttaaacatacataatcgaaatatgaataaagacagtgtatagcacataacttatgagatgcaaacaaggaaacataaggttttatcatgtgcatgcatgaacaatttgccactccatattccacaaaatgtgatcaaactggagaaggaaattacagacacttgtgtgtggtacaactctctaataatgacacttttgcagacgagatcatgtgggtgagaacttaatttctttatcacaaaaacagtcattgacaagaaccaaaattcttaatggaaacatccaaatcttttgaggaagtagcaacgctaattaaggaagacctagacttacggacttttgccttcaagcctccctaatttcctttctttctttccctccgatgtatccttaagttgtattctccccctgatctaagcccctttaaaacgttgtaacaactcttttttgccctttttccttctaatataaccggcagccctcctgtcctctaccgtttcaaaaaataatagaaacttactactgataaattttggtcaaagtaacataccgacagcctagtaagttcatggtttccaacatggagtgccagacctcgtagaatttctccatgtaaaagcacgctttatagaagtcgcagcagccaatctcagcaatgctagcctgtctggtggactctgtggcatcgataaagtctgaaaattcgttgacaaacttcaagatcgatcccttgcatgccatctgccatactttcttgcttagctactggtaaattaagggtgtgtttagttgggaaaaaggaaatttttaggtgtcacatcggacgtttgaccggatgtccgaaggggttttcggacacgaatgaaaaaactaatttcaaaacttgcctggaaaccgcgagacgaatcttttgagactaattaagccgttattagcacatgtgggttactgtagtatttatggctaatcacggactaattaggcttaaaagattcgtctcacgatttcccctatgactgtgcaattagtttttctttttatctatatttaatgcttcatgtatatgtccaaagattcgatgtgatgtttttggaaaaaaaatttagggaactaaacgggcccttaagaaagtgtgtaacatcggtagcagtagtttcttgtcccacatcctggcaatggtcattgtcaaaagcatgcaagtgtccttttcaagtcatttagtactttgcagggtgagattgaactccaacctgaggaatatcagcagaagtttgaattcatgaagaaacacagaatagtttctgtcaatatcaaccagtacacgtaatttcacaatacagtttaaatagaagcatatcaacataaagcaactgagaaataatatgcacctggggatgaaaacggagcggatacggacggataatgctcataccatattcgttttcatattttttttaccggatacaaaaacgaatacggataactcgaatacggatagctcgaatacggaaacaaatacggattatctcgaatacaaataagaatcgaatatgatcggacacgaatacggaaacaaatttttctcggaacacgaaaaccaactcaacttctaatagaaacaaatatcaacatatataattagctcattttatataaaataaggtataatttataaatattttttaaaatttaaataatattaatagtatggactagtgttaagagataaactactattaaaatctataaaggtatattgaaggttatagagttagaaagaaatggggtatatctcatgggtcctgcggatattcgaatagcactgttcaccggatatccgaattattatccgtatccgacggaaaccctgataccatattcgtattcgtatccgagagaaaatatccatattcgtatccgtatccgaaatatccgagaattatccgatccgaaaggtatccgtatccgtttttgtccggagcggacggaaactatccgctccgttttcatccctatatgcacctcttggatattccaggtaaatgatgaaatgcttcaacagcatatccattcccagcataaacttagttaggtcatcggtgctcacgaccaagtctagtggccctgcataattagttttgggagtattacatatttacgtctcgcactaaaaaatgtcaacaagatgcaatgttctaagaataaacatataccattcgcgacactaactggattgacatatcctgcaaggcaccgacatcctataccaggatggctgaggataaggcatgtgcgcacatatacctacaaaaagggagtgtcaacagttacaacccgatgtaattcaagataaccataagaaaaaggtaacacccctttttcttctttgcaaactttattccataagaattcgttcatgaaatgagataattaaaagttacacacttacctgtcaacaagtcagagaactccatctctgacactgacaccaatcacaacaagggatacaattggtcatttcagctcaaggggaggtggcttactgtaacagatacccctcctccagcagcagcaactctagcatatcttctatcatccatttattttctgaaacacgcccggcgattcttttttttcttgaaacactggatctccgcaatctgaaacattgccaatgaggtggtctaagatgaaagtttggtaaaaataacttacccaatgtgcaatttaatataccaaagagagaatgggttaaccagcttgattttgactaataagtaaataatgacataaaagctataatagaatttttgcaaaagggcgatatgagactacaggtcacataagtaatattgcacaacaagaccacatcgatcacattgcatcaaccaacaaaaaaatcaaagatattcaggaagcacgaagcccttacatggatatctcaaaggcaacaaacacacctatacatgtataactggaaattctaagatgacctttatttggaggaaaatggatcatctgaagcaaatgatgacccacttcccccaaaacctgataaaggatatagctgttgtgaactgattctacaagatttagggtgtgtgctaagcaaagcacgtccaatgcaatctaattatctgcacgatcacaaccataaataccattttattgaagcaaagcagtactgagtaccgacaatagcatgcttaactagttaactggagaagataatattctactgctgaacaagctgaaaaattaggtctccaacacactgatcaaccaactaaatgctcaaaggtgaaagcaaagaacaacttatccgtacctgttggagccgtcgcaagaatccgtgcgccacttcagtgatctccgatttctgccgccgcgttcttgatccagccgtattcgccaagaaccccgcttctatctccgacttcggcggggtgattcttcatctccgatcttcggaaccgccttcttggcctctggtcgcgttcttgaggttgccccgccaggacctcgtgcgctccgaaacttctcgccgttcttgttgtactcgtgcattcttggattccggccgccttcttgccgccgatatgaacccttggacgccttctttgtcgtcgtggtcccgtcgatgctggggccgccgccgtcgaagaagccgtcgccgtggacgttgggggcgccgccgtcaccgtggacgctggggccgccgccgccgtggacgctggggccgccaccgtcgccaagaagcagtcgccgtggacgctggggccgccgccgtcgccaagaagccctcgccgtggacgctgcggccgccgccgtcgccaagaagccatcgccgtggacgctggggccgccgtcgtcgccaagaagccgtcgcggtggctgcctctccccgaaccggctggtcaccatcttcgcctcttgggtcggcagttcgacccgcgttgttgacgcatatgctatctcacggcctcaacacgtaaaaggaagtacagaattgggttcacatagtccgacccatcaaacgacacaatgttcaagcgtccaaccacgaaccaagaaacacaagaaaattccacggcaccgacgatcggcgctcagcgctgacactcattgagcgaaatgtgaacatgtaggtcctcgctgagcagggaacctgttaccgcaattgcggcaaacgaatggcaagatcagacgatggtgctctaaacgatagtggcgccacatgtcatccctcgtgaggcgtggtactgtcaccgtctcatcgtcgtcagaaagaacacacaccctgcacaagaatcggtgaccacgagcccacagagaaagcaccggtggtgctggtgccccagcctggatttttcacattttggtccttttaaaaaacttatttcgcaaatagacccctagaaaaacttatcctaaaaatggtcctttttggggcgccagagtggctggcgccgtcgtccaacaggacagtgccagcctctctggcgccgtccccctgccgacgtggcggggcgatgctgaggtggctagggagtgcgccagagtggctggcgcccccccccccgaaattttttatttttgttttatttgtttgatatttttttcacgcttagggacacataaaaaccaaccatagaaaaattgaactcaaatggacgtaatatgtgacctgtagaatttttcctctcctctcctctctctccgaactagtgcaaaggagagatgtgcaacttttttatttttattttattttttgatatttttttcacacttaggaactcacaggaatcaaccatgtaaaaaataaactcaaacggacgaaatatgtggtatgtggaattttccaaagttctaccgaaaaacttctctcctcgaaaacacaatcttgcaagcggaatttggaggttttaatatcgccgaacccggcaaagctagagagaatcggatgtaacattttctatagatgtccgtgcatatattatttgcctgattccgagtccgtatgagaaagttacgcctattttattagatgacatattttgtccgtttcggtagagttttggaaaattctacaagtcacatattttgtccgtttaagtttattttttatacggttggttcctatgttctcctaagtgtgaaaaaaatatcaaaaaaatgaaataaaaataaaaaaaattacatctctatgtactgtttaacttatatatgtcatttcatgtggttatattttgaattagattaagtaatttcatatagtggtagagtgcattatgtttaacatgctgatcaaagggttttactaaaggaattatggtctaattttagtgaaggtgcaaagtagactgagtggtatgctagctattttcagacttagttaagtggtagttcgagtttaaattttttttgtggttggttgtatcgtgatcctaagtgtgaaaaaacatccgaaaaaataaaataaaaatgacaccgttgcaacttcatacagagaaacaggaatggaggcggcggcgccagcatggctggcgccctcctcctgccacgtcggttcgcgtgcgccactgtggcaggaggacggcgccagcctctctggcgccgtcccgttggatgacggcgccagccactctggcgcccaaaaaaggaccatttctaggataagttttttcaggggtctatttgcgaaataagtttttcaaaaggaccaaaatgtgaaaaatccagctgccccagccccctgcccgttctccatgtcttcgatgtgatcacacgtgggggagaggaggcgttgacgtgggatgaccagtgggagagagaggaggggttaatgtggggatgacaagtgggggagaggagaggatcgtgttgcctaattccccttttataataggtgagcagataactatgtgcgtcaagccgtcgattaatgtaccgttgatgtacagttgcttcccgtgtactttaacgtgacagaaaaaactacaacaccagttagctcgattggatccaaacaaaatatttataataacaaaaataacttacatatttggactccatctttagcacatgacaaataattttagtaccgaaagataaaaagatacgggggctgttcagattgatgtcattttcagccatactattttttttaaagttgtcaaaaaaatatctacgtttagtttgttgccaaatttggtaaatatataaaaaatcttaccaaaattttgacaatattaccattttggctacaatctgaacaggcccataaaatatcgagagagcgaggtcaagtaactcaattgattagtttctgtctacttaagtcatacatttggtctacttaagtcatacatttggtacatatatgcttgtatttacgattcatttatgtgattttttcggtccgatttttatccggcgtacgtcgccacctccgtcactccgattttgctgcgcaatgcggcccacaaagtctggagtctgtgcgccaccagcctgcagatcgctcctatcgctacaaatcagacgggggagttgggactcctctctgtctcgcgtcggcgagccgttgacacagtggttccagggcgcaccgtacagcatggatggagcaatggagagtagtatcaggcgcagcagattcttttttcacctgaagatgtacttcagcacttaagtctttacggatgtgtataaggcaagcgattaaataaacaatggtcacagctgatcataatagtgattattttttaaaagtatacatatatatggttatcaaattcatatactctgtatttatatgtttttcaataatgaaattttattttggcctttatttcaaacataaatctatatccatatatctttatctatacctaattagaaaataggtaaggcttccgggtcgcttggttccggcgtacgattacgaggatgacggcctggatctcgggaatcctgtcgtcgtcttccgctgttgtctcggcgccgatctccatcgtcgtcgtcgatacggcggcggccatgaccagtattgtctggcacccgtcgttcgcgatcgttgtgatcgtgatggttgtcgtggtcccggtcctcgtttgagcggtctcctcgatttatgttatcatggcaccgtgaagagacatgacgccgagagcgattcacgttgtctcgtgtgcgtcgtgcttctcggcggccgttgatttgatctcggagatcgccagtgccgcgaggtggaggggtagctcgttgaggtgattccctccgttccggatcttcaccattggcctcgccagttggtggctgctcctggtgtgctgcggtagtggcttcttcaaacgcgttgctgaggttagtcaccgattcccgtagtcgttctgtccaacgctcgaggtcaacgttcagaacgggatcgtaaggagttttcctcagtatcgcttgaacagccctgatatgctgggctagagtagttgattgattccccacttctgcgttggcgtgcgctgacgtgccaacgtcatcgatagccaatacctcccacggcgcgctcgttgtcgatgacccatagtcctcaaggagatgtaagaccgatggttcatgaggatcgatatcgattaccccaacgaatcgatctgaagttagagtcgctccttgttccttgctgttatccctgatggggacatatgacttaggagacggagctttcatggcgccgagaaagactttgcagctcgagaggtcatgattctttgtcttgtgaataggacaatagacatcctgagttggagaagtacgttgaattccatgttctttgcaggcgcgaatttcaacacggacgttgaggaaaacccagcaatcttgcagagtgtgtttcttggttttgtggataggacaccaagaccttgtggcttcggaagtcatctttgtcgactcgtggttcatgtcggaaggacaaggtttgaccgtatcagaatccttctcgagcttagatgtcatcgatattccgttcttcgtctcgatgggaggatttttcgacatggaatcgccttggttcgtagccactgcgttctcgtctccagtcattggaggactggttgagatcggcgtcgtggtgtaaaccgggaagacgatttcgccgacttgagtccataccagcattgttgaagcagggagtactgaggctagtgctgacgttgttgtcgacgaagctggatgacatagtagtagaaccttgagtaccaaggccccctacctggcgcgccactgtcgacgggtgatacccgtagaccagatatagagggtattggggtacgttggtacaaggacctacgtagtacgacatcaagcaaacaaaagacaagaattatactggttcaggccccttgataggtaataaccctaatccagttgatgtgggattatatggtagaaaacacagattacaaagggaacaagggaacttgtcggatccggcgagattgtagtcgagttgtttcgactagccctcgacgatttggctcctcgtaggctccggcttcataggctgtgtaggttgtgttggctctgagattcgatatcttaaaccctccctagggggtcccttttatatcgcagatctagaggtctccacgtagaactcggacgtatcagaccctatacgatacgccaacgacccagttctgcccgagtaggattcttcccgtctataaattccgtgaaaggtttccttacaatatacaggaaatattcgcatgcgcgtggatatgacatatcgatatgtaacgtatatcgaagggcaaagggtatgcctaacccgtaaccctgacaagcatcattttaattgcttatgactgtttattaatttaattctagataaactaaaccaactagaaatttgcctacatatttctcatgatgtgtatttattttatgaccaacgttgattataaattcatataggttttatttatattcatgtttataaattatttatgcctgacagtgacgtaattcatgaattatttctgtttaactttgtaattaattgagccaacacaaattaattattttcatttatccacgtgtttcgtgttttacgtgtcgcataaaagatttttaaacacttgattaacaacactaacccacacgccctccgtccccatactcactaggtgttcatcgcgtacgcaggtcaaaggaaaaaaaaaatcagggatcagagatcgaatcaaatcctaatcacatacagcgggcaaaccacaaaatcgaatgtcgattaaaaacccaagcgacaaatatcattcaaagtctatatcaaataacacaaaaaaattaaaccaaagtaaggaaaaagtataatatatagcgatccaaaacgtttttacccgttgcaacgcacgggccattttttttagtaatgataaaattataatcggatagtagcgcacacaggtgcatcaataactttttccacattattaatttgatttagagaaaagaaatcatagcatcgaaggagtaacccaaatttgtgggggccaacttttcatgtgtactcctggtaaaggcatcggcttcatcaccttagccttcaagtcaaaaactccaatatcacgtggcatttgtttacggtcccaaaaaaaacttaaattgtcttcagtgaagtagatgcaatctgcacctaatccggggatcctatcactcaaaaagaatgttgccgagttgctaccaatgaagattgacgcgccaccaaaatcatgcacctctctccactcgcttcctctaggacgctcgtcaagaataaatgcttggaattttactgttggatcgggtttaagctcaggctccggctccggatcatagcggtagttgtggacttgtgggctgcattgtaattgtccttgtcattttcctcctcaatagcagtgacatcgtcatcgctttcagagtcacatcgatcggtactatgctccctcaaaatgagcatcaggtttccgttcggtgactcggctaggtacttcctaatgtagaggggcaggccgtcttcgtctcgggacataaactgtggagcaacgtttcttgggttaaatggtgttgtgacgtcatcatgttcccaggtttggactacgccatctaaggcccctcacagtgctcctagctgtagcgtggcttagtactgccacgtaggtttttttcacccgtgtcgctcggccacgcttctctgcttggacgctcgtgagtaaactaggatgcgcaaaaccaagcctggaaaagggaccgcgcagaggaatcgaggggaggcgctagcgctgtgggcgtcattccctcgccgcccggtgctctcgcgcgggattcggccggcgaaatcccctattcaccctcccaaaatcccctcccgccacaacattatttctcccgccacagataggattggaagagaaaaagcaagaaaatcttgaagattggaagagaaaaacagatcggattcacggcaaaatcatcacagaaaaatcatcacagaaggcggtgccggcgaattccaccacaaaccaccactcaagtcaactcaaatcaccccaaaccacgctgaaatcaactcaaatcaccccaaaccaacagatctggacagtgcaagaaaagaacagcagcgacggctcatgctcctcttcctcgcggcggcggcggctgccgggctcgccgcggcggcctgtgccgcgcggctccgccgctccccggggtccggcggcgctgctcgaggtcccccttcggcaaggtcgttgcggtggaggcttgccccgctcgagcctttcccctcctcctctgccgccacacgaggccagcgccgcgcttttgcccgccatcagccgcttgtctgctcccgtctccggccgcccgtcggcgacgcatcgtccactcccgccgctcccaccgctcccgagtccgcgcgggaggagaagcgagcggcgcggtcgacggcgaggcgcacggcggcggcgtcctcggcgcggtcgccggattcgcctcggccaccggagggaggggaaggaggcgcaggggagaagcggagcggcggcacgggaggagaagcgaagcggcgcgggaggagaagaaggcgatggcgatggagtggaggaggagaaagtcgctaggggtaggtggggaataaatttcgtcccgtaccccgtgtctacacgcttgggtaacgctgcactgtgggttcggttttcttcacttgtggctccatccaattaagccacacatagtatgggtgcttgcactgtggggtgggtgtctttgggccaacttttttggcgagagctacgggccccatagctcgcactgtgagaggcctaaggtgaccatgtagaattgtcctcggtaaacgatcacatcttcatacatgtgtcgcgtttgcaagggcatccattttgcatcacgcccacgagcaagcacaaccctgttccttggacaatgcatcatcatgataaagtattcaccagaactagggtcccacaacgggacggctttaaggagacgagatgaccggatttcctccgcagaaatctcaatgtcggagcaccatccgacaaacctggtgtggccctccggccagtaggtttccacgaatgaggctactttaaacaagaacctagcttcatcaccgtcagttcttggaagggcatcaaagtaaccggtagtggtgatggatggcagcgagtgttgagtgccggagatggggttaaggaggtgcagcccgcacttgtcatctgttgtcacaagccaacccttcgccgagccaatccacatacggctttggatggcaggggaaggcagggtgattgagcgacgccgtccatccgagaaagagtagaagtccgcgacggctagatgttggggggaatcaccggcggccggtagcatgagccaaggcggttcaggcttcggatgaaggcggaggttcatgccgtatccgccgcccgcttccacgtcttgcagacggcgccaaacttgatccagtctgcgaggactaggcgggttacaaatgttagagtttgtgtcgaatatgtgtacgtagtcggttacagtttaggacttggagttgtaataggtattaggactagagtatgagtcggactctatcctaggatccctcataaatagaggggcgtgcctgttgtaaccgcatggcgacttagcatagcgagagggagcggctgccggcgtcgaccggccgtgagtcgttgtaactctgatacgctatatatgatggatcggggaggagcgcccgtaatcagtgccccggagatgtaggctacggctgaactccgttaccaaatatcgtgtctcggtgtcgtcatcgttttggatctcctatggagttttcttccgtatttagctatcgatgtcgatttcggggctggttttataacaagtggtatcagagcctgcgggaggtccatggtagaggcgcgatggaggtgctccacaccgcgtagcctgctataatgcccagggaggggcattggcgcaaggtggagcacggcggcgatcaacggagtcttgatcggtggatcgaacacttctggcggcggccggaaccgtcgatggctgccttcaacagggagatgactagacatggtgctcgggttgatggcggcggaagcgattggcgatccaatcggtgggtcggacacttcgggcgggtggcttggactttccggtgagctactctcgatagggagacgtgcggccgcacgctcgggttgattgaagctggaggcaatcggcgttctcgatcggtggattcgaacactctgggcggggtggcccgggcctttcgatgtgttgagttcgacagggagatggctagacgtagtgctcaggtcgttcggcggctgggaagacggcatgcgacttgtcggcttcggctcgcgactagattgatggcgttcaatcgaaagtcggagcgggtggatcctataggttgttttggaggtgttgacgaggtatttgcgtgacaaactgctacggagaaggcgcacatacgaaaagcaacggaatcaggcagaagggcagtcaatttcagaccgtcaatgcgctgatcaatcatgttagcacagcaataagcattggttgcaactgaccggcggtattcgtcaccagcgaggttcagcgggaggctaggtggctgcgctagaggtcgtacgggtgcgtggaggctgaggaggtcacggagatggcggtgtgcacgtgttggtgttgaagccgggaccatggaacgtggccagagcccgagtagcaggaagtcggattgcgcaggactcgatctggagaggttgtgacatggaaggagtcggatatgtttccaactcggatgcatagcacaacagagaaatagattgagggagagacctagtcaagcacggaaggggaatcggacgaggactacgattcgttcatgaatcggactcgatttttcccaaataaaagcagcagaggaccacaggattgcaacaacgcaatcgaaacaaatcatctagcagagggcgagattcgtacccgattttcgcagaggcaaaggtggtttgggcggcgaggtcacgggcggctggagacgcgtcattgcaggtaggcggcgcacggcggcgtggtactcggcgacgttcgtcgcagctcaggcaggagcttgcggcggcggcggcggcggttcccggcgaggaaccggcggcggacttcggcggcaggcgctcccaggtggcaggcggcggcttcccaaggtaggcgacgcggcggctcctcgcggggtcggcgcaggtgacagcggcgggaggcggcggcgccccaggcggtttctgaggtggggggcatggtgcttcttgcggggccggcagcgtgaggagcaggaggcggcggcgcatcgggaaaagcggcgcgggcgcggtttctgggaggagcgaggaagccaaaggaagaagggagacaggatcgatctgtttttctttgactggtggttgaccaagtaaaagaaaccggtccggttttttggagaaagaaaaaaaaaccggttcggtccggctggtactgttcgagttagtcggtggggtcgattgaaccaaggcagatcaatttaacagggcaacagctgttgagttgattatcgtcgatggcggtgacggtggtttccaaatttgagatggtgaagttcgatggcactggaaatttcgttctctggcagatgaggctgaaggatctgttggctcaacaggggatatccaaggctcttgaggagacgatgccggaaaagatggatgctggcaagtgggaggagatgaaggcgcaggcagctgcaacaatacgcttgagtctctcggattctgtcatgtatcaggtcatggatgaaaaaacaccgaaggaaatttgggacaagttggcaagcctgtatatgtccaagtcgctgacgagtaagttgtatctcaaacaacagctgtatggtttgcagatgcaagaggagtcagatcttaggaagcacgtggacgtcttcaatcagttggttgtggatctaagtaagttagatgtgaatctgtatgatgaagacaaggccataattcttctgtgctcgcttccaccgtcgtatgaacatgtggtgactaccctgacgcacggcaaggatactatcaaaactgaggagataatttcgtcgttgcttgcacgagacttgagaagatcaaagaaaaacgaggcaatggaggcttctcaggctgagagtttgctggtcaaggcaaagcatgatcatgaagcgggggtgtcgaagagcaatgagaagggagcacggtgctataagtgtcatgagtttggacatataaggaggaattgcccgttactgaagaagaggaaagatggcattgcaagtttagcagctcgtggtgatgattcagatagcagcagtcatgagattctcacagtgtctaacgagaagtctggagaagcgtggatgttggactcagctagttcctatcacgtgacatcgaagcgggagtggttcttttcatacaaatctggtgattttggtgttgtttacttgggcgatgacacgagttatcatgttgttggagtggacgatgtcaagttcaagatgtatgatggaaacgaggtgctactttcagatgtgagacacgtgccgggactaaggaagagtttgatttcgcttgggagcctacatgagacaggttggttgtatcaggtggattttgataggaagaccatgaatatcatgaaggacggcaagactgttatgactggtgagagaacaagctcatgtttgtacaagttacaagggaatgctgttgcaggtggagtcatggaagatgggtatgctggtgttgctgtgcacgatcctgaaggcggcgagcctggcgtaagctctacgggcggctcggcgtgagctgcggcagaaccaactcaagtcctggtacacggaggttcgagcaaataacagattcggattggcgtggcatattcgccaaggtggagtttgttagagtttgtgtcgaatatgtgtacgtagacggttacagtttaggacttggagttgtaataggtattaagactagagtatgagtcgaactctattctaggatccctcataaatagaggggcgtgcctgttgtaaccgcatggcgacttagcatagcgagagggagcggctgccggcgtcgaccggccgtgagtcgttgtaactctgatacgctgtatatgctggatcagggaggagcgcccgtaatcagtgccccggagatataggctacggctgaactccgttaccaaatatcgtgtctcggtgtcgtcatcgttttggatctcctatggcgttttcttccgcgtttagctaccgatgtcgatttcggggctggttttatatcaacaaactcgatcaaaatgtccgtgggaagtttggtccaatccatggaggagggagtcgatgaacacgaacacgtcgcacgagggagtagttaccaactcaccacagagatatataggccgtgcaactatgcaaagccatccgaaacggaaacgtcgtaggcagggttttccgatacacgtacagacaaacaaagcaaacagacctggatcgaaatcttatcgcgcagtccaacacccgagttaatgattttcgcgccccgctagctcgcccgcgcggtgcaccgctgacgctgaacatgtctcctttctcccgatcccagcgctgcccccacgcgcgcgcacgtacgcgtaagcccaactctttttggcccgtcctcgaccgcgcgcaggcatgctaccgacgccggatggaataagttcacttcatgaccctcaaatgtgatcgaaatctaaacgataaccctaaactacaaaaccaaaatcagatatctcgacccccaaaatcctaaaaccggtacaatttgactccctgagcggttttaggaggcggttttgctgacgtggcgccacgtggtgcctatgtggcaatattgaccgaatctttgttacacacggcgttgacgtggcacctacatggcggtagaaataaaaaatatacgtgggacccattaatcattcacacaaaaagaaatatgggcccactgacatgcggggcccacatgtcagaccttcttcctcctccctctctcccttctctctctttctctcctcttcttccctttggccgccgctccctaccaccggcgagctccagcccctcccacgcgcgcagacggttggcgagcccctc

SEQ ID NO: 66486 - DNA, 24097 bp, Oryza sativa
  unsure (1)..(24097): unsure at all n locations
atgacaaactgctgattaaggacagctcctagcgctgcattatttgtggagttagtattgctgctgatgaaagcctcaagaccactcagtgcgagataaaagcgcccccatacaaatgcatagactgttagcaccaccatcattgtgttgaaataaaacccgatggttgtataaaagaaagagagcatccgaaagaaatccaatctgtgccccagtctataaacgtctctgctcaaagtttgctcaccgttgccactagcaaccttggcttcaaacatggaaacctgattgagccccacatcccttcctttaccaacctggatgtattcatggtgtgtaacattacccccacggagggtacaattgaacccagcaaatatatcctcactgatgtttataactcttgatgctttactgataccacctcgtcccaagaaccaaagacgatcaaagacatctggatggccataatgcattcggaccttcagtggatctgccagaacacgctgccccagagtaacaaaacttgtttcctgggcagacatgaaccaagctagagaagacacagaaccagtgaaaacatgttcccgaaccccaaggatttttggcttgcgaattccataatggcgattgaactcctctagcagatttctcatcttgagagcttcttcaaaatagttgtcttggttcatatcaatagtttggacagcatcaccccttgtgaagatgagtgcatgattttggttctctggtttgccttcaccaagcttcagtggtccaggcaacttaacacgataaatctcaacctcccgctgcagttgctgatcatatttcacaaggacagagaaatattctgtttcaccaccattggagttcttttcatcaacataggcaacacgtagtgcttcataattcttcattagctctaaaatctcaaaagcatgagggtcattcttagctttctgctgaccgtaaatctggcatgcaaccacataagtgtatttcataaggacagtcccatactcgctgcctttaaataaggtgcttacactactgcttgccctgctcaatgcacgtgacgaagatgtcctgctgtaatatcctgacccatcagaacccacttcccgtctcgaagatcctatccttgatgagcccatagtagcaagctcccgggatccagtccgtaagtcatgttcagatgcagaatcaagaaatgtcagcatcttgagagcttcatagtagtacatcattcccctcacagtacgtgatagtgtctgccccctgtatgaaacccagtgccggagatctctcagcctctgcttctcactgtacagctccttgatattagacatcccctcacgcttcatacgttctacaaagaactcccattcatcaggatagatttgttgcagatagtacaggattgagatgccatcttcattctccttatagagctggtccttgctgtacaacacctcttcattgtagtatggcgtcaagacgctgaaggccatcatcttctccacctgggtggcccgtggtatgttcatgaacaacgaattactgaagaaagcaatccttcgacgagcttcaaggttctttgggacattgatcatagaatcccttgaggtcaggattgtgtgcatgcgccttacttgtttatagaaggtggggttcttctcttcatcaggcagaacaatagtgtccacgaagagaagcctcgtaggccttgactgtgctaaaccttcattcctcagttgttccatgctccttttctcagcctggaagtcacgaatcagaacatcatagagagtctgcagagcattgacaatcttggtaatgtccttctcaggcttcagaagtaagctcaatatagcaacaagctttgcatgcacatttggcagtacagacatcttgtactccacagtgaacttctccatgctcatggattcatcaaactcatggaacaattgtgtcacaatcccatgatcctcagtatcatccttgattatcttaagcagtaagtactttgcactatcatatacctcaatcactgcacatctacgataatcgttcttgcagatcttcctccaaagcttgcgatcaggtccttttacctcctttgcctgaccaagtgcaagtgatagctcattacagagcaagaaacatggccagcggattacacgcacattccacagctcaggtgggagctcaagaagctcaacttcgcgatcaccaacaatgtcctcctcccggaacttagtaattatctcattccaaacaagagcgaatctccgtgcctccacctgatttgactcgattttccggaatgatcgactgaagccataacgtagctgtagcctctgccagaaatttcgaagccggttgggcaagaaactgcgttcattcacctgctgttcctctggcataatgttgaatgacattgcacttgcaaagaactggaaccgaagacgcagctgtttcatgtccctgatctcccccagatgtgcaaatagccccacaaatgcacccgtcagtgaagagaagatagcataccaaatttggatatccatgagatagatcaacaccacaggaagccacaatacaaacacagcaaatcggttgctcttgccaaagaactcatgccaagcgtaatcaatctttttcaacttatatatttcctgtgtaggtttcacgagaggcctgatctggagaaaatagctgaacgcaaactttacagcaagcagaagcacccagaagacagaatacttgacattatcaaaggtgccctcacgcaaaccgcggccaacaaaacttcggctctgaaaccaccatgtaagagcataacatatcttccagtttgtcttctccaatgcattccgcacccacggcacaataaatagcacaatggcaaggacctctgggatcataaacactgctgctgcatacaggaatctcataatctgtgaattgctgttcctgttgttccaggcttccttgtacaagatcgcaaacgccacaacccagccagctgccacaatggccttgagcaccatgcgcacagcaagcatgcggccatccctgaaagcacgccggagctgtgtaccaatatccagtagcgcctgaaggaagcggagagcggcccaggtgataaaaatggtgagaacccgcacctgcgtgttccgattacccagactcctccacggcagcccctcactctcccacgccacgatggctgcggcctgcatgtagagcaccagcatcacccacagcctgtcgaagctccggtaaatgttccagaacgagcggacctcgacgaagcccgttttccgcacgcggctgcggtcaggaggcgtgcggaagaactgccgcgactgctccatgggccagccgaggcggtcgaacacgtcgcggcgccagaagtactcgttgatgtcgtcatagtttcgccaggcgctgtggggcgcggtgccgttccggctggactcgacctcggcgcggatgacgccgtagatgggcgtgacgacgcgggtaaggaaggcgttctcgccgtgcacggcggggttggcggggcggcccgtggaggtgtcgatgtagccctcgaggatgcggtgaagctcgagcgccatgtggtggtagatgtagcagaggcactccgggacgaagcggagattggcggcctccccccacacgagcaggtggagccccgcgaagagcagatcggcgcgcgggtcgccgtcggggacatacacgttggggcggcggccgaggaagccgcaccaggtggtgtagttgcggaggagcttcctgcggagggtgcgcgcgatgcggggctcgagcgtgtcggagaagtcggcggaggagagccgcatctgcgcgttggcgaggaggagcaccagatgctcccgctggttccgcacgttgtcccgctggaacccgaagaaggcgccgagccagtccatgaggtcctggccctcgcgccacgccgagtagggcggcgggcggagcccccccaccgcccggagcgctgccgccgccgccctcacctccgggaaccgcagcgacgggtgctccgcgaggaggtcgtggatggggatgatgttgtacggctccgccgccggtgaggcgccgcccgcggccgcgccgccgcggcgctgggaggcccgcggcgtcgtcatagtggcatttgggttttagggctagatctgggggcggattagccggcggtgagggagggaggaaggaaggtgagctgggttttggaccttggggctggtttgaaaattgaattctctcttagctggtgttgtggggaaggaggaggagatggaggggcggaagcggaagacggaggcggagcggaggagcccaaacggagggtcgcgtgagaaacagaggacgagcatgccggacgcgtgcgcttgcctgacggggtggaaaatgcaaaatatggcgcaggatggcgagaactgccactcgtgtaaaaaaaagatcttctgaagtagtactagctactagctgttgccccttttatccggggtaaatttttcttgtgcgcgtggcgcgtaagtatctttcttctctgcgataagcgtgtatgtatagagatcccacgttttatttgttacagtttataggtgacgataattattttctgagaaaaaaaatatcagaaggattagtacgcctctctggacatcatcgtggtcgattaagatggctatcatcagtgaatgcgccattaaaacacgttttgcggtcaatatagtggttcattaaggaaaagtatggctttaaattaagacggtcattcgcacaaccattagctataattgttggtgcactagcctgtttgctacctccatctctctaaatggtggtgttttttggtattttgtcactactttcaaacttatttttacaaaaagtattaaaatacaactatataaaagtttttcataaaagttctattaatgtttttttgcattttcaaatcctaacattttactttccatctattactacctgttttaaaatgtcgtcttttctagatggagggatttttttaaaaaaaaacaaggtaatcagtaaccatcagttacacactgaaatatactcttacgcgtcagaggatatgtatttgttttttctgatcatatgattatataaaatattgaataattcctcgatttcatgttacataatgtgttggactgtaaatagattaatgcaaggacgtatgtatatgttccatataagtgtccaatttatatatatatattagtgaatttagatgagaaatggatatgccgaaacatcttatagtgtgaataaacggagtagaatataagcggttttgaggttagagtgaaaatgatatatattactctataaagtatttcaaaagcagatttctagacaaaatctacccaagataattatcaccggtggagaaattgtcttcactcccggtttgtaaccccccatagtcccggtttcccaaccgggactacgaatccgggactaaagatcgctatctttagtcccgggtgaaataaccgggagtaaagatgtcccggttggtaaataaagagaggatagggacaataccggatggtccccttttctttttttttgttacttttttattttctcacgaatcggatggcatgcacatcccaaatcaaacctcaaatccccaaataaagtaacatcccaaatccacatcacaaatcttaaagttattatacacacaaatctaaaacatcacaaatcctaaaaaatttacatacaaatcaaatacatcacatattatacatctcaaatccatacaatgaatcacaaaattacatctcagtgaatcacaaaatatcaaaaaaaaagagagaacaagtaactttaggggagggaggacgtttgtgcgcatgtgctcccctgcaacgcacgtctgcgccgcacgccgcgtgtccgtccatccaccgcgtccgtgcggcgcggcctcatacgtctccaggggagggaggaggaaaggaaggggaaggaaggaggagcggcctcatccgtctccaggggagggaggaggaagggaagggggaaggaatgagaaaggggaggatctgtgtaagataggagaggggaggagggggagaagataggaggatcgatctgtgtgtgaggaagtggttgtgattgtggaggagaggatgagaattagggattatatactatgttgaattttagtcccggttggtaaccaaccggactaaagatctaagggagtgtttgggagagagtgggacttattgttttgtgagaggggctctctcccanacaccccctaaaactatcaaccgggactaaagtggtacttaagtaaagatcctcggtcccctgacatgcctttgacagtggatgaactgggactaaaaatcatatttagtaaagatcaatttttttaaccgggattaaaaatcatttttaatcccggcttttaatggaaccgggactattataaaatttagtcgaccggtcaaagatgatttctccaccagtgtatcatgtagtacatcataccaaacataatgtgaaaaaaaatatcgctgacataatcccgtcctagtaccgtatccatatccaatagtgcgacaccgaaacaaccaaccaacaagaccgtgtttacaccctagaggttgggaaaacttgtgattcgtcgtccctttcaaccctgatgatgcaacggtcacacagacgtgaatgtacaattcatacgaatttgaaaggtccattatttatcagaaaagaaatcgaaaggttcctgctgcaatcgcctttccagtgaattcctcgcctagtcgcctttattttttcacgtgaattcctgccgaacgcgtactctctcacggtacgtaaacataaagggttaattaaaccacttgttcttcccgtcttatactagtatcataggaacagtacattagcagactataaaccagttataaacatattttaaggagataaaaaaagaagatagaaaagtaatgtggctacagatttgtaaccagctgtagtacggactttaaaatgcatgtgtgtgtataacagataggatcagacattaattatatagtaattttataggtaactattatatgaattgactattaattgactataaattataaataatatgaaccaatagttagctatatactgttaaacttgctctgaacttcatcttgagtgccggcggctggctggttcttttcgcattaacaaacaccgtgtgcggccgcatccaaactcccaaagtccatgagcgaacccgcgtgagcatatacaacttccagtccacaagcctgtaatacggatcgacacttcctccacgcatgtccgtttccacacagcacagtacgtttcatgtactccctatgtcccacaaatactcaaaccctaaattttcaaggtgggtttaagaagagatacaaatgaccaaaatacctctaattatgaagttatattggtgaatgggtagatgaaaagatattgaagaaataaaatttctaaatttggaaaccaatggtagataaaagagtataagttggtttattttagaataaattttaaactttaggagttaagtttatttcgggacgaaggtagtatgccaaattgatgccttgtcctggttacgacggatcatagatccttcaatattcgagactgctaacaaaaagaaatattactcccctccaacttactattgcattggtgtatgtgaaggtgggaaacacgtatacattaaagtagaaaagttgataaataactacatcaggatttgaaaaaaatgataatatttactcttttttattggtatatgtcggattggtaaaaaatgaagttgttttgaaagcgtacattaaatagtcaattcataaaaaaaacaacttgcataaagtgatgtaatgtcttgtatatatgagtttttgattttgcataaaagcatcacacattcctgagtgcaccactaacacatgcttaaagggtggaaatcggcgacaaatctgtgagctcactaaattcatattaaaatcactagtatcgaagctctaatatcccgactccatcatcatgtataatgtaaaagtatcttatacccgactatgagcggtcgaaatgacgaatcaaaatggattagagatgacaaggggatatttcccaccagggaatgcatccccatctttattcccgtccccaccaactgcaatgggaacatcctcccatagctccttacccgcttaaaaacatatttatactttgatatatattatgtcaatatattagtagatatctattaatccatatgacaagaatacattattgtccacattcactaatcatagcacgctaaaacatgtatagataccacatggctaccatccctctttcctaataggagaatttccataggaaagggatgtgggcattgtcatccctaaaggctagaatggacatatatacaagtaggatgaaatctttgcttgtagagagagaatgagaaaaatgttttttctttaacgagtacggaattggtttcttcgtagctttcatatatccaaaagtcacggcttcgtgaaaacctgacgagaaaatattaattacggacatgacttgttgaaaacaattggaaactagtataaaatctacttcggttgaaagcaacacaaaatttcacatacaccggacgcaatagtgatttcaatgccttccttttcacttcacactatgaaaaaaatatggtccatgcaaagtaaccgattcaatatatattctagacaaaaagaaaattattttacagtactatatacatatattcttgaacatttttctgattaagacgcaaaatttacaacaattctgttagcatgtgttttaaactatgaaacgatacgtttcgtgcaaaaacttttcatataaatgttactctaaaacatcaataaagccattttaaattgtataataattaaaactcaattaataatatgctaattttttttcgttttacgtgtccttaatccttattttcatccgttataaacggggcctcaaagtcaccataagtaggcacgataaggttgtatatttccgaaaggagaacatgagttctagatccgtttggacgcagaaatattctaggttgtttttccctgtccatgcatgttgcctttatagagaaaagaaaaagaaaagaagaagaaggcttgctcggtcagcccactcaaccgccttggctggattctctgtcccatcggcgtggccctatcatcacctgtgcttgggacggtgccgcggtgggattcgccatcgaacgggcacggcgtgcgcgtaccgcagcagcgaaacttcaaaacctggagggcgaagccgataaacgcccatgtgcccgtccgcccgcacgtcggcagcggaaaaaggctggaaagccggaaaaagccgttgaacgtcaaaggagacgaccgttaacgtggcataccgaatttctagtactacttgcgtgctagtagtagtaactaacgtggacgtggtattaccgaatttcgccatgacctgggggtgagtacctgacagttggactcgtgactcgtctgcgcggagaagcatctgcctgctctgaggtccagatccggcacgaccggcctgggcacttccatgtgacccggccgcggggccctccacggtttgcctcgtatagcactctcctcgcttgccgtatgctcctgcgtgtacttgtccgttgtgtagtacttaggcggtgtttggttggagggactaaagtggggctaaactttagttctctcataaaaacataagttcctacatagggacttgtacttttgtgagatggactaaatttagttcctaattcccaaacacccccttacatgtaaagggcatgtacaatgaaggccacaagcataagtggttttaagacgtacatcacgtaggatagaaccatacaaagatcatactgcccggtgaaaaccactccaaaacgtatcttgtatttcagtctctgtttatttatatatcagcccttatgttgtatgttattatcaaacctattaaaactttatattttagactctataacaaccaaaataagtacatactatgcacccttaaacactatgcggacccattgtcagcctcttccccctctctttttaattctctctccctctttccccctctctctcttgagccatctctctccctctctcatttgccatatttgccggcgagctccccatctcggtggcggatccgggttctcgacggcggatccggacgcgggctcgacgctgccgtcctcctcccccacgacggtgcggacgagctcgccgacggcatggcgagcttggcggtggcgggctcgctggttctggcggcggggccacaacgcgatagttcctctccccctcccttcttcgcgagcgtcggcggcggatccggacgcgggctcgacgccgccgtcctcctcctcccacgacggcgcggacgagctcgccgacggcatggcgagcttggcggtggcgggctcaccggatctggcggcggttcctctccccctcccttcttcgcgagcgtcagcgtcgggaagtagcggtggcggcggatctgacaaccggacgaggcgacgcacggggctccagctctgccaccgcgtggcctcgggccgtggcttcgttcttcctgggctcagacgcggcgcttcgagcggttcctccgcaagcgcggaatcggtaatgcggagccatggtccccgctgccacgggtacacgcgtccgatatagagccgtgagaccatgagcaagagccacacgttgtaaatggcctaagactacgaagggtatgcttgtggcatggcagccagcgaaccataataacgggacccttatgttgttattatggtgatcagtattttcttatgttgttattttttaatgctataaaaatcatataacttgatttattttgcatcgaacttttgcaataataacatcgagttctaaagatttgtaaattcatcgtgaaaaaaattgtggtcaaaactcgtataattcagtcactactaatagttattaaaaaagatagatgtagcatgagatatggagtagttatgtaatattattagggtgcttttgattaggctaaaacgagaagagttattagcacataattaatttaatattaaataataaaaacttaaaaatattttttttaaaaaaaaagttattatagcagttcggtaagtgtaattaccaaaaacaatgtagtagccaactcaagaaactgattcaaactctagatgaatctattactactacgtcaacagtaagaaaacatggtatctttgttgctttcaaagttaaaaaaaaaagtccatcttgattcttgattactaaaatatccgaataataatggcaaaacctgtctctcaaatcctaataccagattaatcactcccctaagaagaagaattagagagatttattccacacctttaaatatggaaaatggaaatggaaacaattttcttgtatacagaccattttccaaattttaccatatatttacagaaactactattcttttatattatgttaattaccacatttttaagtatgccaaaatctatggtacatttctttctttgacatatagttagaagcccatgaactcttcaaccaaatccctatatggaatactcctacaaggttaaaaaaagataatctatagtttacatagtgtaacattcaatttatttcatcatattatatacttgtacaaagttaaatgtgtgattttagagtttaatattttttatatttattacatgtttttaatcgatatcgacatgtttctgtctgtataattccgtttccggctttccgatattttgaatttcgtttgtatttctagctgtacggttttcaactctatttttcgagaaaaatgtgattatggaaatggttgaaacgttttcggaccgttttcaaccctatcgggatgaacccctctctccatctcccatgcaaacattaagtacacaaataaaatagtttcagcgaaaaatgaagggaatcatgcagtaacccatactcctatgccagattcataagttgttcgggaagcacacggcctccgaggtttaatacatgtaacctgatgtaattcagcaacattgggattgccacacattcgtttctcagtaaaatactccagagagctagaataccttgattctctttgccgactgtgttcatcgttttgacgtttatcatttgtttatgtgccacataagagcgacgaccctcactataaaaatgttgcaattgatctggctattaattcactggtgctacgggtttccgacataattctgagatgatgagaaaacggattaaaataactttgtcgacaatgaggagatgccgtactcctgtctttggtcggcgcaacaggatagaccgatcaataagagtcatgtagctcctcctatccacaacaagcagctgaagaaaaccagagtttgttagactgttacaagtcagggtcatctcgtcgtctaaaattagctgaacaaccccatctgtccgaaagaacgcctgaaacaagcaaatgatgtgtgcacaggagataggaccaaatggttaagtatcttggatgtgtggcggtacttttaacaaaagcacaaatcacggtagctttcggtcttggattctgcgggaaagaagaggagacatgcatgcatgtcagcatgtggggctgaatcgctgagaaagggggagaggaaagggccatgctcatctactgatctatactacatgtgagcttgcccgatctgattcgctaggagaacagatggaaggcctggtatgcacagcaacaataatagatcctttcttaattactccctccatactagtaaagaaagtagtttataacagcgacacggtctccaaaacacaactttgacttattgtttctataaaaatatttattgaaaagtgatatatgtatacttttatgaaagtatttttcaagataaatctatacatataatttatattttcaaactcaacaacttaagagtttttcatgatttatattcctcagttttgacttaaacattgttttaaacgacttttttttatgagtatagtgggagtacgtgtcgacagaagagacaagttcaagtttgaagaactcaggctataggccgggcagctgagaccaaattaatcaagttcagactgaagaattcgcaacaaggacaaataaggttcatgacatgaagatacataaaggccaatttcaatttttttcttcaagtttctaactttttcgtcacatcgaacttttctacacacacaaactttcaacttttccatcacatcgaactttcctacacatataaatttttaactttttcgtcacatcatagaaaagttaaaaatttaaagaaaaaagttggaatctaaatagagcataaacacagccttaagttccagttctagctaaagcctcaggtacgggtcatatccacttgccctgaaaagtcagaacatcgcattcgatcaatacaagttagcgcgtaaatttagctgaactctcttgggggttaaccgggtaagcgacaagttaaccatagccgcacatgaagtctcagatctccgcaggggggaaggagccgagccgagcgaacacacacagcaccgaatttcctcgtttttccctacccgtcgcactcgtgcccaacccaacgcgtacgtagctgtagcggggtggctgtctggctgagctaccaacaagccagtgcaagtgggggatcggttttgtcctgtcatttatatatatgtaagcatccagcctgagatttgggtgacgctagctgatcgctgactgctaccgtgatatttatcacgcaattggggatccaagcacattaacaactatagacgacaaccccgatatgcatggctcattgttatattgctatttgtcaccttcgatccatcgatcatgcggtgtttgtatgtaaggctttcttacccccatagatttgctgctcaatttgacttgaccagctctggtgtgtgagatccaatccggacaacgggacatgcatgcatatgcacccatgggtgagtgctcttttttcttctgggacatgtcagggtgggggcaaattaaaggagatggagatcgagccggtcggcctttaccgggagagggcttggagctggaggacgcttttgatgccacgccacaagttgcgaatgcgtaaatgggcttcaaagcaaagcgcgcgggaatgccggatcgagcacggcgcggatgggataaacaacacagcagcctcgatcgccggggggcggggtatcgcggttttcgcccttcttttctgacgcgatcagagcggctacaatagcactattaaccagctgtaaacatattttaataagataaaagatgatagataagagcagcaggctacagatctgtagccagctgcagcacggactctacgacacaatgtgtgtatgataggtgagaccatatattagtagtatagtaagcaactattgtattaattgactattagattaactataaatgaattggagccagtagtgggatattttattaaacttgctctcagtcgatctaatctttgccgggtcgagcagacgagtaccgtgtatgtagatgcagtcaacggagagttttatgctacgcaaatggcagtataaatacatcggaggagattccagcgcccagtttatgattctagagtgagaaaaatatgttacatggtcccgttagctagcttagttatatatccagtgccagtatatgtcgttgacaatgttgtaaaaaaataccattgtcaagggcaaaccgcaaacagtgtcgtgccgcatccattgctggagaaagggtttttacccacggttcgcaacccccctatatcatgaatccgagactaaaatgcccatctttaatttcggttaaaataatcggcactaaagattcatctttattcccggttgcacggaactaaagaggagaatctttatgggtaacgccagtttttttttcaattgttatttgaatattgatttcacgccaaactcaccaaactcatcaaaatcacaaaatcatcataaattccaaatcgagttgctccctacatctccaaatcaaagtaacaacatcacaaatcataagattcatgtcaaaaattatcaaaaaaatacatcacaaattctaaaaaaaattacatcacatatcaaataacacagatccaatgaatcacaaattcttttttaaaaaacaaagaaacccccaaatcgagtcctccacttgccgcaagccgtcgtcgcctccccagcccgacggccgccgtcgaccccgcccggcggctgctgccccttctcccgtcgactccgctgtagaagatatgtggatgaggaaagagagagtacagagtcagcgagagaaatggcgagagaagatatgtggatgaggacgtctcgatctgtctagcgctaagagataaggatgaggaaatctaagtatgtagtctctggttcgatctatttaacacatgggagggagatatttagtctcggttagtgatatcaaccgggactaaagatcatatagtccccgtgtacttttaaatcgggactaaaaatagtttctagtccaagtttttagttgaaccaggactattgtagattttggccaacctataaaagatagtttctctagtagttgtgatcacatgcatataagggttgcagttgttcgtaagatacacggtgttacttcgcaaagaaaagcaaatgctcatgtattgatgtacgtaagcaacatgttcacaaaaatgatgaaagcatagcaagagctgtctcgagcgttgtcattgtaagatgccagcttttctcaaaacttgcattaatttggagtgcacaatactggattgaaataaagaatcaaatctgtttattatatatattcttttccttgtctttttggaggcagatgcaaccatctatatatcctcagctatggcggagatttaacaacccaaactgttgagtttaggaaaaaaaatcaaatgggaaatagaaatgggccagtgtgtgggcgagcgcgccttgcgggccacgaaaccgtgaacgacatgttccggcctgcccacgagtcccgcactaatcgatgtaccccttcgtctcggcccgccgccgcctcctccgctcgagccgcaccgcgcagccgccggcccaaaccctatggctcgcaaagcgcgacccgcggagcctcctacaccggggcggaagggcaggaaacctctcccctcccacgcgccgccgaccgaagccgccgccgccgccgccaccgccgccgcctctccagccgcagccaccgcctctccagccgcagacgccatggaggccgaagcgggcggcgtggccatcgtgtacgacgcgctcccggggctgacactggcgttctcgccggaggaggaggagcacctagagggtgcgactgccgacctaggcggcgcgtcgacctccgcctcggctgcggtggtggaggaggtggaggacgccaccgcggcctactccgtgttccgcaacgagatcacggcggctggggacgcgctcgtcgatatccccgcggcggatttcttctccctcgacgtgtcggcggcagttgaagacgagccggccaccccgcgtgcgttgtcgccgcagcctgctccggaggcgacgctatcgggttctctagctcccgctgagcagccagcgcaggggtcggagcgcgcgtggtttcggggagggaggcggttcaggagccctatgctgcagcttcacaaaggtggggataattttggctttgccatttgttagtttgaatgttggaaaagaacacgatttgtaaattgatttgatcagcttagagatagttcaattcgaattttagcttgggtaggcaatggacttgtttcaatgggcacagattatgcgaatagtttggaactgattttagtttggttctgaaatcttctcagttcagcctaggtggagattgatatttttttaattgtattttgatatcaagctactcgcgatatgctctttcatgacactcttgaagtgttgcctggaaactatggtgttataaacttgggagtgtccacatggtgttaataagcttgagtcagtttatatggtttcaggctggacattttgactgacgcaatactgacatattgtctatttcttacagagattcttgacttctgtgactttatatcaccttctgctgaagaacaatcttcacgaacagctgctgtgaaagctgtctccaatgttatcaaacatatatggcctcaatgcaaggcatagtaacacacattgtccctctcttgccatgtgcgcacgcatttgatcagcattagctgcaagtcatttggtaattctcgttttgcattgcaggtggaggtcttcggatcttttagaacagggctgtttttaccaacaagtgatatcgatgtaagggattttctttttgtgctctccagtggatttttgagcatttaacttgctgttctgttgagttgtatgatcccctggagcataacatttactttgatagcaatgctggaatcgtcatacttaacattttgatggatgaaatagcaatacaggagaaaaagagtaaacacagaaggaaggtgtagctcagcatgcactttctgttttcctgttttgcagaacagggaggaaaaaatgggatgtatataattagcaatgtttactcagttttcctggagtaaagtatgaaatatgtttctccagagtgattttcacccttaattgcattgttagctacttccactttcatatcaaagggatacccttcttctgctattctatgattatgattagaagaaaaccgtgatgcatagcctgttacagacgtgttaagtgttaacccctacttttcacctgggaacaatgaaatacgaatacatggaaaatgtaccctattttgggaaactctctcctttatctgtgagtttatacatggttttgtgatgcaggttgtaatatttgactccagggttaagactccacaagttggcctgtatgctcttgcaaaagcattgtctcagaaaggggttgctaaaaagatacaggtccatttttcactctatttaactctagtttgcaacacttggtatttgcaagactttttcttttattttgttaaagaattactcaaaacaaagccaaagagacaaaaatgcattttttttccaatgaaggaaaagtcaattttctgtccaactgaaatatgcatgacggataaatagctaccttgaaagagaccaaatcccactgtttaaactttcactctgtgctgcagttgtcagttgttattgtcaatcaagtagattccagcttacttatttttctggtggaccattttttttttctttcatggcaggtaatagcaaaggcccgtgtgccaattgtgaagttcgtggagagaaaaagtgaaatagcttttgacataaggttaaattgtgtttctcatcaaatattcctttgtttctagttttttgcgggaatgcttatcgaataatttccctttttctttttccagttttgacatggatggtggaccacaagcagcagacttcatcaaggtactttgtgcagacaaattggctaattacttcactggcagcgtgtgttcgtgaagctaattcgtggggcaaatgattgcatatattttgaacatcatttttactctgtactgcaggattatgtgaagaagtttcctgctttaagacatctgtgtatgattctgaaagtttttttacaccaaagagagcttaatgaggtacaattacttaaaactattagtcgttccattctaataatagattgtttgtaattatggcatttctagatttccaattaccatttcactctttttggtaggtctatacgggtggaattggttcatatgctcttctcactatgctcatcacacatttacaggtaaagctgagtctgttttgtactctaacgtgataatggcctttttttgtatacctgaattgatttgagttataattccttaaaaaatggttgaaaggtacacattgtgtttttcctgacatttaagatttttcttataaatacttaagacacctaacaaacataaatttgggttgtttatacactgcatcgctaatttgttcactgattcagtctaccatatattacttactatggataactgaactttagtgctaagtgttctttttgttagttgatctggggaggcaaagatatactggggtatcgtaaaaaggagcacaatttggggattcttttggtaagcaatacttgttttaaatgtttaacagtaatgcaatgttttacattacaatgctttgacttccgttgcatgtaaagttccattggaaatattcatttcatcgtggtattaaccataatgcatattacatactgcttccgaccatatcgttctcagtatacacttttttacgttgtctttgctaatggaaaggacatgcattctctttataattaagggggcatgacacatgattgcagctctttatagttatttttccccttcatggcagatcgcattatttgatttttatggacgcaagttgaacaattgggatgttggaatatcctgcaattctgctaggacctttttcttgaagactgataaaaagtaaggtgtttactagcgggcttagaccaaatgaatatacaataaaattatcatcttcttagtattttgttcaactgaaaaaaaaggataattttttcagtattcttgtgtattgctgtagaacaagaatatctcatttgcttctaactaggccattctgttaaacacttaaaactgttgaaaatctgctctgtaaagatttataggtgaaatgtcattatataactgaaagaaaatttgatgcgggtgcaactgtttgagttgctaaaattttgactttgttgtataagccatggaacttgtttactgatcctgtttgtgtctctctgcttttcaagctttgcaaatcctgatcgagcataccttctagctattcaagatcctatggtatgatctttggccctttccttttagtcttggttagctttaacatctccagcttcaatggatttacctattgtttttcttatggcctaggtaccagataatgatattgggaagaactcatttaactatttcaaggtattatttcttacaatgttgtttgtgctgtggttgtgatacttgaagtattactcgtttactgtttcataataatatatgcaagcaatatcgatgaaagtgttcctatcttataatgagcctgttactttgctctcaatgccagtttcctgggtatggtgcttacatggtatttcatagcaattttgctaggttatacttgtgttatttgagcaatgttccgtggtactctgtaatggtttggtaccctgtcactgtcagtatagtattttgttcagtgatagagtgatagtccatgttctgttaagggtaatcaatctgaggttatctaagggcactaacagttatgtcctcaagttgtcacctgtcctgttccttttttgccactgttgcacgttcgttaccaaagttcttcaggttttcggaccaagtttcttgaaaccataagaggtggtgaaactggaacatggtataaactagtaccctttttctgttaccagaactagttatcttctttagtttgaaacccgaagcttttgcatatctggattctggagttagtgatataactactggaatttcaaatgttgtggaccttcgtggtatagatgttggtccaaatgggaggtttaagtagggtggtatggccaatggtccaatcttagtttacagaataagtgaacttcctagaatttgcaacatatagttattggacattgatgtttgaagtgtgctgtcacattatctatcacgccacttctatgtgagcttttggcatgtttatgaaaaactataaatgcaaaaaatctgattgagtaatatttttttttgactaactgattgagtaatatttgttaactgctgcaggtgaaatcagcattttcaaaggcttattctgtgttaaccgatgcgaacttgataacaagcttggggcccaataggagcattctgggtaccattgtcagaccagactccgtgctcctagaccggaaaggctggaacaaggacgctacaatacctgacatgttaacagaaccctgggaaccattaccccgtcagtttgatagcgataatgatgcagtctataattggcatgtgatagatgatgaaccactgcccaggaatactcgatcctcatcggaggacacaaggccatcacctacacaaaaaaggaagtcttccaaaccaaaacagagatcgcggaaaaaggccaaggctgattcttcgagtggtaacaatgctgaaaatggtttcaagcgggggaaaggattagcacaatgtgatagatcgcatcaaagtgcaggaagcagcagacggagcaaagggccgagagagtatgacagatttacaaataccctcccacaatatactcagcacattagtaggtggtgactttaggctgttactgatagcatttacagtacagttcgggattgggagatcccacgaggttttgacaggcagaatggcgccttggcagacgtcgaagttcaagcagctttctgtagccatatgtatgatttattatttatttgtttgtctaaggttattcggtcctttgtaacgccgatgaaaccgatatattcagttatattatcatcgtatgaactgcaatttcgccaacttgtctatggcaaagtttcagactattaaaaattatctttggctggaacgtgaattcataattcataacaagacgtcacttcggtgacatccgataaaaataattcataacaagacgccttgaaaggtttaagttttattaaacgaaagaggaacataatttagattgtcgcagctaccaatcacactaaatacatgattggaagttaaataaaatcaagcttatagtcgaatgaaataaaaaggttccaccttcttttcccagtttagaactgaacaagtaaacagctttgtttaccgttaccacaacgacactgcaagcttaatacagctagctaccgtcttttactcgtctttcttctgtgcgaatcctgggggaaaggactccagccttttctattccgctcaaaagaataaggaaatataacgagaattgtatatgaggaatacaggataatcagctatcaagcactttgtgttcaaatatcaagcctcttatacctctgctctattttcctttcgagagctgctcctatgttttttccatagtataacggaaaaaaaaggtcaatcaacaatatgacaggttaaataaacattgaaagtaaaaatgcaaaacaaaagaagctaataaaccgatattgtaaggccacccaacaaacagctgacaggatcaagatggtgtaaactcgtcaaatatattcataccgcaaagacataagtttaccaggttacaagcaggtatgtccattaaaagtgaggacatatgctagcatcatcacttaactaatctaccattcttattcagattgacccttcagctgaaaaaaagtagaaggatttgcaccaatctgctggctaattaaaaaaaaaggaagccagattgaagtggccttatggagagctgataagcttccagtccatattagaagtggagatcctttgtgagaccagtgaaacatctcaatatgactggttcattctgcactaacctgaccattctcgtggggatgtaacattgctacctgcattgagcttatcagccatggcaacagagtctgcaggttgggctgcagttaccactgggagagctacgctctcaactcgatcccgtggataccctaccacactagctgtttcaaacatatttccaaatggctgattatgcacgacttgtggtcccaaatgatgaaatgccatcggaccactcgctggatgctgaggcagaacagcaacaacagtagcagcacagttagaaggattcttgaatgtggcgctgtaggattggccactaccttgaacggcataggatgccacactacagtggttgggcttgcttggttgaggtgggcatgagctcaggccgtgttgctgcaatggttgtggctgctgatgctggatgttaaggtctgtcgatggaagcaaaactgtattgccttggccataaaaagaaggcatggcttcatgatgcttctgctgaggtgaagagtatggcgagtgcacaaccatgtttctcagaagtggctccgttgtagcactggcaggcttctgagaagagtatggaggatacaagacagcgacttgaggagcactttgagcctgaggagatgatgtttgctgttgaactagctgtggtggaacttgctgaatattgtattgctgcggttgcaccacaaggggctgtgttcgccatgcttgtgactcaacctgctgagcaggcagatgtagcctttggtcctggggttgagggtacaattctgtcacctggctagatttctgagataggtcaactgcaaccctggcttcaggattctggatttgtgactgaataacatgtaccgcggattctgatggttcactctctgtgcacttaataggattttggctttgcatataatacacggcagcttgactcggctgctgctgatctggttgtgtgctcaaagagacaggcactagttgctgcaaaatataaccattgctgctttggactggcacagcaggagattgcattgcattaacttgctgaagtggcatgaaagcaacctcatgttttgcaacttgtgtgctgtgatcattttcccttccgaatgtt

SEQ ID NO: 66487 - DNA, 709 bp, Oryza sativa
ttcctgcagcccgtcagagggcgacaggcgcggccttcccgcagtggccccggggccatcctgggggtcgggggcgccgggcaccgtcggacaagcaggcggagggccagctccggccgtcgggggcctcgggccgccgttcggctcgggggcctctcctgcctgctctctcccgggtcgagtcgacgcagggtggggatgcgcggagtgagggttgtcctcgtcgcgctccacgaccaacgccgcgctgaccacctgcggggttgccgccatgtaaagtagcaacggctcatctggctccggggcgaccaggactgggggagaactaaggtacgccttcaactgagtgagggcccgctcagcctcctccgtccaggtaaagggggtcaaatgggattgggtccctgaagacttcaagatggtgatccaacgggtgctgaatctcagctccttggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgggagggggtcgtgcttctgggccccgtgacgggggcccggggggcagccgccctgccgacgcccgggggaagaggaaacaggaggataccccctcc

SEQ ID NO: 66488 - DNA, 846 bp, Oryza sativa
accacatttattgcggtttggctaagcgtgtcacgccgcatgtaacgcagtgcagtgcactcgtttatccggtctgtgaccagtcacagaccggtcagatcgtgggttaggtggcgacaggcgatctgatgcacgcctcgccccatcccgtcaggacgagggcttctaggcgctcgtccccagctggagctagcgtgttacctcccagagatggcacgttagtcctggtcagatatatgccaggcttcatcctaaaccattataggcaagatgttgtgtgaagaagggcgagcatgtagattgctaagctgacacgtggtggacaagaatgaccgacgtgactagtctgatactggtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaaagagagaaatggtgcatgtggtatccccttaagatataaaaggaggaccttgcccactgagaggggggactggacttttccagattagaaacctagaacaagggagaggctggctgatactttgtagctccttcatacacagatctcccaaaacacaggagtagggtattacgcttctcagcggcccgaacctgtatacatcgcccgtgtcttgtgtgatttcactctcgcgaactttccacagaccaagagcttagaacctcacccagggcccccggccaaaccggcaaaggggggcctgcgcggtctcccggtgaggagccccacgctccgtca

SEQ ID NO: 66489 - DNA, 4602 bp, Oryza sativa
acactggcgacaggcgcggcagacgctgacgacggcggcgaccgggcggtcggccactcggcgcgcgcgcgcgggaaacaacgggcggcgtccgcgcgggcgcgcgcacgcgaacacggcgcgcgggaagcgtctttgcgagcagggagctcgcgcgaggggaggggcgctcggcgcgggcgactcccgcgcacgcgcgcgcggcgcgcgggcggggcggaggggggagcggggagagaggcgctcggggcgactctcgcacgcgcgagcagcgtgcgggcggggaagagagagagagagagagagcgggagagcgcccggggggagagggagagatgggccggggaagaggggaagatgggccgagcgagattcggcccatcgacctcgggggaggcaaaatagacttttgaggaggaatttgattgaaaggatttggattcggaattgaactcgacgatagatcggggattgagatcttgagatggcacggacactagacaacaagcaaagaaacaaatttcgcaattagggtttttaagagataattttcccgctaggcgccacgacggaacgggcgctacacccacatatgctaatggcggattaattaggctcaaaagattcgtctcgcgatttccagacgagttatgaaattagttttttttatttgtgtccgaaaactcctttcgacatacggtcaaacatccgatgtgacaccaaaaaattttcaattcgcaacctaaacaagcactaactgatctctctctagtgaggggtgcgacgtcggtgaggaagaggacaaagtgcgaagagggttaatcttagttgttcggcaacgggacattgtgtgaaagtttgttttgttttccgtgtgcacgcttcccgaactataaaatgtattttttgaaaacaaattatgtgaaagttactttaaaaaatcatattaatttatttttaaagtttaaaataatttatactcaattaatcatgcgctaatagctactgtgtatcttttcttctcttttcctctcctctcgagctcacctattattggtccattctagaagcaggagcctatctgctccggagttggatccgagccgcccgatcagtaacgtgcgcagcagattgaccagaaaactagaagaaaaactctataaatatccaaggcccggtactttcctagccagctggcagcctccaacccgaaagcgatatcaaaatttgaaaccgcgcagaggcggcagcttgctccacacgcctccgccgtgtcgagatttccgactcgccggagaggaacaatggaagaggaccgccggagaagcgccgccttcgtcatgtccggcttcaagtcctcgccgacggaggccaccgagtccaccccgcgcgccttgctcgcgcctccctccaccaaccggcacgccgactggcggcggctcccggacgccgccgtcgcccgcgtcctcgaccgcctcaccgtcctcgacctcttccgcctcggctacctcttctccccgcgctggctccacatctggcgcctcctcccgctgtatctccacgaccgccagttcaccactcccccgatccccgccggcaacgtcgcccaagcaatcaccaacgtcctcgagctccacgttggcaacggcgtccaattcgtacccaaacaaagcggcggcggcggcggcggacatggaggcaacgaggtagctgcccctgatggtggaggcggcggtggcggacatggaggcgccgacgacagcagcagcgacgaggagagcggcctctgcgacgacgtcatcgcccacgacgccgccatgctaaacggcggcttcgagatcggccgcgtgttctgcttccgggtagagaccacgcggtggagcctcgagcagctcaaccgctggtgcgccgccctccatcgcggccgtgctcgtgtcatcgtcgtcgccaacctccacctaccagggtaccccagatttcctcaagccctcctcgactgcaccagcctcctggagctccacctcttcttcttcaccgtggaagcctaccgcatcgacaggctcctcgtcctcgggctgtacagctgcgcctggggcctcggcatgatcgaccgagcaatccaccgcgaatcggagattcgggagctggcaatcgacggcgtcgaggggtcaaccttccgcctcgccgacacgcgcctccagactctgcgcatgtacgaaaaccaggtgggcacggtcgccgtcgacaacgccacccgattacggaagctgcacatgcaccatacgtggccatccaggatcagcatcaatggcgcgcccaggttgcgaaagatcgtctctcttgacctcttcaccaccgtcttggagatccaaggcatagtgattaaggtatatttgcaaatcgatcgatcaacctgcccgcttgcccaaccaatttgattaacaccaattctgaatctctgatcatgcgtgcgcaggctgggatggtggagcagcctccagagatccgttctgtcaggtatctcggcttacgggtgaactacacaacgatggtcgacatgttgccccgccagatagagcagatcctgaggagtttcccacgcgtaaaatcactgaaaatcctggtaatgccaatgaacggccaatcttatccaatcaattgttgcataattctgaatttgctgcttattaattgctctgcactgatatgtctgaattctgatttttcttgctgagtcgtggtctgaattctgaattcgctatcaattcctctgcacaaaagtgtgtgcattttggttttctgcctgagttgtggtctgcattcttaatttgctgctaattagtgatatgtcttgattctgattaaatttgctgtcaattgctctgcactaacttgtactatgcgttttgattttctgatttgagttgtgttgtgctctattgcagagatgcgatgacgttacacaagcagaagggctcctccagtggaacgatgcacactatgacgggaacaatttcttcgatggccttgagtgtttcaactatcacctgaggtggatatatcttacaggtttcagagggggcaagtgtgaagttgctctgatgaaagccatgctcgacaaagctagtgtcctgacacagttaaggatggaatactcgacaggaagcctcccccagctcaccctgaatcagctcaacttgtctctccggaatttcaagctgcacactccaaatggtgccgtcagaggcgatcttgtgtcctttgttgcagctgatgcttccggaagttgcgtacgactagcagtgtaaggctaggtcaggtgttgttctgtctgtgctctacttcgagagagatttaggctggagatggattctaatagctcgagtggatgtccacccgtttattgcatgtcaattagatgattacgaaaaatttttaaaaaaattaacaagatagatcaatatgtaatatatcactccacaaacatgtaagttcaaattcaacttctacaaattataacaaaaaataacaaatttaattgtaaatatacatatagtaatttaagttttgattgttatttttgttacaacttgtagaagttgaattttaacttgcatatttatggattgatatattacatgttgatctatcttgttcatattttttcaatttttttcataaccatttagatgacatgcaataaacgggtggacgtccactcgagctgttaaaacagttttccatttaggctagcacttcaatatcttcagtttgtctagctgtcaaatgatgctaactgctgttctgctaagtgagtgaataaagggtagtggtggtttttaagaacttttatcatttcgcacagtgttattatttgaactagaataaggggaagtgatgattttgaagaactgatatcatttcgcacagcattactatttgaattagaacatatgttttcatatagagggtagttgttggttggaacaatttatgagtgctttaatatatactccatagttcacgatatttacgaaatgtgtcagctgggaatatggtactgacaattggggaatcatgtagccttcattccccaaatagtttattagaatggtctgtctacctcttgcatatttccatacatgctgttgcatattttgtcaggtcacaagatagcaccatacccatctttacttaatcctaaagaattactcatttttgtgaattctcttggtttgcatgttgaagtgtacacaaatgagataagcatcatgcactttctttgtggacaaagaagtggaaattctttgcttgaaattattattgatgctcactgcctacatatgagaagcttcattagagtgcctacaaatgcagtatatatgtgcagtcgcaacaattttgtgtgttaagtcagcctaccaccaattctgaagacaccacttatcatgcttaaactctgactcaactgggcatgatcatcttccatataggttagatatctgaatcttgatcagatctgtgttaacaatgctatgagcatcaatgatgcattgatgctaagtgaatgatgatgccctctctgagtctgaacaatatgct

SEQ ID NO: 66490 - DNA, 7113 bp, Oryza sativa
taatcatttgcttgctggtttaatcaatggttcagtgaatccctcaaaaaaagaaaaaggaaaatgatttagtgaatcgtttatttgaagacaaaaacgacacaagaaaatttggcagaatgaggcatcatcaacaaattatttacgacagaaatatgaacattagatccaccagttatctgtcaaaaaaaagtatgatttgatacttacagtcccagtcaacatattgacaactatgttgggcagcagttttatcaggtaggtacaggtaaaaaataaaaaatggaggcctgatgtccctattttacatcttcctagaaaaatcaggtaagctcaaattgcagcacaactgcatgactgcctaaaaatatgtttttttttaaaaaaaaagaaagtttaaaggatgccaccatgtgcaactgcacttcatgttcttttccagaactggtattctggaacaactttctctcaagtttcaactggctttaaggttggaacaatccctgttttcctccatattagagcaatcatcatccagaaaagagttatcaacagataatttcgtcatatgcatagactttgtaaaagctccacctccagttcttcatcatcaagttatgtcatgtctgagcattgtgtgaggcgccaattttccgaaaggttcctagcatgtgatgtcgaagaattatctttatcaggcaatattcaagtctttatatctaactggaaagtcttccattaggtagcgattatcagctttgggaagtgacaatggcaaggtctcttcgtccacagaatctcggtatttcaatggaacgacttcaatcgaaaacctattttggctggccgactttgaacgacttgtgggtaaagatggtccagtacctatttggaaaaatctcattagacatgatgacatagtagtatctatgaaaatgtgtaaaatgacagattgtggcatactgtcagtcatgtcctttgtcttgtggaggagaaatgtcccagaaaggatggtcacaaaaccacacagctccgtgacaatttgtgttggattttgtcgatcccaatcctgcacgtaataaactatgctatcacaaattgaggaaataaactttccataaggcatcaattgtttcttgaagacagcaacattgtgaaagaaaattaaggtgcgtagtgcacggtaacaacattgtgcaaaattataatcacagcagcatagttagcggagcaggacacatgtagaactacacattaagccaaaaaaaaaaattgttcatagctttctgcaacaagaaagttgagtgtataagggctgaatgcctaatggaagtgatagaaaaagcttaccttaaacattatcacactggctaaaattgttagtgaagtaaacatcacgtaatatattggtgagacaactgctgtattaaaggtgtccaatgcctgcaagtcacagagataaaagaattactattgcgttaatgtaataagcccttatgtgatatgttacaataatggtagctcaataagctacatgttctgtactattgcccagagtgacatttcaatgccccagtgacgagccaggaaagttttacagcctgaagccctggaaaaatctaactacgctgagtatatgctgcaattctattttcaatccctacaatgatattaaaattctattgcacattcaccaacgatcccgggtggctccaccactgctatgccctacatattatttgagctagtgaagattcttttaaggacaggtgcgatgaagttgtatgaatgagacaagctgttagaagatcccttaaactcaagttaaatctcttcatgtaccttatttagatagtttatctgggtgctcacacaggtggctacaattagggcaaaagcccatgtctgaggatagaataactggttcactcctgagaatgttaacttcaatgcaatgccgagagcttttacactcatcacctgttaaattctcaccatcagatagaacatggaatttagttgaaacaacagtagaaaaaacaacaaaattgattatgattgggtcatatatttggacaggaagcgtacagtgagagatcctagaagagaacagactccgatgtacaccatgatgtttgtttgtccatgttgagggacaacaaaatatataagcaccagtgctgcggcaactactatagcagcgtagcaaagaaaacctggaaacaaagggaaaacaataatgaatcagacattcagtctagcccgtggaacttacagtaaggctgctgagggctatgttatgaacatattttaatacagtaaatacctggttcagttgcaagatcccaaacttcccttacagaatcgatgttgcgctcctgtggagcatggagtacaattgtgatagatccaactacacaaagaacacaaccaagtatgccaaaggtgtgtagtttctcctgcagaatggcgtgtgcaagtgcagcactgcacaaattgacaaaagattatggttttgatttagcaactagatagcaaaaacaaattttagcaagtttcttatttgattcatctgaaattacctgatgattatactgagtgccccaagaggagtaacaagaatagcaggagcaaatgcataagcagcaaaatttgcaatttctcccacaatcactgttcacaaaggtcatgtaagatgccattagtcaagtttctttccttagtgacattttttgtctaaaaacaaatgaaacagtaacttcagtatattagaaaatacacatttctgttcacttccaaccaataaattccaccaaatatcttactgaaagaataacaaggaaaaacaacagccctaggagcagacagtagtaagagatattcatgctaaggagccatattcaggtgacaggaaacactttgctccgtacaatcacttttcatgccccagttaagctcaaaggttctactaatatctagtcacatacttgtatcaatgtaattatctagaatatcgttttggcttcattgaattcagccccaattaaaaatgtttagtttctcctaatacaaagtaactgtatttatcctgattctcaagacacagaaacatcttattacaggtcttagggagttgacaacttgacatcaacacgagtttacatgaccaactaaccaggtaacagacaataaagatctcatcataatcaaagtgacatcaataaggaaaaaataattgcaggataatgtttgagcagagcaagctatatgttaagatcaaaggggaaaaaactgataaatccaatgatagaaaaaaaatattgtgcacataatgtgacagaaaagaaaggaacattttcaagaagtacaaaatattgtataatttaaaaaggaatcaaatgtggcttactagaaatcatgcctatccaccatagaggctccattaagtaagaaaatcctccatatcctgtttaatgcaaataaagaaaacatgtgacctcctgcattgaaacttgtagagcttgcaacacaatagcttatgaaatatcacacgaataatgaaagtgcattgatctgacatcaatcatttcaggtaagtgcataaggacatagatcaggttgagatgtaagtgcatgttttgttcatacgttaccactaggctgtcctaaagtaagctattatagagtaaagtatcatagtagttggttggtttgataaaatattgcacatgtgacatcgctatcatggaagtgaaccactagccagccaaaaagatgtaatttcgtcctggcatactgaagaaccatatcggttagccactaatcgcagaagcaccacaaccacctagcaatagaaacaacaacccgaaatttgacttgactttactctttccgcaaaccgaatcaaacaaaatccacagtaatcatccatgactcgatcagatacagcttacgatccagaaattcaaaataagcaaagcattggtaccacaagcattgaacatcatcttgtataaatatttaataatggaggacaattgcaaaaggccaaggataccaccacaaaagacaacttttttccggactcactcatcttagttccaataaaaaaaaatctcacaagtaacaaatgccgtatcaaatgaagcaagaaaaaaaaattcttcagagagtcaactgatcctccttgcaagtaaagtaaagatccttagactcgattagaactacttttgcaggtagaactttccagcttccacgcccaaatcattgcaatccttttcacccgcgagaaaagaaaaaagaggaacaaatccatccaatcgcgaagcaaaagatgtctctgacaagattcactacttgaatcaaagctatatttttcacatcagcagaatctacccgccaaaacggcgtcacctgtgcccccaaaaattttcaccttttcccagcctctctctcctctgacgagtgacaaccaaatcaagattctaaagaaaaatttccaaaaaatatttctactcccatgagaaatccccttgactcaatcagactatcaatttactacccaagaacaacaacctcgccaaataaaaaaaataaaaaaccaaagcagaaacagatccctctctctcccaccgagcaaaccaacaaagcaaggaaagaaagctaaccggaaaccgcgtcgccatggaaagcaagatcctccgctcgattccactgcccacgaatccaacccaacccaacccaactcaacccagcgaggaaaccgcgtagaccctaccctccccaaccaccgccaccgacgaacctcacaccggcgcgcggggggagatccaaacacccagagagcacgcgcgcgcgggcggccgcgaactcaccagcgcggacgccggagtcggcggccctcctgagccccatcttcttgacgatgaagctcgccccgatgaaggcgctcgacgacaccgcgaggaccagccccttggcgttgtcggtggacatccccgcgagccccgccgccgcagccgccgacgcgggcgccgccatcgctgccgcagccaccgccgcaacctacacttcgcccccgccactgcacggttactactccaacgccgccgccgccgacgaggaggtcatggaggtggaggaatcggaagcgggagggaaaggtagaagaagaagaagaagaaggtgagaagaagtgggaattttaaggggagggggtgtttttgcgacggggtcctcgaggattcgctttattaccaaatcctattcttttttgggttagacaagtagtatccgtttttagaacggtttacctaaatattaaaaaaaaacttgtctaactcttctagtttttgttggattaggcattgcattctcatctcagatctactatatgtgttgttcttgttgtaaaaaatactatccttttataaattattaaattattgctcgtgttcgcaaataaatacttgctatagtttattttatataagtactcgtacaaacgaagacaccaaaaccacattgggaattgtttatgtaagtgttcgtaaaagactcttgtatgtatgtttaaaattacttatatttgaaatcaaaagtgtaaatttctatgaggcagcttcaagcttatcaaatttcatttattcacctatatgtctgcagcgcggtatataattctatctttaattattgtcataataaaatctgtctaattcttattccttgtttatttttcaaaaagaaaatatacatatcttatttaactcatataactgtttcctacacattattcgtcatctcaattaatcaatcacaacattctcttctttaattcatccgtctattttcgcatcttaacatatcatcaccatttctcattcaaaccttaatttatacttaaaactccttaaaaatactcatgtctcgaaaacggagtgaggctgtgtttgcaactcctttttcccaacccatctccctcgttttccgcgcgcacgttttttaaacagttaaacggtgtgttttttacaaaaagtttttatacgaaagttgcttaaaaaatcaaattaatctattttttaaaaaaaatagccaatacttaattaataacgcgctaatggaccgctccattttccgtgcggagagaataagttctcaaccaccccatgcgaacacagcctgagtacatgacatagaagcactattcgtatcatacacgctacatatgcatccggaattctaggaggaactgtggtaaacctaattattgggattggtcaccatctagtagtacttaatatgactagcacatgttcacttcaccggtgggactttactactacgtgaaattcctcctcctttcacgttaaataaaccctttacaattatcgccacgttctcctatcttatattagcaaaagttattatacattgcattagagagaaaaaaaagtaccacgaataacaaagtgagtttgttaagtttcttgtgatgcaatcagtctatccggattcaagttattgagttgatacggatgttcgcatttacagattattgtttttcagtggtaaacgacgtaaccatcgacaacgagacacccataatgacgtcattaatcttaaaatatgctgaccaatttttcgagcgcattcgtaaattttaggatataatatttcgttctttccaagattagagtgtgtgtgtgtgtgttttaacatatatgagtgagtgtgcgaacgtgagtgcgtgcgtatatgtacgtgttttttattaatactgtgaataagtagtataacgagtcctaatttcacaataccgagactcccaagggaccaaaacgcaaagagccccccgaaattccaggtgaatcgaaataaatgtgtttcggatggcagggcgtgtcagaacccacccaaccacgcggctgtcgcgtcgtccgatccgtctgtccatcaccgcatcggacggtggaggcttctcccaggagaggccggggtggcgttggtacgtggggacggttggtctggatttttcacattttggtccttttaaaaaacttatttcacaaatagacccctaaaaaaacttatcccagaaatggtcctttttggggc

SEQ ID NO: 66491 - DNA, 6611 bp, Oryza sativa
cagtatcttcttcctgagctccggtcatcgccacggcgtcatctcacctcctcgccgatcagtcagtcaccctccggccgacggacaccggccggcgatgtcgaagaagagatagatcaatggagaattggaaatgagaaaacacacactggcaaatggatggcttcttcgttgtcccggccgcatatcctttcctatggctttctttagttagtgtgccaaaaattttattaaatatacggacacacatttcaagtattaaacatagactaataataaaataaattctagattccgcctgtaaattgcaagacgaatttattaagcctaattaattcgtcattagcaaatgtttactatagcattacattgtcaaatcattgcgtaattaggctcaaaagatttgtctcgcaatttacagtcggattgtgcaattattttttttcgtacacatttgatgcttcatatatgtatccaaacatttgatgtgacggaaaagttataagttagaagaaaaaagttggaatctaaacacggcctacgtaggcccaacagaaaattgaatctcgtatatctggttcttgggcctatattatccatcagtccatcacagttgttgaatcattcttgggctgttaggctaattgcctagtagaaataaaacattaatacctttctcaatgactcgatcacagtaaatcctaggcgaaatttggtatggtccactcttctaaaagatgtcttttcgagatatgttacctgctacctctgtcacaaaatatagctacatttttactacactcttatttggaccaaacacaatcattcaattttgtttcatcttacttctgtgcttgtattttagaacggagaaaataccttattaaacttaaatactactagacccaaatcctcgttacttttagatttttttaaaaaaagtttcctttttattagcattatccttttcatttaatttttcctcgcttcctgttctctctgcccattggaaatggatcaaactggtttatatcaattcgatcagctaagcgagaactggcgaaacaggtggactgaatgacatgcgggcccatcagttcttttatttgactgggatgccacgtaagtaacaggtggataggatgcaaattgaacagtttataaagttgacgagtaaatggtgttcaataaatcaataatataaaaaaataacactttctccccatataaattccatctagcgtaaggaggagatagggaataatcaaatcagcacggaacgtgcaggcataacttcaacttaaaagtcaaattatatgcatggatattcaattcagtccataatgtgattaatcaaataattcaatgtgtgtagtacattgactatgcgttggacgcttaaattcattgcaactaatccaatgtttatagaaaatcaatacctaatataacccatttttgttgatttattttcaaaaatataatttcaattattcttcttctttcttttttccattagcattccaacttttcgaaaaccttcatgatattttgaaagtagaggtcatagcaacttttttacgagtcgggcacacacgcgcacacacattcacgtggttaggaactaatactccaatatggagtatctctaaagatacccctaatctgtgttcttctctcaacttttccaaacctctcgtctctcaactttttcaaacctatcatctcttattttccatacgtatgtttcccaaactactaaactgcgtgtttttttaaaaaatttctatagtaaaattgcttttaaaaaaatattaattcattttaaaagttttttttaactaacgcttaattagttatgctctaattctttgcttagttttctgtgtcaagaggcctcaaaactcagctctaaagtctaatattttttagttgatcctttttttaacaaaaaagaaattaaaaatgcattttgagtttcctcccccttttaatttgcatttgcatatttttttctaaaaattaatttatgcctcccacatatttggactagtggcgagtagacaaaccattttgctgtttgtttacacgtcaaactcgtcgtcggcctccccctcaccaccttccgattcccctttctcccattcgcacggcttcttcgtcttcttctcttccctcctctcgcccaccccccctcgcagatctcgccgcgctctcctcctcctcctcctcctcctcctccgccgccgtctccgcgaagtcgttcccgccgccgccgccgcgggcaccgcccacgcgctccgttccggcaggcggcgcgcgctcgctcgctcgctcttggtgtctctggagaagaagcggagagagagagagagagagaggtggagaggagggagggggtttgctggggtagtctctagaggctccccctgctgccgccatcgccgtcgacggctcctcctcccctcccccggtggagatccggggtggtgttcctcggtaagcgggattggttttggttccggattcgcctcgcggtgggggctatccgtttggtggggcgcggcgggatggatcccgtcgtaatccgctcgcgagggtagagctgttcgtcgtcgctaatgcggggggtttcgcgttgtttgcagggttcacgcataggaggtggcggctgcgcgcgcagaggctcgggggcgagggcggcggcgcgggcgagatgaaggggtcggccatcccggcggtcgcgatcatgccctcgccgctcttcctctggcggttcaaggtatcgtggccttcttcagctcaactcatggtacactgatacggcgaggcgatggatttagcgccgatttggttgcaagtgccagttgtctcctttgcttaattttacctgcttggggttatcgcagcgcgacattgctatgtagttgtaaaataatcaatcatgttatgtgtttgtcctggagtatagtttggtcaataccttgcaactgcggtaaagggtatcacaggaatcacggaggaattacttacctttgctcaaagctaatcgcagagatgactactactcatagttgggaaacattattggattgaggagaagtgatcttacttcatagggtctagtcttttccagatatttgtcctacacattaatatttccctccttcctgctactgatgcataaaccccattttatctgtaccattaattgtaataaaaggaaatcgagaatcatgatttatccttttcttctaaatgaaaactgaagaagagtaaaactcatctcatgtcttattcttggcttcactgggatgtgcttttatccttgacggaccaagataatagtgttgacttcccttgaaatatatggcaggaaatagcattaatcttggcatgcataatgaaatggtctttcaggaatgccaattttcacttatgttttcttctacagcttaactttgaactgcatctgagaggcatgatagaaactacacattagtgcagtgtacaattctttactcccgtgttattatgtaactgaatataaggagtatttagtacaaaagttatcctaagctcttgattctgcatttacgtgcatcaattttacttctctaatcactgataaacccatccatttttcaggttgtattgtttctcctatggggtttatgctgttgcaaggtattctcgctttgatctaaccatatcttttttcttgatatgatctgaatctcttgttgtagttctaattcacatattattttggtgttacagataggttgggactctgttatgagaatgagtgctgatctgcgagacttatttctttacgaagctttcttatactacaatccgcttcttcttgtggtaagtttcttttgtgaagtatgtatgacaatctcaagggccattactgtagaaaagacagcaaatgaaggcacttcctgatcgttttgtacttgtggttcatgtttttgttgtaggctctgatgatttggttatggggagtaaacctgtgggtctttgcacaatcatcagtgaattacgcaagggtgtttgatcttgcacaaacacatttatcgcatcgagaaatatggagggtatgcttatctgattctcctggttgcactttctgtttatgagcttaacttgatttggattttcataagttttctccctttcaaaatgcatctgctctgacatagtttgctatgtacaaatttgtatgtctggcatacagttgctgtcatgacaatgaaagggttcaaagtttgtctatgccatgcccatgtttgggaaaagtttgcaatattttatttaattgtcaacccatcaggatttattgtgctagatgcattttacatttgctgcttcatattcatatgtgcacttttctctggtgttgtgttattacttgattttgtcatatttttggctaatgcaatcttcatctttttatttcattaacagtgtgctacttggcttactttgattgttcccacgagtatgacagcttacctatatttgtactcacatggagaagtgtcccttgctgcatctcaaccagtgtaatatctaacccattaattagttcatttcatgccttgttcctcttgtgtgcttgagctcatgattttttttttgtgtacttaatgtttggttatattgttggtagtgcttaccaatagtcaatttgtgtgtaagagtatcgcgttcccaaagctctcaaaaggaacactgcacctttctttagcatcaactgttactgtacttgtgctttgattttccttagtcaaataagtggaaagtctcatctagtacaataagactttttatgcaagacaaacaaattttatgagtgatggatggtttaattattagaatgaacctaaaggtttgtacgcactgtttcttttttacttgtcatttacgtcatcggcatggtcactaatacacgtatttaaccattcttttactaaccatatgtactgatgagtgatgacattctcagtgacaagtcctagtacttctgtatgtacttgaagttttttttttaccctgtatatacttgaagtttgtctgcatatgttttaaaacaaaaccaatttaagaacactaggtgtagggtatattgccttcttgtttgttcaccatgttgaagatgaaactatcatgcagtgttgtcatgtattgtatcatgccgtgccaattccagggtggtggaactaacatatctttctgcctattttcaggttcttttatatgctatccttcttatagtcctcttatctccttttgatatgttttacctgtcgtcacgcttttactttctgaggacagtgtggcgtataatgcttccattgcaagtaagttgtacaatttgttagtaaggggtgtggtagtttttgtttttagctgtgcaacatgcactatgctactgcctgttgtgactaagcatatgccttttatgtccttgctgtggagccagcaattagatcagactaacttttttgatggtttccttcccccctgttctgcaggcaattacattccccgacttctttttggctgatatttttacatccatgtcaaaggtatggagcaatttatttaaaattgttggttgtggattgttttgtgtacattatttctgtatagagaatatagggaaagacttactgtctaatactatatgattctctgtttggcctctaggatttaatgtgtacaatgttctctacaaattaaaaaagcactacatgacatgctatattttagtttgtagagaactgtttcttgcttgtatttggcctgagttagcattcagatacttggtattttaccattttgcctaattgttgcatttcttcacaggtcttctcagacttggaacgttcagtttgtcgcatggtcaatcggcaggttaatttcttatacttactttttttgtggggaatttcttatacttgctgttgtgctatgtgcattatgtcctcaatggtctctaagtgactgtcaaacgacatgccattggcttatattgacagttgtaaattattggtataactcatctcgttcctgtataatgtgttcattattatgatattctacaggttgcaacgaccgcttggcttgaagcagattcaatttgtggcagccattctgtagctattcctctagttcttgtgttcccttatttgtgtcgactcttccaatgccttcgacaatacaaagatacaaaggagaagacttgtcttcttaatggtatttactgattgttacttgttgcaattatggcttgctttaaaaaaatgatctagaacgcattcgtcccatgtttgctaccagttcctctaaccaacaaacatttgtctcaaatccagcactcaagtactcgacagcggttccggtgattttcctttcagctctcaagtatcatgtattccctgacaagtgggttagcttttatcgacccctctggcttatgtccagtgttataaattcgctgtattccttttactgggatataaagcgagattgggatttgaggtgtgctatcttcacatgatctttgttttagagcttcagcatgtgttttcacatct

SEQ ID NO: 66492 - DNA, 681 bp, Oryza sativa
gcccaaagccaaaagaagacttttaaaccctttttcaatttaaagttattcatgaaatgcaattccattgattaaaaatacttccttagctcaaataaatcccagaaaaatctaggaattatagaattaagcaaagtatttaatgaaattttatctggccccattttatattgagatttaacaaattaaaattagatcttctcttttaggcttttaaaatcatttctaataattccttttaaacaacaatttataatttaaggattttaaacaagaaaagctcttaacaattataattagatcattattgatcaaataattactgaactgttctttgtatcatttaggaattgagagctgaaaaatccgagaaaatttcagagagttgacttaatcatggagaatttaataaaaattaaatccatccatgctttatattaaggaaattttatttcccacatttaacttcacttgtaaattaaagatcatttaatataaattctattaataatttattaaataatttataaatcctgaaacgaaatcaggatgtgacagatctacccccctacaaagaatctcgtcccgagattcggaacggctagaaagaaaaagggaataggtaaactgcagtctatcttattccataactccgataattattctaaggctttaaagaaa

SEQ ID NO: 66493 - DNA, 13028 bp, Oryza sativa
aacaatagcgatttagccggtatatatgtcttttgtaattgaatgctgttgtgttccctctctctttttttttaaaaaaaaaaacagaattcaagtggcgcagcccaacaaaggaaggccacaaacacagaacctcctccgatgggccgcccgctcccgccaatgcaacgccgcatctgctccccagttacccgcccaatgccaccgccgtcgcggtctcacggatgcggccgcatatcgtgcgtccccccaccaccgccgcgtcgctgtcttcacgtcgctacgtcgatcagtcagcgacggcacacgggcgcctcggcgcgactccgaagaagcgggcggcgatcatcacggggatggcgcgcgcgcctcgcgggtgagaggctgagagcggcgtcggcgccatcgaccgcttcgacgcctcaaccgtcggcaccggctccaatgtggcaaaggcctaaggtggacatcacgcaaactcggctgatcacgcgccaacgtacaatgctgctaacttctcctaaaagctttattaccatagtctggtactctgttttggcttatcaacccgcaggcaaacttaaattttagaaattaaatccagatttttattttaggtttttttttcatcagaatctatttttagtctttagtcttttaaactgttaaaattttgtccataaattaattttaattgttattaaattgtattagtagtttcgatccccgctggagtaaaaggcgaaaaacgatttaagtgattcgttttttgtccttgggaaaaagaaaactaattcttaacctctttcatatgctcatgtattgtcgaggtactgtaaaaggaaaactcataaaatcccatttgatgagagatgatggaatagctactgcccccatttatcttctactgcatccggtttagaacgttatgcagcatacgaatgtaagatcattgaagagatatttcctttttgtaacgaaattctgttgagccaatatttcagttgctagatacatgtctgttgccagtcaatgaaagcagcatagggcattgccttggcacacagcatgcggtttagaagccattgcaaaattgcaatcatcaaagcgacaaccaccggatgggtgcatctaaccataaaacagttcgtaagtatacaactccaaaagaaagcgtggcatcgatacccactcggtctgtcccttttgtgctcaggagcttgagaagacgaaccacatccttctcgactgtgtgttcgctcaacaggcctgactccgtgtgctgtcgccttttggttggactgccctctctccatcccgtggcagctggctccaggactgatggccatcttctagggcatgcttacctgagcatctccgtgctggcttcgactccctggtcctcctggtcccttggcagctgtggacggaacggaactccggggtttttgactctgcactcttttcggtctcagtgattctagagtccatctcaagagtcatatatggtcgttagctggcattgctacttttggggttttcttgggagggtagtgtggttgcccccttcctgctaattggagttgcgtagtctcttccttttccgcggtttttgtttttgttttttctccttcccttggcataagttaatatgactgattgcggtgtgtataaaacactcttttcttcaaatatattgacgtgcaatcttttgcgcgttcgcgaaaaaactccaaaaggaggttagcaattgctatatattagtaatagtaccaaagagtacatgtgctttcttgctaactatgatcacataaaagaaaactttaatttccactaataatgtaggtaattcacctagcaaaagagatactccctccattttcaattggccatcatataaattttcgaggctatttccaaataatcatcagaaataattcccgaataatcatcatattagtacatattctctaagtctttttattatctaagagtaaatggatgttggtgcatgcatccatacacacaatatgcaatgttttgatttattattggattgaaaatagtggagatagtgcatgcatcgagttcgttaccgaagtaaatatagtacgaaaaagttattgggttttcttgatctctatgtactcatgtaatatgataattaattgaagaaacgcctaaggattttccggctagctctacaaggtggtgggctagacgatcttggttcgaagccccaccccttctaattatttgatatgacaacctgagtttgaagcctcaccccttctaattatctgatattagattctttcctaatattcgtgtatttttttaaataaattgggaatggagggataaaccttaactattctactacccaatgattaatgcatacaagatacaaaatgtaacctcttctaactcagtaactgccacccaaacagacaacagccagttggatcccatgctctcttttcgaaagaagctactatattgtcccattcgctcaaccacatggcaaattgagtttcctgatgtttggccggccaatcacctgtgccatttgtttgctgttgtcttccaaatcattggcctaactctactacctcgtgcctcagaaaagatgctgatgctgctaaccaccaaaaggttcagactgagggtatttccattttgtcagtggttcgaacagacaatcagagaaagcaatacaagtacagtatgaaagttgtacctcgtgggtataaaacagaaaggccttccgttacaacagaagattagtgatccatcctacctctagaaagcagatttctagaagataacaaacaatacaactgtatcatgtagatctctgccacacacaagcgaaaatgatgaactgcgcaaagtgtcatgaaaaaaaaaatcagctcaagatagtgccacttgcgatatggagcaaactgcagaatcgttgggtctcgatcgaagcgtgcgtgtgagttgtgactgcggtggtggctgtggtggctggacacgtttggtcttcgatgtagacttgctgcaaatgatgggctcgtagatgatacccggttattagtggttgctggtatgactgtacatgtatggcttctttccaacagaatatcattagccattacggtggaaaatgacccaaggacggatctgcccattagacagggtgagtcgaccgacacagctacgacccgtgtcgtcccacatccctaagatctcctacctccttatagtatttattggccatcaaaattaggtataataaggtgtgagcgtctaacaaattagtccgtcttttcacaactcacgcacgtcacaaacaataaccaaggcagttatgagattgagctataaatacgatatgtgttgtgttcggttcgtcttatcgactaaatatctccgttctccgccctttattttaaagttgcgtccgtcaatctcaaaaggtagctagctgcatgtcccccaaaggccccaaataatagccacagctaaatgcttatctcaagcacagtactcaaagtgctctagtccaattttccggagtcaaacttgtaatgttattgttatctgcttttctgagaaaagaaaacaactttttaacattatcgctagttaggttagtggttgtcttagagctaaggttaggagaatatatgcctttatccctagccaggctagccatattctttccagtccagctgaggatctgcatacaaaatgaccttactatataatacaaacagatcacgggtctaaagtttaaatcaggaatgatcaaattaatgaatacatctctttctcacctgcacctgctgcacagttcattctttatacatgtcttcggttgcacacatacaacaaagcttcacttccaagcttaaattcgacatgtgctacatgcatacgaacgaacttttagttagtcagtgcttcactttcttcttatatataaaacgtcggcaacgaccaaccgttcggaaaaaaaaaagttagtcagtgcttggtaaaaaggacgtatatacatagtataagaatcgcgtttttggacaaaggatctcatcttagtcatctctaaaagatcgccggtttcacgctggatcgatcggccggcggctagcgcaccattgcaggctaaggcggcagtgcgtgcgtgatgatgcggacgacggccggtctccactttcgcctccacgtatggacggtagctggcgcccactatttgggtcgtcgtcgtcgtcgtcgacgtcgtcgacgacgaccgcggccggccggattcggacgccggttgtggccacaaggccgccggcataaggaagacaggaatgttctgcgtcgtgttgcttgcgcctctgcctgcgtgactcacgggcttcgctggctgccatgttaatcagtactctagctaatgctatctttatatcccaacctaaaatttttcatgtcatattgaatgtttaacacccatataaagtattaaatataggctaaaaaataactaagattacgactaatttacgagacgaatctttaaagcttaattgctccatgatttaacaatgtggtgctacagcaaacatttgctaataacggattaattaggcttaataaatacgtctcgtggtttaccgacggattctataattagtttttttattagtgcccgaacacctcatacgacaccctatataatatccgatgtgacacgctaaaatttatacacatagatctaaacaccccctaagatctacagactgattgatgaagcttcccgctggttttacctcacaccgagagctgtctttttgtcagatcgactcacatgtatttttgtcaggctaagtgactgataaagaaccgttcagttttctagttaggccgtgtttagttcattgtcaattttttttacgtatacggacacacatttaaagtattaaaaatagactaataacaaaataaattacagattccgtctgtaaactgcgagacgaatcttttgaacctaattaatccaccattagcacatgtgggtactgtagcgcttataactaattatgacgtaattaggctcaaaagattcatctcgcgatttacagtcggactgtgtaattagtttttcttttttgtctacatttgatgctccatatatgtgtccaaacatttgatatgacgaaaagttaaaagtttgaagaaaagttggaatgtaacacagccttagaagttgtttctttaatggaaagtgtaattcaccaaatcgaaattctctatagtaccgatcattgatatgtaggtccgaggatctatggagcccacgtgtcagtcaataataccgcagaggatatgtatttctacgtgctttactagtttgtactccactagtttggacttcaaagtttcacgtgtgattcaacaattttgcgtaagctagtggataatagatatattcatgttggtttagaattcgatgggaaacattttagaaggcttcgggtgcagaggccggatttaatccatcttttttcttttaaaaaaaggacaatagatatattcagaaattaattagaggattggaattaagccatgttagaatttgatgtgactgcggattgtgacgcagtttggattggatcaagcaaattttaagcatccaggtgtacagactagaactgttaagtccaccccctatcaatgttcaagtactgctcgagtctcgaccgtgcccgccacaaggctgttgcgactttggtttcggtgaagtcgtcgctgaacgatgtaccttctttttccccaatgtcttaataatactccgtattcgattggtatggtggtgccgatccgacgtcgaaaaagtactgtttgactgctttcgattaaatttatttgacgttggggtactggattcgaaattgatattggtgtccaccaaattcagaagtacatgtatatgacatatgctcaatttacgcggagtgatcattaggaggatatgtataatgtttcctcaattctcgttatataatgtccgccctcacccccacggtgcacgcgtctgcatgcccactccccgcttccgctcttccgccacttcctccgctgccacggcgttcgccccaaccgcttcaccttccttctcctgctcacttccatgtcctccctcggtgacctgaggcctagatgacggaggaggctgatgggagaggcgagatggacgggatctggactttctggtggagttgttgagatcgacgggatctatggccagactgatttgcttgatttgatttttttgggatttgatctggtggatttttttccatgaatcatgctctacttgctacttgttggtggcatcatcatattttagtccttcatcctagttgctttttcattgatcttgtacggagtacttaatttttttttttgcaattattttttgtgttgagttcgtttatcgccgaatcgaatcaaactaaccaaagaccgaagtgctcggtcttgagttttcttgaagactgatcggtcttgtgatcctaaagactgaatttttcaaaagaccgatgaaccaaaccgaattttcggttagaccgaatgcgcacccctactcgtctcattgaggaggaggaagcatggagggagaggtaaatggagcagaggggaagccaacgtcttgctacggaagaaatgggtagggggctatacggtcattcgtcgaggagtacgaggtggcatgatgccacgcaacagagggaagtgacgaatctattgctccatccgtcccaaaatataagtattttggactttgacactgtctctaagatgctattttgaccaacaatatctataaaagtaagatatttaaaataaaaaagagttgcatattatgatagtttgtttaataataaatctagtaacatcaattttacacgattgatctttttttttatttttttctattaatagttaaaaagttaaaaatatttaacttgtcagttgtcactatgctaaaaatgattatatttcgagatggatggagtacgagttaaggtgttcgctacttctatttatcatggttgtttgccaaataacaacccccacaataaggacttggcaaggtgcttccctaattatcatgtgtatatatatcaagagattttgcaatcatgtgtatattatggtgggcacgagtagccgagtatgttttatattgagcacatgtccattatgctctcatattatattggttgtcaaaggttgccacgttaaaacttagacattcaacaatttgttacctcaaacatgtttggttggtaaccacaatggtgacataccgcacttggcttctagccaaatgctgtcacatttatggccaataatttgttggccacattttatacggcatatgccacacttatagcaaagtgaagcgtgacaaacatagttatcaaccaaagatcagacgtctggtattatccatcacatttctttcgattaaacaatatgtgcatagtaaataggactaaaatttacttcatttgttccaaaaatattcaaatcctagggacatgtgtctagattcatccctaaaatttaagtttttttttacagagacattacaccatttcattggggcagagaaacatgtcattatcatatactcctttcatcctataaaaacagatataatacggaatgtgatatatttagtaatacgaatttagacactactaaaatattacattgtattctacgtttgttttttaattagacgggtggagtatactttattgttaggcttagcgcctatttaattggcaaaaaaaaaagtttgcccgtgcatataacatcggatatacggacacacattaaacgtagtctaataacaaaacaaattacaaattctgacaggaagctgcgagacaaatttattaagcctaattaatctatcattagcaaaatatttactgtagcaccatattgtcgaatcataacgcaattaggattaaaagattcgtctcgtaattttctgttgaactatgtaattgatttcttttttatttctatatttaatactctatatacatgtgtcaaacattcgatgtgataattttgtttcggaactaaacaacccctagttgctgcatgatctgcgtatcttgtttgaatggggaatcgtgccaccaatttcctacctgtcatttgaatatcgaatttataatccagcacgcgtcctataaataccggacatggcagccaccgtctccactgagctcgagctcgaccaaagccgctctcccatcgtaaccaccggatagaacagtgcccccgccatgaggacgagcacgagcaacgccgcgctgctcttgctggtggcagcagcgcaatgcctcgcgctgctctccgtcgccgccgcggcgaagccgcgcacgcgccagggcgactacctcgaccggctccgcggctcgccgtcgtcgtgggcgtcgctggccgaggatcgtggcgcgccggcgccgtcgccatcgccgtccggtgggcggcacgcggcgccagcggcggcggcggttgggagcaaggaggcggaccgcgtggcggggctgccggggcagccggccggcgtgggcttcgcgcagtacgccgggtacgtgacggtggacgcggcggcggggcgcgcgctgttctactacctcgccgaggccgacggcggcgccgccgcgtcgtccaaggcgcccctcctcctctggctcaacggcggccccggctgctcgtcgctcgggtacggcgccatggaggagctcggcccgttccgcgtcaagagcgacggcgtgtcgctctaccgcaatccctactcctggaacaacggtaagcaccgcctcgccgccgcggcgcgcacgacgtcgccatgtcaactcagaattcagagcaactactaacaccacagcatcattcgatccatggcgtggcgcgcagtggcgaacgtgatgttcctggagagcccgatcggcgtggggttctcgtactcgaacacgacggcggactacagccggatgggggacaacagcacggcggaggacgcgtacaagttcctcgtcaactggatggagcgcttcccggagtacaagggccgcgacttctacctcgccggcgagagctacgccggccactacgtcccccagctcgcccacgccatcctccgccactcctccgccgccgccggcggcaagccctcctcctcgccgatcaacctcaaaggcatcatggtacacacatatactactacactacatatagtacaacgaattcggatctaatcttatccggttttgttatactatgaaatatctcattccattgtagattagggtgtgtttaattagttctacgttaaaatggaaagttgactaaagttaaaagtttgaataaaaaagttagaagtttatatatgtagaaaagttttgatgtgatggaaaagttaaaagtttaaaaaaaaattaggaactaaacaaaggcttactatattgtaagacagagttagtacctctgttttaaaatataataatataagtatacttgaacaaacacgcagaaatgcttagcttttagaaagatccatacgagagaattcaagtactgaaacatcaactagcttgacaaaaaaaacaccaaaagtgtttaattaatttaatgcacttgacgggtacactgatgactatactgtgcgtgtcgcaatcaatcaaagattgggaacgcggtgatcaacgactggacggacacaaaggggatgtacgacttcttctggacgcacgcgctcatctccgacgaggccaacgacggcatcaccaagcactgcaacttcaccgacggcgccgacgccaacagcctctgcgacgacgccaccagcctcgccgacgactgcctccaggacatcgacatctacaacatctacgcccccaactgccagtcgcccggccttgtcgtctcgccgccggtcaccccctcggtaagtcagtcggtcaccgtcttcttgaccaacactcactgacgtttcagaattcgacgcgtctctgatgacgtttcaaagatgaggccgggttttcggacctcatcttttcgttttttcctatgcttatcaaccgaaatttaaatttttaacattaaatttaaaacttattttagtttttttttcatcggagtatattttcagcctatgtatttagataactaagaacacatatataaaagttttattcataaatagtttttcatttgcaaataagccaaacgataggaccgttcatctgcgtaacacctatatcatcggttaaagaaaatcaacttataaaaatgaatctagatatacgtttgttcagaattgtctctataagttgtttcttagactgaatgaatattcgacgttatgcggtggtgacggttactgggacagtgagatgaaactaaggaattgagtggctaattgctagggctaatcaggaaggttaacttgtggtgtacgtgacgtgtgcgcagattgagagctttgatccgtgcacggattactatgtggaggcctacctcaacaaccctgatgtgcaaaaggcgctgcacgcaaacatcaccaggcttgatcacccgtggtccgcttgcaggtaaacccaacaatcacccataaagaaagtatcaaaccagtattaattaagcaggcaaattcatgcataagcagataattatggctccctgttttgaccaaaatatacaggtcttcaaatattcaaatgtgcagattaattaagcagacttctgtatgcatgaagggcctgtttttgtttgttgcctaaattgcctcatcaatatttttgtaatttcaatactgtctattatctatttggactgaagccgttttagcaggcctaaatggtaggcaacatcattagttaacctcagcttcaatcaaacacaactttgtcttgccaaaatttggcattggcaaaaattggtaaggtcaattttagccccaaaccaaaccagctggaaaagagaaaattgagctcatttttctctagtagctcatcagctgaatcacagctaaatggaccagtatttactactactatgttagcatcattagagcttacaatgctttggtcagggacaacgatttcatcagtgttttttttcatgatttggccagtagtacaatgtatcaagcatcacagtgaaaccaaccgatcacaccaacttggacagatgattaggccatcaacatgacatccattattggagacacttttggtgtttcatcaatcatccaccaactgttaaaccaacctgattagtgatttgctttgctgcacaacctggaggcaatcattcatagttatgaaccctagcttgctcacattatacgaaaatcacaccacactaagctcactatttcaggttaggcgtgcactgaattatgaactgaacacagaattaattagtctcttctgtctatcatgttttattttgtctatcatgttttattccattcgtcctggatttttgtctgcaacaatatgataaactgactggtaggtgtagcacaagaaagtaggcaatacaaaaggttgctgaaaacttgcagcaattccatttcacatgaacgggcaaacttccatgagttggcatagcgtgctccaaattcgtaaaatcttgtttgaattaacaaatgacaaatgcaaggaatgcatggtgctagtttaattttgacttcatgcatactccatatcactatatgcaagatcttatctaaaacatgagagatcttataatctattctcagaacaaaaaccaggaaccttataatgcaccagcttttatagtttctttctccatgtttattcgatgcacatgacgaattgcatctagaaccacacgctgttggtttccttttttttttatatgctggtatgctctgaaactatgcgtggatgtactgggacttcaacatttttttttctttttgctcatatcagaagtctatgattgatcaccttactctttgcccatgccgcatgaattgattggcccatgtgcccatccatcgatttgattgcgtagaactttggcataatttacaaaaaagaaaatatttgatccgttttgcagtggagtcttgagacgctgggtcgacagcgcttcaacggttctgcccattatcaaggagctcctgaagaacaacatcagagtctgggtgtacaggtatgttcagcaactttcagacaatcaatcaatagataccctgatcaattatctgaaaaaatagatgctctaatccaagaaggaaatgaactagtagtattttgttgccagttttggtatatatatgcttaattcagtgtcactgatattgcagtggagacactgatgggagagtacctgtcacttccagcagatactctgtcaaccagctcaaccttccagttgctgctaaatggagaccatggtttagcaacactcaggtacttagttcctgcacttaaaactcttccttcccttcacctgttatctgaaaaaacaaagtaggaaccacttcacagaaatctgaattcatcagaaaacaaactctcgcaggccagtatggaagtaaattctacccaaattcgaactttagaagctcataccatgaatactagtttttgttaggatttagaaattgtattgatctgtttcaatcttgtgaaattcagggtgttggagacgttggtggatacattgtgcagtacaaggggaacctcagccttgtaaccgtgagaggagcaggccatgaagtccccagctaccagccacagcgagcgcttgtgcttgtccagtatttccttgaaggcaaaacgctacctgattgcgaaaaatgtggagaggcttagttataaaaaaaaaacttaacttatgtttacaaatataagtagtataatgtgccatgaccacaagttgcattattcccattgttgtccccattctagatagtgcaagaa

SEQ ID NO: 66494 - DNA, 3839 bp, Oryza sativa
  unsure (1)..(3839): unsure at all n locations
cttgtccgcgttggctttttgtggcaatagccgcatcatatcgtcgtcctggtggcccaagctctcttctccgtaccacttgtaatatgagtctactttctcgatcctataaaaataaatattgtacaagatatgatatattctagtactataaatttaaataagctattcagattcatatagtactagtatatgccatatcacgtatatattatttttgtttttatagaacggggagagtatataggtagtttaattactgaacttcccaacctagtggtaggcatgagacgtcactagtcagatcatttaggccacaacagaagtttcatgtttcttcttgtcatgttttctggatatgctaaatagttccaagagcgtaaaaaagaaaagaaagagtaaaataattaaatagtgttgtctgatatcattgtagtggacacaacagttatggctttgctagtctcgcctaatttcagtaccctacggccctaccacaaccctcctaaactagcacgaaccactgtctcctacttcaaaacattctgaaccaaagtccagcttctagatttttcacttttgatctttttaaaattttattttacaaatagatccatcataacttattatgagaatggatcatttttatggcatcaacatcattagcgtcatggtccaatataacggcgcaatgacagtgatgccatcccctagcttccttgcaaaacctatgggtatgtttccgaagcttaagattttgagaagctgtgggttggtagtcagcttctaagaatttagaaaagctaagttccccttcccgtggatggtcggggcatggtggaccccaccgagacctacaacgtctgcctcttcaaggtttcaaaaggagtgtcgagatctactgaatctacatcttccaggtgtcaataagagtatcaagatcaacaagatctatatcttcaaggtgttaggaagagtgtcgagacttacaagatcatcttcaaggtgctaaagcagacactgacggataccggggtcttgtctaaagctatgcccaccatgaactccttctttatcaacatcttcgagaagctcatccaaaacacaataaaatctatctttggcaatatgagcgcgctcgagtgggcaagggttatagttattgagaccggactagtaattgagcngacaaggctcttggttcgatggttcactggttcaaccggttgaaccattggtccaacctagttcaataggtattaaatatattactcattccttgacatcacgaggtgcatgatagcctggtggttcgtgatcagcttcctctctcacatgtgatcttgtgttcgaatcccatcctagtctcgttttcccctacctgctcccctgcatgcatgtcttctcgcgcatagctgccacaaggctggttcaactacagttttccctggttttatagcagtttttcctcaaaacaggacgctccaatcggttcgattgcatatccagtcttttaactagaccggactggtataggctctggttttggtttttacaggtccaaccgtcggtatggttcggtcttaataactatggcgggggtgccctgaggattcgaggtgacccaagcacggtggctagtcgaacacaagttttcaatcccttggggacctgagcactgattaattagtgccctaaaggtttaaggagagcagatcggatccggtgattacttttaaccaccactttacgtttattatagggtggttcaaacttaatgtacaactcatccacaacttgtacgtggccgcacatgcagccccttgcatgcccacatcacgttggagaacacgagacgtgcgatgtggctcatcttcagcaacattccctaggggtcacctctattggatacagtggctaataggtaggctcggggacagttttaatgaagacttttacctcccatctctacttgtcattcggtatatgtggctatcacatctggccgactagcttggaggtacaacaataatactaaacatatcaaattcagaagagtagacctcactcctacatgcatgcaatggcattgtggactccccttcacgtataaggagaattcatgccaccgagaaaaggttcacactttcatctaagctaggttagctgaacattcagtgagcaagcaacctctccttctcacttagaactttttacatcactttgtagttcacctcaccatccatgcatagtccatcacacaggagtaaagtgctacgcatccgtgtgggccgaatttgtatatccgattgtgttcactctattcgcgtaattaaaacccgaacttagaattggtagcccggccgaactcacaaagagggagtacttagctttctcactagaggagttccgtactccgacaaacgccaatatcatttgcgccatcatgttggaccacaaaatcaatgatgttggcgccacgaaaagagaccattgctagaataagtttttaagtgtctatttgtaaattaagttttcaaaaagatctaaattaaaatataaaaaatccagagcccagcttagccctaaccatgcctggtctggcccagcctggctctcctagcgcagcccaaaccgatcagctgactcactaatccaattccaaataccacacgaatgtactccactccattgatcactcatcaatcatcaatcactgtaatgcactatccatccattaattttcctcccttgattcacgtcgaccgaccgagacggagtcatgtcacacggtcctaatttctttcgccgtgtggaaggcattggatggatctccccagccacggggcaagcgaggggaaaaagggctccgagcccacaaaggacgagccgtctatgccatgccatcatcatggcaagatcacaaacttcacgggggatatatgtaatgtaggactaataataatattgcaacaattgtgtttctgcctttttcgctgtgatcattacacgggtccagccttttagggataacaatagttacctataacacttggagggttgaaaatctagtgtgtccttatatactttatgtgtatacatcttggtaggatatttggattttttttcaagccttgttcagttagtctctccaagagagagggaattgagggaattaattctacatcttaataagtgcgaaataaattaccttaaccctcgaaaaaaatcaccttcagatcccctcaaccttagcgatcaattatcccagctgagcacatacaaagtggacattcttatggtgcgggtgtttgggttttccatgtaattaaaaagaaaggccacgtgtctgcttgatataaagatcgcacgatgggtacgtatgggctcgatggtgtgttcaagggttgatgccatgccaaaccaacaatattgttgaataatagaggattagatattgaacacattatattgatccttgggagcctgtgcatataggagtacaacacttagttctcaagtaagcatagagatatactcccttcgttttaaaatgtttgacaccgttgattttttagcacatgtttgaccgttcgtcttatttaaaattttttgtgaaatatgtaaaattatatgcctacataaaaatatatttaacaatgaatcaaatgataggaaaagaattaataactacttaaattttttgaataagacgaacggttaaacatgtgctaaaaagtcaacggcgtcaaacatttcgaaacggaggtagtagatatataggagatacaccacgacgtgtgaatctcatatgtatccatgttttatgcagtcataca

SEQ ID NO: 66495 - DNA, 13511 bp, Oryza sativa
gccagcatggctggcgccgccgcctccatacctgtttccctgtatggagttgcaacggtgtcatttttattttattttttcggatgttttttcacactcaggatcacgatacaaccaaccacaaaaaaaaattaaactcgaactaccacttagctaagtctgaaaatatctagcataccacttagtctactttgcaccttcactaaaattagaccataactcttttagtaaaaccctttgatcagcatgttaaacataatgcactctaccactatatgaaattacttaatctaattcaaaatataaccacatgaaatgacatatataagttaaacagtacatagagatgcaattttttttatttttatttcatttttttgatattttttcacacttaggagaacataggaaccaaccgtataaaaaataaactcaaacggacaaaatatgtgatatgtagaatttttcaaaactctaccgaaatggacaaaatatgtcatctattaaaataggcataactttctcatacggactcggaatcaggcaaataatatatgcacggacatctacagaaaaagttacatccgattctccccgctttgtcgggttcggcgatattaaaacctccaaattccgcttgcaagattgtgttttcgaggagagaagtttttcggtggagctttgaaaaattccatatgccacatatttcgtccgtttgagtttattttttacatggttggttcttgtgagttcctaagtgtgaaaaaaatatcaaaaaaataaaataaaaataaaaaagttgcacatctctctcctctgcactagttcggagagaggagaggagaggaaaaattctacatgtcacatattacgtttatttgagttcaatttttctatggttggttcttgtgtgtccctaagcgtgaaaaaaatatcaaacaaataaaacaaaaattaaaaaattcggaggggggggggcgccagccactctggcgcactccccttagccacctcagcatcgccccgccacgtcggcagggggacggcgccaaagaggctggcgccgtcctgttgaacaacggcgccagccactctggcgccccaaaaaggaccatttttgggataagtttttctaggggtctacttgcgaaataagttttttaaaaggaccaaaatgtgaaaaatccaggacggttggttgggttgggacgggttcgggagcacgtggaatatgcccttgccctcctgtagttctgtactaccggatgaaacggagcaaggaatccgccacgctggcgcctcctctccattttcatggtggctctcactctccaagcgaaaatggatcggaattacgaacgctgatggcatgatcgtagctaggcccggtttattccctaagataaacttttcaccctgtcatgtcatattaaatgttcgaatacataagagtattgtaaaaaaactaattacacaaattacgtataaattatgagacggatattttaagcttaattgcgtcataatttgacaatgtggtgctacattaaacatttgctaatgatgaattaattaagcttaataaatccgtctcacattttacaggcgctctgtaatttgttttttattagactacgtttaatacttcaaatgtgtgtgtctgtatatccgatgtgatatgccaaaacttttcatctcgcaaactaaacaaggccctactaccttcatgtcaaaatataaaaacttattatcggattgaatattttgtagtataaaatatctagatagaaagtctatccaaatacgttgtattaagaaacgtctcattcggtactagattcttatatgttgagacagagggagtacgtaaaaaaaacagtagcgaaagagaaactcttactattcccactatcctagttcatacgtaaaaagacactttttagaaaacaaaggtattactagtattgaagaaataaaatgtctcaatttacaaccgaggatagttaagagagtagaaataaatttattttgtgataaattttaaattgtaggaaacttattttgcaggatggagggagtccttatcagatgcaaccaaaactaaaatttaaaatgaagttgatttgggggtccttttctttgtagtttattttttagcattggcttttaaactgatagtaacacaacttctaccgataatttacttcacttgctagtcgtaactcaaatgatcagaacatctgtctattttcttgtgtcttattggtgatgtagtttgtgtaagtaacaagttgtctctgtttcatgagaagccattattatcatgctgtgtaacttcagccccgttcttttctccaataaaaattgtataaatttggatattcatggcacgcttttcaaaattactaaacgctgccgtttcgtgcaaaatttttatatatggaagttgctctaaaatatcaaataaatatatttttcaagtttataataattaaaactcaattaaccatacgttaataccatctcattttgtataaaacatttcatctttattacgagtttcaaacaccatcttcatttcctaatggataatcatccatttataagtcatgggtttggtcttatacctacagaccttccatgattttgatattagaattatgtttgatgtacaattcacatactctctgttcaagaaaaaaaatccaacccttatatcctgaggtaattttagttgtgagaaaaaaaatactacataacccctcgttaatagaaaatgaatatgttggatgcgtaggtgagcggtacagaaggaataaaagttcttgatcaatgaatcaatagtaggtaaaaatgtagaagtttaaattttaattttaggattgagtctatctgagacacaaggagtactataacagctggtttaatttggtactacaataaagagagtccacgggattttagaggattgtttctattacaaatctgaacggcttgatggtttttactaagtccacattgtgcatttttcagatagtactccgctgacttaaaaaaaggacaaaatgcagtgcaagccagccaaacaccgaaacacgtatagtactgtagaagtatttatatttctgaccaaatacgtccatgtcgtgttctgaatttaggacgtgggagcctctatattgcctgtctgcctgacatagattttcagccaaagccaaaaataagaagattaaaaaaaaaaactctttgttcagttgtgccaacttacacacctagaaaacggagagaaattaattaattaattaatgctatgtcctactcctacagttgactgttgtcaatgtcactccgttgtcctgaaccaatttttttaagaacaatttgtcctcaactttggcccgtgagtgacacagaagcagagggacagttattatagttgcatttgctccaaagcaagtactacaccaagcaaagtcagagtgtttacagttcataatatctgtttttgtttcctcctcgtttaagccagggctgataaaccgtgaaataattataaaaacttctaaaacagtatgtgttattagtggtttaaaaatcaatttttaaaaacacaaggataaaaatactctaaagtcaacttgttttaaacttcattttcaaggtgacaaccaacagactaacaagctattaaggtaatattgttatcgttttgcatacaactaactataagtcataacgcttactaacgataaaaaaaaatgatgataaaacttttataatgtgttctgaacgacttaaaaattcaatgctaaaaaataaactaggataaaaaaaatcaaaatcaactatagaaatattttttaatattaaattctttgttgcagttgataagttaaatagcaaacggtacaattcacagctagaaatgcgaaagctgccgctactgttagctttggctacttgccagttgccactagaaagctgctcactcagcaagacagcaacagcttatcttgtctccttgctcatctcatccctcaccttccccttcaaatgctttgcattacatatttacatcaacattccatagtggcaaaattgcaaaaaaaaacaaacaaacaaacaagcaaaaaactctagagagtaggagtagaatctagaatctctctctcaagtactccctccgtactcgtaaagaagttgttttagacagtgacacggtctccaaaacacaactttgatttcttgtttctataaaatatatttattgaaaagtgatatatgtatacttttatgaaagtatttttcaagacaaatctattcatataacttttacatgttcaaacttaacaatttgatagttattcatgatttatattcctaaggtttgacttaaaccttatcctaaatgactttctttatgagtacggagggagtagttatttaattattcagataattcaggggatattttagacggtttcatatttcattttcttttagaaaaaaatggtttcatatttcggggctgattaagtagaaaaatcccgtagtataggaggtaaatagattatacatatttctttctaacgtgaagatgcatagatatactatttctttacttatttataagatacggtatagttggactcatgtaactaatcattactcaatcgttacaggatcaccataaagtataataaagtataagcatatactcttcgtctcaaattaaaaaaacccaacctagtattagatgtaatgttttctagttaacagtacgatgaatctggacatacttctgttcagattcaactagaaaacatctcatccaatactatgttaggttttttttttggacggagggagtgtggagtacctgattacttggttagtggtttacaataaggctggccgtatttagtttgttgggtgtaaaaattttgacgtatgcggacgtatatttgaagtattaaatgtagactaataacaaaacaaattataaattccgcctataaactgcgagataaatttattaagcctaattaatccgtcattagcaaatgtttattgtagcatcacattgtcaaatcatggcgtaattaggctcaaaagattcatctcgcaatttacatgcaaattgtgcaattggttttttcgtccacatttaatgctctatgcatgtttccaaatatttgatgtgacgtttttggctaaaattttttggaatctaagcacacctagtgtttagttcccttcaaatttccaaaaaatccatcacatcaaatgtttggacacatgcatggagcattaaatgtagacgaaaaaaaccaattacacagtttgtatgtaaattgcgagacgaatattttgagcctaattgcaccatgatttgacaatgtggtgctacagtaactatttgctaaggacggattaattatgcttaatagattcgtctagcagtttatatgcggaatctataatttattttgttattagtatacgtttaatactttaaatgtatgtctgtatacataaaatttttttttgacaaggaactaatcacggcctaagttgtaaacatgaggcccagcttggcatggtacaaacaattttagcttttggaactcacacgaagatgtgacaaaagttgttgggtacaggccaaggaatgcacggtgacatgtctttgatgtcagctttgtgtcttgggctgaaaacaccctacaaatgcaatgtacagcctgtactatattggagtactctgaaagtctccattcctactttgctctagtagcctaggatcatgtcataaaatttgaacttgaaagagtgaccttaaaatttgactctagcagctgcattttgtctctaatacgcaattaagtttgattgattttacaccagctggcaaattatacataggactttcatcttctcaatataaaccatccaaatctaatttgtcttgatgtccatccactatatatcattcaattgtctgcatcaggtatattcccattgtattagataacgtgtctttaagagacggctggattgaggtatgatctattcatttcaaatctcctgacaatatgcctagaaaataactataaactcaagtatgatccattcatttcaaattacatgccgttctagttttgtcctaagttaaatatttgtatctttcaccatattctagacacgtgatttaacatcgtgagatttatattttagatttaacataagaaatactttcataacatataattcacgtgttattaaactacacgattttttaaaaatgatagttaaaggtaaaaaatatttaacttgagataaaactgaaacaacagacaattttaatcagcgaaagtagctgaattggaagttctatggggagtaggagtaggctctaaagaaggcactcctgactgagtagtcacatttcaatcattagccttgctaaagttgctagctagggtacctggatatattaacaagggatttactaattaatcacctcacttagctaggtagcattcatagcaaaaccatcattatttttgccgccacccaatgatgaagggaggtcagggggaattgttgaccagcatgcatatatacccagctcgcctttggaggctgaacatgcaatgcggcgacatggggccgaaatgaggtatgatttatttttttagataatagaagctttattgatctcagtcatctgaagatactttcggcctctgcaccacgatagtgcacacagccaacaaactccaacatactcaaaacaagagagaaaaaaaaacagcatgcaagatcaatgccctataacccgaagactaggtcgccacccatatatcggggtaaaaaactccttgaccacttgctccaaatatagacaagccgaagtgacaaagtcctgcaaattgggtttctagagaataacccatgatcggagccaatgtgtaatcaagaaaatagcctgcaaaggagaagaaacagctttcctatcaaaaaccacatcattctcatcattccttgagagctaaattgcccagcaagttgttgccgcccctagtaagactagaggtctaaactctttggtatgtcataaaacccactgcccaaacatatgtgacacgttcctaggcgaacaaatgtttgaagcaatctggattagagaccaaaccgaccgtgctaggcgacattcaaaaaataagtgttttatcgtttcttctttgtggcaaaaacaacagatcttactctctttccatttccgcttagccaggttaacttttgttaacaccactcctcgacgtagataccacaaaaagatctttactttaagaggcatttttaacttccaaatagttttgttaatattgggagctcccgtatgagccaaagcaagataatgagatttaaccaagaatcttccagctggtgttagattccatttaaactcatcttgctcatgtgacaaaactatattagcgatgcgtgggaatagatgattccatgccactaatttagagccaataatatccctgcgccaagtgaaatttcatgaggtatgatttaataatggatggtcacctagctaattatgcaactttatatctatatctataccttattaaaaaataggtaaagcttctgaaatattttttgtccgtgtccgtctttttttccaactgtttttttccatcacgcttcggtttggtattcttcgatctcatctgatctattgcacgccgccgccggaccaaaacctagcattgtcgccacatcatctccccgtgtgttttatccccctattgaattttgtggatttgttccaattttgagaaaaacggaaagagaagatcgaatggataaaaagccctcaaccaattttgatagattaagaagaaattggctggatttgatggggatgaacggctccggcatatatgcaagagactatctaaaggtcggagatggcagtcggctgtgtgagttgggcctatggctccacttgtgggctggaccgaagagaggtaggtcatgcggagggaagtaacggaataggctggggctaggaaggaaagaatggactttcatcccaaaaccaagaagaatttttattagctttttcaattataatgtatagccatcctaatgttttaatttattgctcagtttctaatagctattgtatcactgacaaaacgtttttatccgttgcaacgcacgagcttttttagttagataacaaaagcccataggagttctgatcaaagttttaacaacggcttattctttctaggtaaaggacaaggccataaaggttgatctactccttgtatcctagattttaattgaagtgtgcaccatggacttgttttggataacagatagtactcgtatttcatttgtagggaacatgcatgcgcatcgatcttgcatgcaatttatgagtggaacactttttttttaacacagtacaggcgcacactcatccttctgaactcacacacacaaacactctacccctatgaacatctccgagagactagactggtatatattgagattgatgaagtgtttatgggtgtcttgctctcgacggacacgtcgcctccaagaaaaatgcttcgtagaggcatttttctaatgccatagaaaacaattttaaaatacatttacaacactatatcatttaaaaaatatgtaatgcgtgccttattgtgaattaatatctacaaacgaaaaatatccgtcttgtggcatttcaatagaggcgattttttcatgtctataagataaatccctctatgtctcgtggtattttaatagagacattttttatgtctataagagggtagatgcattttctaaagatattaaatttcaccataatcatatcaaaccaatgttgaaaaaagagcataaactatttattcttgctactgtcaatccttgaactcaagatcttttaggcaactcattattatcttcaatgcgttgaccaacttaacctcatgtcaatacttgtaaggttatggcgtgtgttacttatatttattctcttagtatacagtattattcttttttagaagtgtctctgcagagtttaaaatatctcaagaaaatgtctttacatatcaggcatattttaaagtggtgaaagaatacctctacaagagaaaatttaacaaaatatactaaaaatatctctagaataaaagttttttaaggcaattcttgaaagtgcctctgaaaattgtctttacactgtaaaactcctaattttatagacaatttgtaaaatgcctctgtgtgaggttttttgttgtagtgcaaaataattagtcataaatatgaatacgcatgtcaagttagcacttaaatctggttgggtaggttccaccataaggaattgttaacaccaaaaattggtatggtcttttagtggattcagttatcgaaaaaagccaattggtagaacaaagtttatcaagatcaagctgaattcaaagctgaattcaaagaggaatcgtgaagaccatagcaatacagtttcgtatttccttaattaatatatctcttagataggtaggattagttatgctccttttcttgttaggaaatattatttcatgttcgatatagacttgtacctcctcgagggtataaatatgtacacctggagttttttaatatcatccacagatcaatacaattatatttcggaaccggcaacctttcgacgggttcttgtttttgggcggggctgcatcgattaagttcatcttcggtgagaaaccaagttcagggccttgctctcaagttgggcttcatcgtttcaatctccagtgaggaaagtaagttccgtcaacttcgcttgtatcaatttggctagaactttctcggttatgtccaatattctattcaagttgatgcaagcattgcctatcagatatatcgactctatctttaactgcatcgttgtttagagttgtattggattaattaggacttcctcggttaggtccgatattctgactatcttggtatttctctaatcacattgttgttttagattgtttcaatatatccatcacaattgtgtagatctatcagctaaataggtttttcttattatcttcaatcttatattatctcggttaggtccgatctattagattgctgctaataagtttgattctactaagtcaataggctattatacaacgttttatcggagttctagtcgatgagttaccattgctagctatgggctttagctataagatatatcggttagttagccgatgtatatatacacactatatcagtatcggccaattggtttattggttcaatcctttctattatccttgttagttgcaagatcaaactaaatgacacacctgaacctcatcaaaatttaggacttgcaccagagctaaggaaatctcttgaccttcgtgtgtggcaccagattttgcatcaacaggaacctagctaactaattgagttacgctcactgtgcaaatggaacacgttattaacattagtagttattgacttactgcaacatctatttacattttgagccattgcatgattatattatatatataataactcttatacaacaagtatcaaatatattaaccatcattgcaatgtcgtttttataccaatattttccatgggacgtacgtgcaattaatcgacgaaagaggcaggcttctactcaccaccaaatatttgtcacatatcaaatcaagaaacaacgaaaaagagagcagttttatgcacagttcatgaatttggatcacaaagtagttattgcaactttcttcattccattgagaactataggtatatatatgcataagagtagtatttttgccattgggatgtatgattaaaacttggtatccacgcaagaatttaattgtaccaaaccgcttctggttatcaaacatggcaatacataaatattttttcattgtagtataatcatgtaagatcttgttctgaagatttaattacaacgaacacaatggtgtaatcggattatagatcggataaataatttgagagaaaacttattaagaagggggaaatgcatgcatatgtaatagaaaaaagacttagcatgtgtactggcttctggcgttgcgtgataaggcaatttcgagaggcctctctgattattttttgcgaatttgtaagctatcgtgaagaaaggaagattatacagattcttactaatttatcatagatgaaaaatctctatgtttgatgtggtattttaagtagttttcttgtttctaatcaaactgggactctaactcgtagtcatccgtcctataacctctgtaataattggttgtatcttcttttaagtaaagaccggaatgaattccattattaaaaaaaaaacttggatatgtatagatattttgttttatgccatcgtttgtgctacagtagcatagtatgctactgttatatcctccaccatggtatagaacacatgcaaactataaaacataaagaaaatgttacatctttttttgtctcttgcgagcttgattctatcaaatgtggttaataccacaacttatacatgacatctgattgcatgttttataccccaaaactgaatgacttggtgaatttggaccacagcttgtgacaacagctaagggggtgtttgggaattagagactaaatttagtccttgtcacaaaacataagtcccaaacataagttctatgtttttatgagagggactaaatttagttcctagttctcaaacacccccttagctgttgtcacatgtcctcaccaaatgcctgccacaccatcaaacaaccaattaacttcataactattatgtgtgcctgtaattaatgttgttctcacaggaaagctcaattccatgcagacaattgtactacacagagtccaagtcttcaagatttttagtgagtcatctactggaccagcaatgccgtggcttctgagcctttcatgccatagacttggtcacttggacaaggcccctcaatcctcatgcaatggtccattattcttctgaatttatcctggacaataatatgctcagatccctggaacttggataaatccaagtatatttcttaaaaaaactacatttttcttctcaaataccctgattttctttccaaggcctaaaatctttaggcatattgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatcaatgtatgaagaagctccaaagagctggagagccagagagctcttactctagaaaccctcttctcccttttttcctctcgtgggatctattctccaaaacctcctctcctcccgtcccctatcctaagtgggcaaggtcctccttttatctctccaggggataccacatgcaccacttctacctatctctcttttgtgtggggacttatcctctctttactcaaacttggcttgccttctctagaaagctaaaaacactgcttgtttttgagtgtggccacgcgtcctcactcgtctgacctcggggatcaccttgtcatctcttcataaatgggcggagacttgcaatggctgctgtccgaatgaccttctgatgggatggcccatacctacctctactccgccggaagcaggtgcaacgtgggaacacggttgtctgccgacgacatgaccagtgtcagatcggtcacaaatcggtcattcttgtccaccacgcgtcagtctagcaatctgcatgttcgcccttcttcatacaatatcttgcttgtaatggttaggatgaagcctggcatatatctgtccgggaccaacgtgccatctccaggagctaacacgccggctccggctagggacgagtgcttggaggctctcatcctgacgggatggggcgaggcgtgcgtcagaccgcctgtcgccacctaacccacgatctgaccggcctgtgactggtcacagaccggatagacgagcgcgctgcactgcgttatatgcggtgtgacgcgctcgtccaaaccgcaataaatgcggttaggtgagccccgttgtgctcacctaacccatacacgcggcgcaaaacccacaaggggtcggggcgcctcacccctcgggggcgaaacgggagcggtccgacccctcggggagacaaagaggggggcggccacatcaccctcgggcccgacccccccgagggggtcaggccacgtgggtgattgctcctgcccaagcctctagtcatgatactcccggtcccatgtcaccgacacatatggacaaaaaatacgggaaggcgtgtcaa

SEQ ID NO: 66496 - DNA, 5392 bp, Oryza sativa
  unsure (1)..(5392): unsure at all n locations
attgatgagttgcttggtttagttcaatctacttctgataaccaccagagatctaataaatcagaacaggaaaaacaatgaagtatgcaccaaatttgactatatgaggatgatacactctctggtgttgtttattgacaatgtggcacattgttagaacaaaccatggcaggaattgatgatgagttatactgtggtgaagtgcagagaagaaaaaaaaaagaattaatcttagtgtgataaccatccttggtgttgagaaacaaanaggaagaaataaaatgacaatttctttacaagcttatattacttgcagaaattggtaataataaaacatctaactttatgttctgcatggatgaagtcctagccagaatacggacacaactgtttgttattttgttaatactcatgcaaagctgcaaaatttgcattttttttcttctctgttatgtactaatgttgattacttcaatgaaaacatgtttaccttagcaagtgtatataactataccaaaaggagaatggaagatgtcatataattatacttgacaaaaaatgaaacggtttgaaatacattttatttttctctgtttgaaccaaagaaaatagatttatgcatgaatttaatcatgccaaccttgcattagtagattacgcacaggtcaaatcccaacttgttcgagggaaagacattgaaattcttgcaagacagaatttaacacaaagtgtgcaagaacatttagtaaaagttcagaaaatgaaagcaactaaccttccaatacagttccaaagacaatgttctgtccatcaagctctgggcagggccctggtccagtggtaaccaagaattcaacattgtgataattaggattgagcttgatgtcatcatcgtcatcgttctgtccaaggcacaatgagagggtgccaggccttgcatgctttagttcaaatgctttagggtcaatagtctcagcattcctcacaagtccggtgggaggttggacctcgcccctgtcacgccgaggaccttggcggccagcaacgaagaactggccctgaaggagcttgtggacaagtgttccccggtatgcagcagaagtgcaagcagctttgaagttggcagtagtgagggggaggagtcgaccatacaaaccaaaaattacacgaccaagaggttcagaatcaggacatgtagcaagctcagctcctaaagtgcggtcagagcgaaagtagctagggcagacactgaagtccatgaagatccgatctgtgatggtggtatcaatggcagaggtggatggaatgtttgcgtcatctaaggcaggggatgatgaagcgtatagaagagaagggaggacagggaggaagatgagagaccgtctagaaattctagaggattcaataggtttatgagtattatcatggtttgttttcgagggaagaaaaaaagcatggtggttgttggggtggtggtggaggctgctcagggaaacagggtaagccatggaagaagtggccctggtatttgatgaaggcaacaccatactgttgctaactgaattcttcagttcttgtccttctgacgaaacagcagtagaaaatcactaatatccttccctgcaaatgtaatagttggcttttgagatataacattactgaaattctaaaacctactgttagcctcttcgttgtagggtcacaattatcacttgtgaataatggcaaatagctgacagcccaaacaattacaattttaaaatggaagctttaatctaattctcaacataccattctccgattacttcaaatggaacctgcattgcggtgagggggtgtatgatggtcacagcaggtcagcagctattccagagtgagcaaatatggtcctcttaagtagttgtagtatgagcgagtgaatatttctcaccatgtctttgcatatcatccattcacgattttactataagcaaggttttttgttctaaaatttaccagtttctatagggcagttccaacaatcaaattcaaatcagcatactttttttttacatttccaggcatgttgtctcttcgtttaactagctcgaaattatgtttcagcaattcaaaccaggggcggatccaacttggggcatgggggttcggttgaacccccgaacttttaggtaaacaaacaaactgttattacttgaaataagagaggtttaaggctatcaaattcacgaacgcaagcaaattccaggtcccggtggggtgggagagagagagagagagagagagagagatggatcagaaagaggacgcaccaggatcccctcctcccctccgctgctctgcttgccagatggagatcgccgcccggccctccgctcgtcttggcggcggcgcaaggagcggaggagaacgagaacgagacgggagatttcttcttttacgcgatactcgattactccgcccttatctcaatatcccttttacatgggaattgtgccggctgttttttttcgttttcatcagccgaatttatggctatcagatccttcaagattcgtgctggttatgcaggccatctggtgtgaacccattttgtccccctatagaaaggcaccgcatctggtgcaaaccatggttggcaaccttggaaactcttaatcaacacgacaggctcatccgatggctaggaacaaaggtgaattacttttacacttaaccgcccgcactcatccgatgctaacctcattttttacaaatcccccctcgtcacttcgtgtggccgccgccctccgcctcgccgctccctgcgtgcctggccgcgaacgcgtccccgcccagccagctcgacgccgtcgctggcccgccgagctgcgcctcccgccgtcgccgctcgccgccgcgtcctcgtgccctcccagccggctcgacgccgtcaccggcccgccgagctgcgcctctcgccgtcgccgctcgccgccgcggccgcgccccccctgtgcgcctccacgactccatccagccatgcgccgccagccgctacaggtcagcggcaacagcaggttcggaccgacgcctctgttcttgttcttggaggttcggaccggcggcaagaccctgtgctcttccagcgctaacgagcagtggacggatgtgcagcttctgatccacacccgtgcaggggcagcgctggaacacaggcactacacattccctggcctgccattcaagatttgtaaattagtgtttccaatttaattacatagaatagtagaaagatttaccaactgagattgacactgatgtacggattttgtaatccgaaactctgaagcgtggtcgaggcgccgtcggcgcacgtctcctccaaccgacggagcccatggtctcggtgtctcctccggtagaagcggagtccgctgcaatggatgtgaagggggagcggttgttcaaagggcggtcgcggaggttgtggtggtcgccgacgaggtttcaacggagaccttcgcgggggatgttgatgcagcgcgaggccgttctcgcggcgggtggcgaggtggctaatccgatccttgcctgtctgttccaggaatgaagctagtgacatctgaaccaccaagcaagggaggcacaccgatccacacagtgagtcagtataatgtcatatctcagaactgattattgtttcacatatgttttagaaactatttttaggggggaatgaaatgcttgatatgtgtaaaacattttgctggtttgtttgtccagatctataagtgcgtcaacatatacccaaatcccattatgaaacatttgcatggcatgtacatcaacagctcaatgtctctttgctggctttttcgtggccaggatcaatcagatttgtggtaaaaaatgagtggtagttttcattgatataatataactaacgctaaactgttgtgtcaattcttaattgaagtactatgttattgaacactgcgctacttatactgaaatgccatgttcaatttttgctctgtttgattcggcattgtttcaggttctggtaaaaaaatcaccaataattttgtgatgtgctcagctagctacacagccgatgatctggtgccttcagtctttgaccctgtttggtagtaatatgtattctatgtactttttttaatgatgtattcatttgtgtaatttaaatcacaagttctcatgcaaaaattctattgcttagcctcaggaggacaccatgcttgatagtgttagattgttataatatatagcgcttccaatatttgtaagacagcttattttttaggattctaagatactttaattttgtgtatttttcactgataggaaaataagtacatgaggctgccttaaattgtgcttgctgggtgtttctaccagcattaaagacaagttgattcagacctatgtaggatttgtgctcttaaagatgcataatttttggacaatttgcattgcatgtgttcatggatggaaaaatccatactttacatctgtttactgctctgctcttgtgttgtgagcaatttgtgctgactcacatccttcatgctcctccttttcaatgctgatgattattttcctttttcctgaagagcttggttggcttttctctcttttcgagttagcttttgtccccgtgaatgtaataaggtggccgatgctttagcatcaattggttgtaatagcccagaaaatactgttctcagctgggataacactccacctggtgttgaggatttggttgtcgacgattctgtcgagaatatgggttaatggaaacaattagttttcctctaaaaaaaaagagcttggttggctgttgtttttgcagtaggtattatccccgtgtgccgcattaaaggcaagttgattttctctatctctgtgttagcagcacacaagatcaatcttgttgggaaagatgaggagatatgcatatgtaagctcccccatccctcccattacctctgttggtaatgagtttatgctctgctaattttttatctcttggggggataaatgcatgttctggacaatggttgcatggttaaggtgggatgcaaccattttatttttgactgatcctacactaagtagttagaatcatgtatataaaacaatttttgaattatgttagttctttctccattcactattctgttaactgcaatcttaacagattcatttttgtttaatgaggttatatgttaacttttttttgtcagcaagcatcatttactagcaatatttgcactaaagctttactatatccacggaagcatacaaatttcaaatattagtttcctaaaggtcactgtttagaagtaattccaagtacttttacaagtacagttagcagttttgttaacga

SEQ ID NO: 66497 - DNA, 4714 bp, Oryza sativa
ttctccaaacagtgtagtttgttacctagattctaagaatctgtacttgtagaattcagaaaatgaactgaatccagatgctgaaaaacccagcttctccagatttataaaagctggctaccaaacagcagattctcagaattttaagctcctcaagcagtactattgtatcgattggtttggagtttgtggagggatctatagatttgaaaaatactgccctaaaatcaccaaatcgaatatgccttctgatttgtcatttggattaaacccagattggttttctcactatgatcctagccaatatgctgtattattttcagttttttgttacagattttcggccccatcgtttcacttttgggtggaataagccaaaagatatatttgcaaacgaaaaataatttgtgaaaaaaacttttatgtacgtattcttaatgatctaaaagcaaaggctgaaaaataaacttcgatgaaaaaatctcaaaatcaactccaaatttaagtctgaaaatttaaattttggctgataagcgtaagcataagcataaacgaaaagataaggctgtttaggagttctttacactgatttgtccttgcaatccgtttaagcccagcatcagggcttgcctagcaacagttctagtgctacaaaatacaagcactgaggcaatgagttcttcctatatggcatgtgctataaaaaatactactgagtagaaggcaacatgtccggcgctgcaatcatgtactactcgtgttctgggcgatgaaggttgtgcaggatgtacagggaagccgacgacaagaagatgcagaccgcgtagctgagcaggtccattcccgtggtgatgtgcaccatcttgctcctctcgaacatcttcaccaggagaatcatcacgatgatgtggcccagcttcgttttgagctcatcgagagagctgattctcatccacctcggtctctcctgcagcaacaagaagtgaatggttcagcggctttcagtttcatgacatgtgagcatcagaagttatcaggaaaaaaaaaagtgcagagatggtgagtgcagatttcgacttctcgagtcagttagtttaatcttgaagtttcttctgaatttaatggctgataccttcaaagcaaacatgccaaacaaggatgatcccttgagagcacgatcagatgcaggtacatcaggaaaatcgttgctgatgaacagcccatacagacccatcccaaaaatcagcatgactgttccagcaagatacacatctggccacaaagcagcagttaagttaaagcacattttgcaggtccccctcttccaaaattgataagaggttcgtataattgttagtgttagatttaggtagatatcaagctaaacaatagaggcatctaaacaatattgtgtcagagttcagatgatatcaagcagaactttaattgctcaccgatagcctcgacgagcctgaggaccatctgccctgtatggacacctctaacacagcttgtccagtagacatggtatgcttctttaatgtacacacaaccctgattataagcaaatgacagatgattcaatctgtaatttcagctccaccatttcgtatacaaaaatttgcttgcacagtcacaaggctttacactgaggaagcagaggagggagccggcgacggcgaggagagccaggaaacggaaatcgaatatcagctgcggccaaaaggcaaaacgaaacatcatatcagacgacggcagctgcgtgcacaggaccaacaaaaccatactttcgcgcgtgtgcgtgtgtgtgtacgtacatatgtaccttctcaacggtggactcgaccgcggggccaatgcctccgccgccaccgccgtcccctccggcgaacgcgcgctccagcgacatggcggcggctgccgagccatcggagcccagcggcgattcgcccgtagtagtggccgtattaaccgacgaggcagcgcacgcgactgccacgagccggggcctacgacacggaagcgcggcgcggccaccgcccgtctccgcgcgccgggacaacgctggagcgagccaaccgtgcaccaccgcgagagcagccatcagctcgaatgctgctggtttgcctgccacgagtggagtacggaaacggacgtggtggtgtgacgcgtcggtgtctcccccacccggtgcttttcatcgccctctcgatcatccggccatgcgtgcgggtgcggatggttggtttctcgcgtgcgatcgaaagggagtgcaggaaagacctggaacgggtcggcaaatccccaatacggcatgcaggcccgcgggcctgcgcacgcgaggacgcgcgagtcacgatcccgctgacatggacgtatacagtgagtattgtagggggcaaccggtctctggctcgtatcagatggcctaatcagtaaaagaaaaaaatcaaattttaaattttcaagcttaatgttgaccttgattttgagatattttaacgcaatttcttttttaacattggcttttaagtcaaaaaaaaacatatttataaaagtttcacctacaaattcatttatatttcctaataagtcgttttggcttattaggaaataagccaaacgattgggacctcggtgtctcggaccctcggtgacggtgaggggccgtttgggcccttttcaccggtggtgaactggcgatgatcatcagaaacgggcagtaggtcgttcagtatccagcacacacggtggcatcaggcatgagttgaagtggtagaacaagtaaacatctgggctctggccatctggggagctatcaacagcagctccagcacgtgatggaatgcatacgggtaactggctgtaagcctgtaacggcgacacggcatgcatggctttggggcggtgctgattgctgtcgctgaaggaagaaatggggtgactcgattactcgagggatcttgaggtgcagtttcgtgctgaaaactggtattgcacatgcgccattcatcccatgaagagagctcttgtacatttgatgccgcaatcctgatatgaaaaatccagtaatgcataccatcatatatatgatatgaagttcaatgaaaagccacgtgttatgcaatcattagctgtcaactgaaagttatctttcaaatgaaacaacacatcatgtgagaacaaaaagctcaatacttaaggtgcataaagtatgctcaactgaaaactagaactactcgtgtaatcgatcaatcaactcttccatcctccgaagaactcatgtacataacggtgccacaagcttgctacataatccctgtgatgcataccttaacatgaagttcaatcaggaatatattgtagcattatttttttttgagaatttattgtagcattacatatatgctaaaactgcctactgattgaagttccaagtccttcaaatgaaacagtacgatcatttgtagacataaagtaaaaaaagtttaggtgtatgatcccataatccaattatgctatctagtttgcagtttcgcgaaaagttcctaagtgaaaatactcattccaagtgttgtatgctgactaggtttgcaaagcacacagaaatagttaccttctttctttctctgcggaggagaagaaactggccatcactgttttcagcttcccaccagacaaaggcaatgttggcacagcggcatacctgaatgttttcaactccatctattccgtcctccaagatctgaagaaggatggctacaatgttgagggtcttccagacacagctgacagctgaggccctcatcgaggaggttattcatgataaggaggcccaattcaacagtcccaacctcaatgttgcctatcgcatgaatgtgcgggagtaccagtcactcacttcctatgcctccttgctggaggagaactggggcaagccacctgggaaccttatttctgatggtgaaaaacctacttgtctatgggaaacagtatggcaatgtattcattggagttcagcccacttttggctatgaaggagatccaatgcggcttttgttctcaaaatctgctagccctcaccatggctttgcagcataccacacctttgttgagaagatcttccaggctgatgctgtcactttggtacccatgggtctcttgagttcatgccagggaagcaagttgggatgagtgatgcatgctatcctgacagtctcattggcaacatccccaatatctactgctatgcagcaaacaacccatcagaagcaactgttggcaagcgtagaagctatgcaaacaccataagctacctgacaccaccagctgaaaatgttggtctctacaaagggctcaagcagctttcagagctcatctcttcttaccaatctctcaaggacacaggacgtggtccacagattgtgagctcaatcattagcactgcaaaacagttaatcttgacaaggatgttccctttgcccgaggaacgtatggagcttccaccaaatgagcgtgaccttattgttggaaaggtgtatgccaagatcatggaaatagaatcacgcctcctgccatgcggtttgcatgtgataggtgagccaccaagtgccattgaggctgtggccaccctggtgaacatagcttcccttgattgcccagaggatgaaatatactcactgcccaacatacttgctcagacagtgggcaggaa

SEQ ID NO: 66498 - DNA, 10471 bp, Oryza sativa
agtctcttgacaacaaagtgatttgtcatgtccccactcccaagtcctttgatcttgttgacaagaatcatcatcctatcatacatctcttgtggtgtctccttgtcatccatcacaaatcttccaagccttccttccaataattcaatcttggcctcacgaacggtaggtgatccctcttgagccaattgcaaagtatcccatatctccttggcctcctcaagcccatcaaccttgttgaactcctccagactcaaggcggagagaattgcattggaagcttgagcattgcggtggatgagttgctcttgctccgaagtgagctccatgtcatcattaggtacatcaacacctatacaaaacaactttccaaatacttggatgcaaagagattagatgcaacttcatcttgtgcttccaagcggcgtaatgtgtcccatcaaattgaggagcacgcccagaaggcacggagacaaagttgtgagggggaatggtaagtttgctgtaatcaaaaggtatagtagctcccttgggtgatggagtttccttgctgctcgctccatcttcatttccattttccccgttctttccccctaagtccgacatcgtggatcactcaaagcggtgaagcttgaatcaagagcatatcgctctgataccaattgaacgcgctgatgaagcctagaggggggtgaataggctgtccctgaaaacttaaaaacaaatcgcagcggtaaattccaaacagacccggaacttcctggtaaggaactccggaacttccggcctcccaggcccggaacttccggtgttctaagacaggaatttccgggtaacagaatagagatgaaattcaaatttcgaaacaaaagactaagccaatcttcacaagatggtgcacaggtattctaagcagaggatatatcacagaatcatccatagaaacatcacagaaagagacaagagcaattttttcccgaagttcggatcttgcgatcctactctccgttgaggagctccaaagagctgggtctcgattaaccccttgcctcacttgtgcaaaaaccccagaggaaatccacaaccttcaaccccaaacacccctaggcaaatttctagaattgagtgaccaccaagatccaactcaacatacttctagaaatccaccacaagtgtgggttgctctacttgaaaagcctctagaatctcagcacaagaacttcactaacttacctcgttccctttcggaggagaggaaatccttcacaaacttacacgggacatccacaatatgtaacggattctcgcgggcgatacctaaccgtctaggagatcatctccaagagtaataagcaccgagatgacagcccacgagatattccaagtgctcacccaagatcctagtcttcacacatctccaaatcttcttctctccctctcaatctctctttctcacaagaattaggctctagattgagtggagaaggcaagaaacacttgggagaggctagcaatagctctaggtttgaaaagtgaaagtggaatggccatggaacgagctggaaacgagctgtatatgtataacggctaggtgacgtcatctagccgttactcacaaatttgaactggaaactagacaggaagttccggacctagaagaccggaacttccggactacacttaggaaaatctttttcacaagaccggaacttccggacctggaagacaggaagttccggacttgcatttttggacagatggagtatttgcaaaaaagactcctagggaaacttgacacttggttcacactaagagcacttgatatatctcagagcatcacatggaacccctcttaatagtacggtttttcctaaaaactcgatttcaaaagataaactatcctatacacttctcgagttccggtccgctttgattttgtactttttgggggtctccaagcatccatcttccacaccttggactaatgcacctgaaagtcactcaatgaactcattagtcccttaaccacatttgtcattaatcactaaaacccactagggggattaatgcactttcagatgagatcaactagcgacttggccttgtcgagatgaacccgacgagatcagctagcgacttggtctcgagttctccggattgcttctactatggctggtgttgagattatgattcgatgatcccataccctctgagggtcttatatctatacccttggcttccaagtagaactctgagaataccttatttgtacgagatcacagagttcactcgctctcggagtaggattctaacacctggggggacggcttcctggtagattgtgggcccccggttttacacaccggaaaccccatgtgtcttacaataccattccctggatcactagatggtacacacatagcatagttgtatatcacaagctgacatcgttatataggttgaactatacattaataataatacaaggatagcccaaatgggacccaaatagaccgagcatggtcatatacaatacaaaataccagaagaagtagatgagatagcggaagcgaagcagcggcagtccaacgtactccacaggcatcgactggtgaacctaggtcccgactccaccatcttcgacatctcttcatcagcattgtttccgaacagtcgactccaagtcctttctaaaagatttagttaagcaagggtgagtaccaaccgtactcagcaagccaccactacaggatgcatttagtgcacacaggggttcaaggatggcttggtttatttgcataaagctagatttcacaaatcatttcacaaacctatgacctagcagttttaactgaaaacaacgttaagtggaagttgtcattaatccgcgagggtttatccaccttccccaagcctcgcttggtccggtttaccctcgcatccaattttccacacttccaacatcaacatgaccttcccgcccatcgggcaaggtcacaccactttcctcatctaagcaagattaaaatctatgagactagtcaagtgtagtacaagtcccggtgctcaataaccgcgagcacggttattcgaatagatttgatttactcacactgcagtggatgtacgcttttaatcccgcactccgcggcttgcccaacacatgagcctagtcccaacacacgagacttgccacggcccggtttttcagtcattctcgcgtttcggcactcgctccaaggactatggatccccattgcactcccggcacaacacaccacctcgagccggcagtgaggagagtcctggcgctcccgggatcacaatgggttatattacatataggttaggtgtgttttaagttttgccggccttaaccaaacgatcgatccactcgatccttcacctccatcacgtcaccacttcagaaccaccatgacaggggtgccaccccacgagaattcacttagtccaccgggtctatacccactcgagaagtgcggtcgtactctgatcgtttcctgcatagcttcttgactcagtccttaactgaccagggtcggcgactagccgtttccagaaccacccatattctatccatgccgccccagtcgaaaacattttgtttaattaggtttttggttttcgcaaaggtttttactgcgggtggcgctcatgtctccacccgccttctggcaatcactctcgacgagtgaccgctaccaacacatccatacccaactattatggagtgtacaatcttctataattataagcaatactaagcaatgtcaataattgaccacgcataattaatagactcaggcaacaaggatataataaaggtaacaatatcaaggaggggtaggtacgcattttataattagcatgcaactttatttataaacaaaacatttataaactgggttcaatatgttcaaggaggggagcgtagtgacttgccttgcttttagaaaccgatatcttcgagaaatccacgatcgacgaataaccggaatacccgatacgcggttagcacgagaaaaccatataaaatcctctaaataaagtaccaaacattagtgccattggatagatcccgattttagaaaaattccgaaagttgaacggaatcaatcggagtcacggttgaaaagatatgaattcccgaagattagatgatttataaatcgagggggaaggaatacccaaaataggatccctttattttgaggaaatatccccatggttgccctctggataggaggaggtagaaaggacttatccttgggtgagcttgggcttcaacccaaggatacaggaggtctaatagggaggtattatggactttcagagaggaacttgggttctggagggatgtaaaatagacttttcgtaggaaggagtttctgggcttggataaggaagtaggggaggagaaatagactttttggcagcagtcaaggtcacgagatggagtcagcacagtgggctccactggtaggtcccacgacatttactttttccctttttatttctttctctctcgattcttcctcttctctttctctctctctcgttcccttctctgatttctcctcctccacgcgagttccagagaagaaggtgcctgcggcggtgccgggcgcagcggttgcctggcgcggggcggcgcgccggggaggaagggagtagcgccggctgggaagaggaggccggggcgccagcggctcgggccgggtggcgcggcaagaggcggcacggcggcgctcggtgcggcggctttcggcgctcggtgcgcgacgtcacggccggcgtccgggcgcggtggcgcggaggagaggaggaggtagcggtgctgggagcagaggaggtggtggtggatgggggatggttcgcgcggcgacgacagaggtcgtcggggtggcgttctacccggagcggcggcgcgtgcaccgcgcggtgacggcgcggcgcggccgagcgcagcgcgcgagaggtcggcggccgaaaggaggtagcctcgtggcgggcgacgctcgtcccgatgcggcgatggcccggatcgaggcggtgatagcgacgaaggttgtggtggctcccttgttgggcggaggcaggggtggccgcaggaggtgcctgcgcggtcgtcgtggccgtgcgcggcaacttcaacagcagcgatcgagcgcggcgacggcctcgatgggtgcccgtccaggtggagatggaggcgggtggcagagaggggaaaaggggtggctggctgtggtggggagaaaacagcacgaagagaaggctgctcctggcgatggttttgcttgtaatgccaatggcttcgaggagaatgatcggcacagtggtggaagggcgatgtggcgcgcgtccataggttggacggcggcggcgcgggcccgggtgtcgacatcgacacagtggaggggaggtgcgaggcgggcggcgtgaacgcagctcacgcggacgctcgtctgcggccgatggagagcgaggatgcaaggcgtggacgaggagtagcgacgctcacgcgggcgacgtcctgggaggcggcgaagtgaccatcggtcacaaggcttccttggagcacgtgtcgtcggcggatgggttggacggcgataatgtgagccccgagtgtcgacatcgctacaagaaggaggcttacaaggtaagcttcgctgtaaactagctctccaattcggtgtgagctccgctctttctttcggcgtgaaccatcctcactgtgtcttcggtgtttgggggaggacttggtgaactgggagtttgcagatgaagagagacggacgtcctcatccagggaatgccagggcatggcttcggtgcacggcggggtgcgtgcgacgcacggggagggcgtgcctgcgaccggcgcggcgcacggccggggtttggtggctcggtgcaggagcgcaatgcggcgtggcacggctcgacgcgacgcggcgcacgcaatgaggaggagcagcgcggcacgacgcggtggctcgggggcctggtgcgccagccttgcccgactcggcattttgccgagcacgtggcgggcggcgtgtcagcctgctggcggaggcaaggaaggagggggagtagacttggctgcaagatggagggagagctggagagggagtaaagacagacttgtgctggggggtgagttgggctgaccggaaaaggaggcccaacagaatggggactttttgtatttgtaaggattggaattgggaagaattttgtatttagaatttgtagatgaactgtatatttggacatttggtttggctctgggttgaaaccttgaattgtggtttggagctgtaaatggaatgtttaatttgggtaattggattggattcaattcagccgttcaatcgcccaagtatttaacttaggttttgtcacatcctgattttcgtttcaggatttataaattatttaataaattattaatagaatttatattaaatgatctttaatttacaagtgaagttaaatgtgggaaataaaatttccttaatataaagcatggatggatttaatttttattaaattctccatgattaagtcaactctctgaaattttctcggatttttcagctctcaattcctaaatgatacaaagaacagttcagtaattatttgatcaataatgatctaattataattgttaagagcttttcttgtttaaaatccttaaattataaattgttgtttaaaaggaattattagaaatgattttaaaagcctaaaagagaagatctaattttaatttgttaaatctcaatataaaatggggccagataaaatttcattaaatactttgcttaattctataattcctagatttttctaggatttatttgagctaaggaagtatttttaatcaatggaattgcatttcatgaataattttaattgaaaaaggttttaaaagtcttcttttggctttgggccgaaagccggcccaaaacctctctctttccttttcttcctccccggccagtcggcccaagtcggcccagtccgcgccgccgctctcttctctctctcagtcgctgacaggtagggcccatctgtcggagccgtcttcctcgcgccgccgccgccgcccgaaaccctagccgagcgccgccgccgtctccttccaaaattcggtcgaccctttccttctccggccgaattgatagaggggaaacgatcctctcgatctcctcttccttttctcttttggaagcatcggctaattcggtttggaaactcgtggattcgaagtcgaatcggatccatctctctcctccgaaccccgttctttcctttccgtcgccggcagccgtgggccttcgccgtcaccctccaacccctttaaaaggacccccgagctctcctctacccgccgccaccttcgccttcgcctctcgtcgcccgtagcgctctagcgccgtgtgccctagcgccgccgtcgccgccgtcgttccagccgtgcgccgccgccgttccagtcatcgtcgtcgctcggggagatcgccgtcgtggtcgccaagtcgccgccgtcctcgtccgcctcttcgtcgccgccgaagaccgccggagcaccgtcgccgccgtcgacccgatctccgccgccgcttcttcctcgtcgccagcgtcgtccgttgcttctccgccgcttctttggttaccggtgagttcgccgcgtcgccctctacccgttggtgccctccgttcgcgtcgccgcgccgtcgttcgccggcgagcatgcgcgtccgagccgccgccgccggtggtgacgtcatcgccgacgtcatcgtccccatctcccgtgagccggtcgtggaccgttcgatctcggccgtccgttttggataggatcgatctcggccgtccgttcccgtgaaccgctgccgtgcacccggtccaccgcaaaccctagccgctgacgcaataatcctccttttccttttcaaaaataattcattattgcgtcataattcaattaaaatccatataagtgttttaatccgatttaatctttaaaaattcataactaattcatcttagctcagtttaatgtggttcaagttgcaaaaattatataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaatcatgatctacatgtttgtttactttttatgtattgtttatttgatttttattagtctttttcttcgttttgcgtgttagcttgtcgtttccgtcgttgcgaaggttcgcgagtgcgtcggaagtattcaagaagattaattgaagaccgattattgcaaggcaagtcacacagatcctaaacacaatcctttgagcatgttgatcctatatttaaattctctatttatttcaactgtgcatttattttcaaatgtcactgggtggtgtgaatctattcctttgttatggcctgtttgcattgattactttaatccttgataccttgggttattataacttgactagttgagctttatatattggttcagctagatattagatgtgattgcttagccatgcttagaaacattagcacactattgggataacatatgattcattattatttaatgatggtttaatgatggttcacgatggttaatcgtgatcggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactgagaagtggcggagataagcccacgggggtcactggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctcccacaataattatggatgttatacctggtaataatttgcttagctcctggtttggagttagatctgtacagccgggtatggttgttcaggatggttgggcctgtgcagcatgggtgtgctgttcagtgttgattaaaatttctgattaactactccactgttttatttcacttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggacttagtgcctcttaagtaagtatttatcgttttagttaatttgatgaatctgtatattaaattgtcaatttgtgtacctcggctgattcctggacgaggatttcatgcacaaataagttcggaaattactagtgaattttcgggcgtgacatttattaatgtgccaattaaaacttgataatggtgggttgtgggcacatggttttgatggtcgtgctcatgacaattaaggaccggttcacgagtttcggttgtgaaccattaaccgtaccaaccacaagccagagtaggcaacggctggacactttgtataacaaggctcattgtggtgtgccagactgagaagtggcggagataagcccacgggggtcgctggggagtccatgccttgttttataagggggtgattatgatccaggaacggtgcactgctttgagttgagttatgcgaggggtcttgtcacaatcactcgccatggtgacgtgtctgcgcggacacggtgacatgacggtgggttgtgtcttgtgggtacagtggtacacctctggccagagtaaaactattcgaatagccatgcccgcggttatgggcgggtcgaacaatgtctttcgtgattagtcccacaccacttattaataataatgtgataattgatggtaattaatttagcttctggtttggaatgtgtcggtgacatgggaccgggagtatcatgactagaggcttgagcaggagcaatcacccacgtggcctgaccccctcgggggggggtcgggcc

SEQ ID NO: 66499 - DNA, 9682 bp, Oryza sativa
  unsure (1)..(9682): unsure at all n locations
actgtcgtggtggattgaaattcagaggccagggaaattaaagatggaaagaggaagaagaagaagagagtgtgtacccaatgacatgtctgccaccgtcgtagacggcctgggagacgaggcccatgaggccaatgctgccgccgccgtacacaaggtcaatgccctcgcgacctgcacggaaacaacaactcctcatcatcatcgtgcagtgcagcagcaaattcgttgcagaggcaacaatggggcagcgttctcctgttcccataaaacttggggatacacatgcagacaggagatgcagaggaacgcatgggcgttgccattttctgacatgacaaaatctctgtacatgctgctgtacttgtcttgatacgtactagtactcctttgcagaacagaacgtagacctgtccctctgtttcctttttctttcgatgaaggaaaaaaaacaaagggaggcacgcgaaatactataaacgtctgaatttcactgtcgaatacaaccagtaccattgtagtgtttcttactgtaccaccgaactggatattgttcgaacacgttgccacaatatagtctcttgattagtagtgcatacttctcccccgtcctataatataagagattttgaaagggtgtgacatattctagtacggtaaatctagacatagagcctatctagatccattgtgaatatgtcaaatccctttaaaatttcttatattatgggacagatagagtagttttcaaaaaaaaaagtgatgatggatgtaaagcagccatgtagtccaattgaatagaaaaggggacgagggtatcgtgtcgatctattggaagcaggtttccttatccaatatggatggggttaccactacctggcagtaaccgaataaaaacggatgaaaccgaataagttttaccaactcttaaaactttgttgatatgttgagctgttcccgttacagtatccgttagtaagtggtaaccgatagtttgtagttaactagtacaatatactccctccgtttaaggttataagacgttttgactttggtcaaagtaaaattgcattaagtttgatcaagtttgtataaaaaaagtagtaacattttcaatccaagataaatttgttataaaaatatattcaattattgatttgatgaaactaatttagtattataaatattactatatttgtctataactttagtcaaacttgaaacaatttgactttgatcaaagtcaaaacatcttataacctgaaacggagagtatctttttagacaatgaatagataaaattcggcctctacacaggcgtggatctttaattttgattttgataacacaatatatattgtgattatatatatgcaggtgaaagatagcctgttttgccagcgcatatatatgatcacaatttattaaagatccacgcctatattaattaattataaacctttgcttcctgctttgaggtgtaattatggaaaggaaccgcaatctaaacaaaactaaagagagagattcatgatatgctgttaaacatagatgcatgctatgagagagtgtagttgtgtaccagctctttggcgaggtcgacggcggcatcgcggtaggtggtcttgttgccctggctactgccgcagaacacgcaggtcctcttgaacctgctctcctgctgctgctgctgctgctgcctcattctcctctaattgatctacctttgtaaactgcagacaatgcagcacccagagctagcttaagttttgctctctttgtgtttgtgtttgggtgcgccatggctggctggtttatataaagaaaggatgtctggggccgggcgacctatcttgcaacagcgctagctgcctgaatggagaatggacagtaacagtgtagtgctagctagcttgtgcttgatgatgaaacacacgtcccattcgcctctgctgctcgttgcctgttggtaccatagccttgctagccacctcatttatcttattattatcatactactgatagcgagcaacagtgttctaaaagaaaacatccatgcaggtaaattaaatacaacaacttgacgcctaattagcaacaagctacgtaagtagtggtgttcaccttttcattcttgtagttaaatactactagcatctacttgtttgttttggtcagctgatctgatcttatcatttttgttttgtttggcaagaataaggataggaacactgaaacatgtgcttgatatgggcaaccctttgacctgataacagtaggaacagatgattatttgttactgttataatttctggtcttccatccccacctctctggcgttgatacgtacatatggtttcctcctgtctttaccaaacaagctggcaggcacgctcttaattcgccggtacagtgacctcatccacagctctccagatcgactgttttgctctctctgctggggcctctctagaaagcgagtacataacgtgcaggtaaacagtttgttaatgtttcaagaattaatatccatgttaattagtgtatgtacgtgttggggctatcttagctagtgcgaatatagctagccaaatgatatctaagttgaaggaaaaaggatgagagctaaagagcaaacaaccctatgatatctacgacgtactttccccccagcctttggttactcacagttttatgtgtatgcatcaggatccaggaaatcgaacctcaaatcgagctttgtccctcgctttatatctagccccatgataagagattgtatgttgtgtctgctacgacaacctagcttttatatatatatatatatatatatatatacatacataccttaattagctcttaataattcgtttagcagagttgcatgcatgaattgaaatttagacaacaaattataatactagaaaagttgaaggtcttcaattaccataagaaacacgtgtgatggtattttcattttataaagaaattatgcatgtatactggtcaagtgagtgacagagatgcatggcaggtactagctaggtacatatatacatgacattgggcaagcaaagcatatatacgcgttgagagttgggtgagagtggtagtggcgaccccggtgggcaagggcaaaggatcgatcgacagatgtgtttttcctacagaaaccgcaacaaggcgacacaagtaattggtggtcgtcgcaaaagcgaagccgacgcgacaactccatcatgcatgcattgcctgcctgcctccttccttctcatctgcccatttccaattaaccaacggatcgccgccgcgttaacactgcaccatccatcagttactcctagtaattaactcttcaaattatataaattttcatctaaattcgactctatatagttatagattaaaagatagactacaaagtaaaagctgaaaaaatatctttttctaagactcatatctcagtttgtaattactaaaaagaaatctgtttctaaaatctcaagctccctaaagaatgccagagcatagcagcagcaacacaggacaggggcagagtggaggaggatgcgtatacggaattggatggtgtggcctactcctgcatgcatggatgatcttatccaacacccaggaaaaggtcgaaagctaaattagctaatggcgtttaatataattttttatctttttggttgattttgtaccgagtcaaacaatataatgacgtttctcccgagcaggttggggctgggaccaacgggaggtcgccacgtggatcccgcaggcgagccttttgcacgcactcacagagtgcagtccatttccaagggctttcggtcaaatctgtgtcgaggtctagctatggctgttgagctcgtgtgttttgtacgcctcatacagtgccacgacaggagcttttatcttgctatcgatcgtgctaccgctgcccaatcgatggctccatttgtctggctgaaaactcaattcattcagagataaattaatggagcactcatgtattattatgcacgcatcctttttagtcgtcagtgaccaaagatgaattgctaggtagctgagcctgagctgccttggggtttcaagtttcaactgctgcaggctggagcacactaaaaacatggatggatgcgagcagcggaccaaccactcgatcgagaggtagagctgtcgagtgccgagtgcgaggaggagcaaagcagataagaaaagaagagataaaccggtgatagggcaggggtgagtgcggggatttttttttctttttgaactttcttgtttttaaattttaaaaataaacccttcaaaaacttatttctagaatttgaatcttttggcaacgccaacttgcctagcgtactaaaataatattgacacgccacacacaacggacataacagggcatggccaaataacgctgtcaacgtgcgaaagagcctgtagcctagtggttacaagagcctcagtagcaccttaggtcctgggtttgactcccaatgagagcaaatttttcaggatttaatggctttgtgctttcagtggtacgcgacgtactcgtcgacaacgatgcgtctgtgttgacttcgtcaatctccagaatggatttgccggcctattcttcgaagatgctcatagagttaaggtttacgtgcgtgcgctcatacgggtgagtgtgcgtgcgttgtgagtgtctacgttgtactgtgtaattttaaaaaaaaacgctgtcaacgtgacgtgatcaggtaacgttggcatgccagccagatcagctcaaacaggtcttgaaaataaattttggaagtgtttatttttaaaattaaaaatttaaatatttcaaaataaaaaaaaatcgagtgcggattgagtggggtcgtgaagggcatgtcaacaggcaggcaggcaggcaggagagatatgatccaaaatgccatgccattgcatgcttgcagttgcaggtgtaatattgcagccccggcaggggagggacagaaagcgagggatcgagcctgcagcgctgccgctgtcgccgcctttggccgtggcatcatttcaattttctcgccgccggcggttgcgtaggcaggcagctcgagtgttggactctgctggagtgtcctccgattcactccccacccattccgactcagcagctcaccggtcggtgccatagatcaatacgatgattgatgagccaccaatggactaggagattcatggccgatgattttctaaccctatccaatgcacgctccaaaaacgtccaacaaatcgatctaacatcactaaaagttaacctacacaatctttcttttaaaaaatagattaaaacccagcctctacatctaaatttgaaattagtcttccagtgttttagtttttttttttgttcttttgtggtgttttttgttttctcacttatgagacttggaatctagtattcctgtaaactttagttgtatgtcacttgtagatatagaggctagatttctatccattttctaaagaagatgttatatactccctccgtcccacaatataaaggattttgagtttttgtttgcaacgtttgaccactcgtcttattcaattttttttacaaatataaaaaacaaaaagttatgcttaaagtactgtatataataaaataagtcacaaataaaataaataataatttcaaatttttttgaataagacgagtgatcaaatgttgcaagaaaanactcaaaatcccttatattatgagacggagggagtataatctaaactctcgacagtgcctacgaactattgggcatgcagacaaagaaccacaaaagataacatttaaagttcagcaaaagtatatgtgcatatcttattttattgaattacacatactaattgttaaccccgtacatattgtccgtactattgttactaatatcagaaatattaaaattttaatcatatatagaaatttgatggaattaagagagatccattgggcttctcagaggaaaaataaaaaagaggtttggattcgtggaaaatttttttcgcaaacgcgtaaaatgattgcacgtcaatatattagaagaaaaagagttttagttacacgacgtaatcagctagactgtcttatgctaggggaaggaagaaaaagcaaaagaagaaaaaactgaagcttagagaaattacggcggctaaaaacagactccaagcagcgagaaggactcatggaaaaatttcctatggaattggtgcaatggatagcaattcataggagtatgatatgctcaaatcccttttttttcaaacaacaaaaggaaaaattcctaaggcttagaatcctttgaaaaatctttgaatttccttcaatcaaaggaacctccaatctaaatcattataacatgatttacttaaatcattagtcagatgtttctaatacacgtgtaagttttctcaaagtgctcgattagagtatatatgttggcacaccgtttcaatgaaccacatcattatttataaagaatccagtgaaatacatatgtatcgattaacgtaaaatgctggcaccaaatcaacttgataaaaattcaattttttttagagtaagtcataaaaaaccataccttagttccaacttaaaaaaatcgaagttacagtgcacacttttttttttaaaaaaaaaggggttgtcacgggtacatgtaagcataaaaagcccaagcctggtcagaccaacaggcttaacaggccagacccatgccaattcaacacaaataaaaccgtactcaagtaggaataaacttagagattttctatcctatcccacattattctctagctattttagcaacacaatatttccatggtagtgtcaataacccgctattgctattgcgagtgcaatagcgtcactatcacctctagtaggaataaactagagagacgttctctattttatcccatattattctctagctattttagcagcacaatattctcgtggtagtgtcaataccctgttaccattgttgcaataacaatagtggcctatcaccactattttgtatcaagttgaggatgatattatatccatcacattattatcccaacagttttgggctacttgccgccaacaggaattacaactagtcgtcaacaattgtgaacaaataacccagatatcactaatcgtcggatattattgtcttacgtaggcaatttacttaccatagaggcttgggttatatatatggttctagttggcattgatgacgttgtcactgatagttcgctgacggcctgaccaccgtctatttcatgttttgatgaattatggatgcatcaacgcaccacagcactcacagcttcattggtaccggtccgtcacctctacacaaggttagatgacactgacatcccaacgcaactctctatcctatctgctatcgagtatcaacgcactgtcactccatgggcctagagtcgggggaacaacgatctcttctacagttctactgttctacatcttttagtgcaactatgagtgaaataaattctagcaggggaaaaaaaagagagaactcccatgctctaaacaaggcttgaatgttgaatatggcacagcaatagtactatttaattagcaaacaagtataagttctgtttagggatgagcgtgagtaccctgtcccagcctaaccgtgttgattcctaatcttgctcataatttaccccaccaatctctaccatctttccatcgagtaacaaccattagacagtggtaaacattgttaccaggtacatcttgggatttaacgacagtcgtcaattcgtcattcaaaaaacttgccaatgcttaattaaagggatgcacgatccaatacgtcgtatttgcacagtaagtaccaaaagtcgtgaccatcttcatgaaaaagagattgggagggtgacagcggttaggggtcatatgatctgagaaaaatacctggaatttcccggttgcagacgatgcacgtgttcacagtaacgttctgagcctgtctgcttctgcatctgggattttcgcagggataatatagcatcctcatgttgatgatagctccatgaggttcaagtaaagttggttgctggcgtgtccaagatgcattggaaaccgtatgcacaaacctgacatgcatatcagaatatcaacaaccatcgtgctaaatctgatcctgaacatttaacagagtcaaactgccgatcgactggcttaacgtttttgccgtatgtaaagtaacagacatactcgtgccagcgtatctggctatcaggttcatgtattctacatactttggaagctggcgaatgctattctaacgatgcatccttactggaaacgtaaggatgctgcccttgttgcacttaataattcataatctcattcgtggtattcatgatccggcaattctagaagaaattcaaaatactgcacgtgcaggaaagacatcctaactaacttctctatatatgatagaatggtgttcagaaaagtctggatctcacaaagcaccagcaactcagcgagaagcaatgcatggacgactagatcaacgcatatagagtaagagtagtaactagcacagaatgcatccatccacccacaatattccagttttaacagcatcaactgaatcctgtaggacaagatcaatttgtttgataaaatctattccgaccttttactatagataggaatagccacaagtttgttgtttgtgtcaaaaatttcaaatggtgctgttaacatggtcgaatggctgcacttgaggtttggctgtagtgctgtacaaatcatatttcaccaagttcgagcccattattagttggaataactagtttttctccttgagattaggtgagtgtgcatatgcagggattccctacgcatattttcaaatttctccattaaagtcaaattcagggtcttacatgttttttttttttaaaaaaaatggattcacagctattttaatgataagaggaagaggaagaggggaggggattgccagcagtactctttttcccagaagaatatgtgataacagaacgtgcacaagaaacaacagtccattctgagtaaatatgtccccaccagtgccactgcaaaaaggtcagaatatattagcctcacattgtgcatcatcacgggattacatcagaaaagtaattgtgtgccaacgttagcattctactattgtttgacctcatttgagctatatgaacaaagtaatagcttgcatttaaagtcaaagtatcaaatgacatatgaactgattttactcgaacaggcacctctggttagaacaatataggtcaagactctaaccttgataatagggagcgcaccttgaactaaatttttcttaacaccattaaggtcttcatgtgcagaacgacaggctggtctgaacccgtcataactctaattcccctagcaatcatggataccacatatgcatggccaatttggtctgttcaagagaagaataaatcacttcctaatgcctgttaaaggaacaacattaaatttagcctttacccaacggtatgcacatggaaagttctttagataaacagtagttacgacagcacatttgtgtttgttttttcacgtacgcgcaaaagccttgca

SEQ ID NO: 66500 - DNA, 2179 bp, Oryza sativa
ctttaaattaaataaaaaaatatataaaaacacttatccgcttcccgtccctaataggagtactaacaaacagctgtactgtcctatcctatatatttaatgtattactgctatattattaattactagaaaattacccgtgcgttgcaacgggtaaatacgttttcttagtgattgaaacattgcgatcactatactttatgattaaaaaatttaatgaaaatcctaacactgagattgctatccattataattaaaaatttaatgaaaatcattccttcgttttaaaccgaaaactcactcgttccttcctttaaatccctaggccattatgtaacctccactcaggctgcctcactttgaaccagccaacaagtagagccgcaggctcagaagattattgtctttaacctcccaaagatagaccaatgcccatacgacgtcggagcagatctttcccatcaaatctgactgaattttgctcgatctcccaaaattggttgagggctttcaatccactcgatctactctttccgtcttccaaaatcagaggtaaaactcacgataaaaacaaccggggaagatcgcctatagtcggagattaaatctggtaaattaaaagtcgcatcaaaaggggaaatcatgtagaaaatgatgagagaagagcggggaatcgattttttaatcaattagagtagataatgcgcaatcgacatgaaggcggcatggcgctagggttcggcccgggcagcggcaggaggtgcgcggatggcgcggtggaatagatcggggaataaaacggccaaaaaaaacccagacggaaactgaaaaaaaaatggaccaaaaaaaaccagacggaaattgaaaaataaatggacaaaataaagcggtgcaatagatatcagttgggatcgggataaaaaagctgcaacaaaagaaatgatagaaaccgaaataaaacaaacagaccgaaataaacagaagctgtgattgtggcgtgttcgcgagtcggacaatgcgcgggagtagataaaaaaaattaaaaacctaactcgatacctaatccaacatggatgacgtactaaaattctggcaaaaatatctttaatttttataatagtaaagataaaaaaaaactcgtggaaataaattatatacttgctcactgatatattagtacaattttttttatactagaaaaaatgcccgtgcgttgcaacagttaaaaacattttccagtggtacaaccgctattagaaactgagctatattagtaagttgtttggattcaagggttattttgagagctatttgacctttaatgtatctttccatggagagatatagagaaaagatatttttttagcgggcctacccaaaatagccccaattagcacctcttgggtgggatattttttgggtgggttatttccaaatagccctcaaataactcatccttttggttctttttgggttatttgggctatttgagggagggctagccattatgtagtcctagtatactctctccgtccaaaaaacccaacctataatgaaatgagatatatttagcacaatgtgtcaacctcgttgtattagaatatgtcacatcacatcttaagttttttttactgagggagtaattagtagtagtactccatatttgttttgttattattcttttgtgagagagaattaaattgctactagaaacgaagagggagacgggtaagatgggccgtgctgagcctgggcctgtggcagagagagggagagagatatatgcgtcagatggaaccctaactgaaaatccgaaatccatccatgtccaagtcgatgtcgttcgccggaacaaggatgatggccgcggcggcccggcgcgccgtccactcccagcctccgtccggccccctcaccgacatcgcggaagaatcgcaggttgagatcgtctgtttgtttggttggttttggggatcgatcgatctttggttgctgctcatcagttgattaattgaattgatcgctaggtgatcagctccctttatgaggtggcaaaggcgaagaatctttcccgggtgccacggcagttggatccttcgacgcgggtgcacatcgctctagatatcgagcacaaaatcagcatgatcaggatcggtgctagtccttccgaaccgcaagg

SEQ ID NO: 66501 - DNA, 12031 bp, Oryza sativa
tccgactctatcagatgactacaacgttgatgtacgcgccgtcagcagcgtgcagtacgaatcctcacgccgtctcgcaatgtgttgctacgttgttttggtcgtacgccggttggatggatgggtcgtacgtatagcatgattcttttaatatataacactattaacttttagacatgataagatgagtaatcaaatatatgctcatatttaaaagtcaaatagccttgtatatttttttaaaaaagaggaaacatgcttttgttcaaattaattgtactagaaaacatcacatcttatgctaggttgattttttatgagacggagagagtaatactgtttatcctatacaagttgctgacaacgatacaaagacaaaggtagtgataaataccaaactagcgatatggggtccttatgcttgcaattgctgctagcatcgcagcgaaggatccaaatcactgaccaattcaaacagtacgttcttactgtagcaacagggtgttgatgctggcatgttgctgtgagacaaagctgtactttgctcattctactgtaccagttcaatctaagccgttgatcatctcatgtcctggacggtagagaatgttcccccaatgcaccatttactgttggcctactccctccgtcccataatataagggattttaagtttttacttgcactgtttgatcattcatcttattcaaaaaaattttagaattattatttattttctttgtgacttactttattatctaaaatactttaagcacaacttttcgttttttatatttgcacaatttttttttgaataagacgagtggtcaaatattgtaagccaaaactcaaaatcccttatattatgggacggagggagtatatatgttgtcatggaatggggatcacattcatggatttgtttgatttgtatcaatcatgcatgagatgacttgtcacggtcgtacgtgcaaatgtgtaatggagaatcatattagatcacctttagtacacacacaggaatttaagtgccatgtacttagaatccctatggtttttaaaagggcaagaaagtttcgtaattgtttctctgatggcactagtcatatgtccatacgttgcaacaggattttcagaacgtgatttaatttgatatgagaaacatggttcaattttttccaccctatttttttttcggttggtttcagtttgtcttttcactggtttttttttaatatgtaggataggaggagggaaggggagaaggacaactgcttttacctagtagagaaaggattgaagcacttacactacaaagagataacatgtggtaaaacttcaaaaatttaattcccttgcaagttcctattctctatttttgaggagtcctaaacattgtaatccattgtatggaccaactattactaaagaaagacaattggacttacttttttctatgagaagtcatgtatttcgaggaaaaaacaagccattctgacatttttgagttggcaagagaaaagttatatcctcaatgattgggtctctacttctataaataaacaagtagtagtagtagtaacttcttttgagtcaaaccatcaaaaggttccagctcccactgaattgccaaatctttttcttataaaaatgccccaaaaacatgagtgttccacctgttaagcttttttacttgctaatgtcggatcgatttatttacagaaaagatttttttatgtatattttggaaacgtgacacgaataatccgtttagaacaaggccttgccactttgtgcaactgtacaatcagccatcatgtccttccaaaatttttatcggtgttgcatcctacatatatagattctgctcgatttcattcgtgctagtttcagttagcaccatgataactagatgatgcctcatacgcgttgctgcgtgacttggttaacatcaatttgttagataggaggtacaatctcaagaagaaacagaagaaacaaatagctttcttggaaaaattctttttagcatctctatccaaaatttgtagataatttaggtagcacatgtcaactaaaggggcgtttagccataaagctcttttatacggattgacgggctggatacatgtaaatgtatgtggagatgggccaatgtgttcatgtgggctacatttggcactgaggaggcaaagagacttactcggtgactaatgggttgggcttatatgctggattccatctaacgtctgagaagcgatctaacgcattcatccaacggttcacaatttgatgatgacatggacagtggcgtagctaggaatttttcgttggatagtcctatttcccatgacgggggataaaaaaaatttaggtgtgaccaagtacccagtagatagaaaaagaatgatgaaaaacaagttatactacaatatttacaaaatttgtccatagtcgtgccaacttatactacaattttaatatcaccatactatctaatatgcatttacaaaatttgttaaagaccgcctaattcaaataaaccatcaaaacataaacaccatgacagaaaaaaaagacagctagctctaatctaatcgtataaacaaactcaaaacttgacaaaaatgcaataacaaatatataacactctagagttgtcaggctaactaacaagtttaagaagcatgatatatcagtaagtatagttcgttttgcaaatgatccatgaattgtaaagactgaataagagcaaatcaatttaagagtataaatctcaaaggtaaatacgaaatgctttagcaaactttgtggccaaagaaatttattttgatagtggggattaaggtctctaggctagaatctagggtagtcctgtgcccatatagaccaccagctagctacgcccctgaacgtggaagcacgaggtttgagcttttggccttaacttcatagtaaagaaagaagagattacatactctagatatcccacatgcctatgtttgaattgttggaatctactaaaaggcatacctagtaactaaaataaatatttcccccatcccaaaatataaaacttttagccatcaggatttgtcccaaaatatactccctccgtcccaaaatataagcatttttggatctgaacacggtctccaagatgctattttgatcaacaatatctacaaaagtaaaatgtcttgaataaaaaagttgcatattatgatagttcgtttaatgataaatatagtaacatcaaatttacatgattaatctttttaaatttttcactattaatagtcaaaatttaaaaagtttgacttggcactattttaaaaatacttatattttgggatggcgggagtaacaacttttccgccaacattcccttcccaaccaatcacaaccctcaaccattcactttttccacctacctccactactcatccaaatacaaccctacaccatttacttctacctactttcttaataaccgtgtttaattctaaaacttcttatattttgggataaaggttgtacttgttaaacactctctagcttactactactatcaactactgctgctgctggagtactactacacccatgctcaatgtgtagcaactcaatgtgtctagaatcttatcacatcaagctaactacacccatgagaaacaatgcagaggcagccaagacaatctgtagcattctcttcctttttgtgaaaaccagtgctgaacatctcattcagtcatctttactctttaccagaaagtagcagtactacatgcacaacagcatgcacagagtaaggcagattccatctttccaagcaacatcaaacatctttggcagaaagccatcagaaaaaaagcaatccctgaatcatctgttgggctctgcataactgcattgctgctgttgctgttgctgtcacacacatcctccctccaaaaaccattcaattgctcatgctgctgctcctgcacatgcctgtctatggattccagcttcccttttgcttttcaatcacactaacaatgcaacagcaatcctttcttttttgttactacaaaatttttgattggttggtccaactccagtgcaacaccttgcagcttatgttgctgttaggcaggtcagatgcgtgaacattcttcctagggtggtgtatcactgtatcctacagcctttgtccctttttaacactggttgtatatagtaattagttgcctgtcatttgggataaacagtgcacactattaagtaatcagcacatcatcactgcataattattgccatctgatctgaagcttcaggggaaccatatccctgaatttcccaacagctgcagatttcaagtaggtactctagattaggatgctacatcctactacaccctagctacacaacctttgtccctcaactttggctctatggccctgtttagtacacactaaacttcccccaaacttccaactttccatcacatcagatcatatccaaaactttcctactcacataaactcctaactttttttttccaaactaccaactttccccaaacttctccccaattccaagaactaaacatagcctataatagagaggcagtggatcaagcctactccctccgtccctaaaaaaaggttaacatagtacaagatgtaacatttccgagtactatggatctggacagaggatggagtgagtaccattttgcataaacagtgaaaactaatcatcatattatcactgcatcattattgccatcttgtctgaaactctgaatcttcggggtggcaaccatatctgaatcctcccaacagctgcacatttcaagcaggtagatgaggatgcttcaccctccatgagtgaccacttgtcatacaaacacaaattgtagctatcaccattcatctcatatatatatatatataggaggaaagtagaccgagtaatggtagtagcagtagatacatcaagaacacatagacacatacacatcaaaaaaaagatttgcaacctcgttgcaaaccatggaggagttcaccttcttcccagcagcgacgtcgcctcgccgcgatcatcggctcggcctcgtcggctcgcctccaccgctgctgttcgccgccgtcatcgaggtcgacgacggagatgatggagaggaggaggagaagatggacttgctgtgggaggacttcaacgaggagctggctcgcgcgccgccggtgtgccctctgagcccgctcaacatcaagggcggagggctgacggcgacgacggcgatggccaaggacgacggcggcggcggcgagaagcaggcgaggcgcatgtactccggcagcgtggtgcggcggcgccggagatggagcctgctgctgatgctcaggctgctcaagaacctcttcttggccaagaacacgaggaacaacccaagaactgcacccatctgaagcttttccgaaacgatcagtcgatcagattttttctggaggtttcagaaatcaagaaatccgagagctgatgatgatcttgatcacgatgatgatgatgaggatgagttatatacacgagtgtaaaatagtaatgtgcatatatttgatatctattagtactacatgtttgatgtttctgtcacaggacagagtaacccaaggaggtaaatttcctctcttttgctgaagtgtgtgttcttcttattatctatatatatatatagtttcctatataattatctgtttctgttcttcactctgattcttcttatgttatatcagttatcacaatgtatattggcatctcaatcatcaaaaattttatttctgaatcaagttcaacaagccctggctatttctcagtatagtactgattgagatcaatcattggttccatctgaattttgcttcatcatataaagatatctgaattttgtttgtaaaattttactgtacacctgttcctacagctgcatttggtttgttgtcaccaaccttgtagatgcagatgccttgccatcaaaacctaccgaaatgagggagctattaaatgtcaaggagcaggccaagttttctggtgaattcaccagaaatctctatgtgaggcagtgccagatgattccaagtcttcagcttcataaatgttgcaactaaacatcacagccaaaacagaccaggatcagggtacaatcatttgtgctgcatcttcaggaattctaacattagtaatctcaatgccctatctgatcccacagtttgcatttataatctttctcttctagtaataagatcataattttaaaaatgtccagacataaatacttctgtaatctgtactgtactgtactgtacttctgtaatctgtactgcatttcagttgatcagtgactgaaaaattttcaaactctcacctaacacatcatatagatatctactatttgatttagcagttgtgcttactttgttataatgaccagtactacaagtaagtcaatcatcgtagtcatagtacatatcaaacctagaaaggtcatctgaataggacttcctgattgggatttctccattgttcactggagtagaaaggaagaagaaggcctcaggctgggcgaggcgccgacacgtgtcgtctcgtggcaatctgcggtatctcagatctgtatataggcctgtaacaaattgaagcaacagtgaggtcaggtgagctaggcaaaggaagagctgtgagatggattcagctacctctaccggttggtctcaaacagcaggaattggttgtgtactctttcttgtacactgtcagaaaatcttggcaacaatctgcacttgcctgtcgggcatattcatgcaagaaggggaaacaaattattctcacatcataagctaatcatgctataacatgactagcagcagagatctagaacaaatgaacaattgctgtagcatgaaactgaacctgaaactgaatcaggattgttctactagcataaacaaatctgaaaccgaatcataattgctgcaagcataaagtttcagggtttagagaacaggatcacataagcaccagttcagtaacagtttcccagaaagaggcaacaatcagaaactcttttttctaagctataagatcagaacatttcttagctaacgactaattttcatcaaagcttcagttgcacactagagccacatgtgtgtgcaaccaccatcccaagtaaaagctgatcagatatggtgaagcatatcacaccatctggttttcagatctcaggccagtatactttgatgataatctgaatgaaatcaactacctatgacatatatcatgaaacataacagtaaaaatattatacagccacaaaaaaaaatgcaagttacattttagcattacaatggctgcacgtccgcaacaatagtacactccttaaccaatacaaccaggtctaaactagtcattcaacaacccaaccggaacaatagttcacttatgaactaggcacttattttgtttttttttatagaaaccaacatataaatagttttttaactgccaactacagcctcagatcaatggaattgaagcctccaacatgccgacatagcaatgttacttcgggtcagaacggagtttgtgcggagtaatttctgggacaactctgtagatgtgcacttttatgttatccttctggacaagctcgaagacacacacatcaaacttctccagattgttgccaacagcaaatttgccccagccaccactgaaagaaccaacagaacgatcactgtagtagacatagttaacttcccaagccttcccttgtggatcccagagtgtgatccttttgttggtatggggaagacactcacggacaaattcacatgggatattctgcaatataagaaaatgagttttggtttagatataagaaaacaagtagggaggttgagtaaacatatacagatagtgagcctttttgtaaaaaaaatgtattgccccgagggtaaggcataattggggaaatcggaagtttatctaagaaagatagttgaaaaatactaaacttggctcatttatgatggtattaaccgaatgcttgaaaattactactacagactgttgcttatttatagatcgctctctgctgtatgcagaaactttgtaataaggctatgtcaagatgggatgttcaaattagaacatccaaaactctcaaactatagcagcagcgccattgtgcaaattataatcatgcatgaaagaatcctctcatgcacatattttttttaagataaaatgtctcatgcacatagaaaaagggaaagtgctggatgaggattaacacacggaagtaacattaccatgaaaaatccaacatagacatatgactccatcattatttgcacggcaaaaggattcttagatttaaactctcttgccctttgaagagcatggtccttctctgcttcagttaccggacgcctctgtgatattactgttagttgtctttgaccctttgaaacacctgaaaagtgcaacacagtcaaattgtctacagaagtaatttattagcactacatttaggggacaataacttacatctaccacgccgagacacctcaccagacagaaagcgcatcaggaatggtggatttggtgacttgctagaagaattatcttcatctgagctgcatgatgaacctataatgtgcaaaagtaatttttttgggaaatcatatgaatccttaggattctgaacaagtatgatggaaataaataaataagcaacctctaaccaagagattagaaatatgtctttttgcaattactttgcatggtttggcaccgcgtagcttatggctatgcatggaacaaatcaggaatacaactaaacaagttctataaacgaaatggatgtggcaagtcatttgtgccgttatgcagacctccctggtcccccaacagttcaaaataattgactattaatagtcatcatctaagctgactatgccaaatatgtgtataacactttcagaaatatagaaatgttttacctctggtactgttatggcttgtcgatgttaccttggacttgccagcagaagctcctgcacgttttctcctagaactttcgcaaacattagcctcagatgacttcttaaatacaaccaccctatcttccataaggtaatctacatctctagttctctttcctgtgattccattattttccttcagggcgggagccattttctctgttgtgatagctgcggtgaccatgcccccttcatcactttctgttttaatgatcacatttttggaagggtgagcagagaaagttgatatcttgtcaatgcctgaaggttcaaagactgtcactgagaattgtgaccgtttatcataagtgaatactaaaaattgaccacactgaattgagttatctctgacaaattctttccatccatgcacaaagaagaatccctcagagtctgaagtcagctctgcactccatttatttccacttcgatcaaccagagaaaccatcccagtaggttgattctgaaggcattggttgaatgatgatgggattttctgcattgtaccaaagtataaaatatgttaatttatttttctacactacttgttaacattgtgaactactcatacgatgcaatgtcagttcaaaaacaaatatatcagacaaatacaatatgccacgtcatgtaatttttctataaggcatcaaattgtaaagaccagcaaagcagtcctgacatcatagcctcaaaaatgcaaaattacagaacatacgtgatgtatgactggaaaaactaaatgcttagaccaactaagatcaaaccttatcctgattaattgaattccttcttttcccacaccaaaaaataaaaatgaaaagtaagactcaaaccctctgaaagataatccaacccattagcagaggcccatgttgtgtaagtttttagccgctgagttgaaaaatgaaaggacatcataggcaattttattgtaacacagtgctttctactattctttggccacataaatgtgaaaatgaactaagcaagtttggcagctagccagctactttgggaaaaccacgaaaatagtaaatgtagtcgtcatgaacttctaacaataactgattgtgtgaccaatacacctgagtgttagacaaacctggatttggtagtgggagtgattactctatgtttttctaaagaacgctatgagaacacataccaccaccaaacaaggttaatcaagatgttgtttgctgactatgaaaaaccaactgtgcagtgcaaatgaagagctacatatcaaaatcaatactttaatacgctcgtgtgaacaatgaaagtgtataaggttactaacgaatcaaagcaagctagtcacactagggaatatacataaccaccacaaaaactcggacatttatttgaaagtgtttatagttaccctgcaatcatacagccacctttcgactaaaacacatacttccaaataattaatctagcgaacacaatccacatccgtgggattcgcaaaaaggggggacaagcatatagctaccctgcaaccaaacaaccgccttggggaaaacacatactcctaaatcattaatctagcgaacacaatccatatccgtgggattcacacaaaggggggggggggggaagtatttagctacccacagccaccttggggataaaacacattcctaaataattaatctacacggacacaatccacatctgtgcgattcaaaaaaggggaaaaaagtgcagatatctaccttgcaacctaacaaccaccttggagtaaaacacatactcctaaatcattagtctagcgaacacaatccgcatccgtgggatttacaaaaagggaaaaaatacatatagctacggctacccacaaccaccttggggctaaaacacacactcctaaatcattaatctagcgaacgcaatccacatatgtgggattcacaaaaaggaggaaaaacatatagctacccacggccaccttggggatagaacacattcctaaataattaatctacacagacacaatccacatatgtgggattcaaaaaaaaaagggaaacaggtgcatatagctaccctaaaatcaaataaccagatttgggctaaaacacattctcctaaatcattaatctagcgaacacaatccgcatccgtgggattcacaaaaaaggaaaaaaaatgtatatagctacccacaaccaccttggggctaaaacacatactcctaaatcattaatctagcgaacacaatctgcatccgtgggattcacaaaaagggaaaaagtgcatccggtctacgggtatcacctgaggacgcgagaccttggggttaaaacacatactacttaattattaatctacgaaaacacaatccacatctatcggagttgcaaaaaaggaaaaaaaatgcatgtagctaccctgcaatcaaaagtcaccatggggctaaaacacatactactaaatcattaatcttcacgaacacaatccacatacagctacctacagccaccttgaggctgaaacacacactgcaggttatgtttggttcatggccatttctagccttgccaattttgggcaatggcaatgccatttttttttggcaaaaattggctagtgtttgtttggtttgctaccaaagttgcatcttgacatattcaactcagccaaataatttggcaaggcaaatttttggccataaaccaaacaaataataaaaattttgtcagtcccaattttttttttcggtttggctgagattggctacaaaccaaacatgcatatcccaatcaactagcacaatcagcatctaatgaacagattaaaagtagcacaagtgaacacaacattattactaccctctaatcaatcaaccattcataacaaactgaacaacaacaacaacaacaacaacacaaacggagaaagagagacaaaaaagggattaaagagacatc

SEQ ID NO: 66502 - DNA, 4808 bp, Oryza sativa
aaagcagcatttagcaaacatttgagaatttgataaaacagttaagtaattaaacaatattaatccaacgctatacaacataccctgttgtataggcccaaccattctgaacaaccatcccggctgcacagttctatctccaaaccaggaatgtaccattccaaaccaggagctaaacaaattattaccagattaagcatcttttattatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccattgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaaccaaccattaccaggttttagttggcacattaattaattaactaatcacgattgaccatcgtgaactatcaataagccatcatgaaataatagtgaatcattagttatcccataagtgtactaatgtttctaagcagggctaagcaattatatctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcaaaaagaagcaaaatcaccaaaacagcacataaacaagcatgaacagtacatgtggatatttttaatgtgtagatctcaattttagaaaaattagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccggcgcacgggcggcggttcacacgaacggacggctgagattgttccgatccaaatcggacggccgagatcgatcggtccacgaccggctcacgggagaggatcccgatgacgtcaacgatgacatcaccaacgacggcggcggctcggcgaagaagacggctcgggcggcggacactcgccggcgaacggcggcaccacggcaccaacggagggcaccagcacgtagaggacaacgcggcgaacacaccggtgaccaaaacggcggcggagaaggaacggacgacgacggcgacgagaaggaacgggttccgacggctgcgaaggggcggacgaggacggcggcgacttggttagggtttagggtttagggtttagggtttagggtttagggctaccttcgggttgtcgacggcgacgaagctccggcgggttccgacggctgcaaaggggcggacgaggacggcggcgacttggcgatgacgacggcggtcttcccgagcggcggcgacagctggagcgacggcggagcacggctgaagcggcggcggcgaaggcaaagctagggcacacggcgctagggctactccggcgacgagaggcgaaggcgagggtggcgacgggtagaggagacaccgggggtccttttaaaggggctcggaggcggcggcgaaggcccacggcgacggcaacggcgaaggaaaccttcggcttggagagagggaaaaccgatccgaatcgaactcgattccaaagctttccaaagcgatttaaccaaagattccaaaggagaaaaggtagaggagatcccggagatcatttcccctctattgattcggccggagaaggaaaggaacggccggatttggaaagcggcggcgacggcagctcggcggcgcgaaactagggtttcggcccgaggaagacgacgactgacaagcgggacccacctgtcagcgacagcgagggcgcgcgcgcggctgcggactgggccggactgggccgaggagagagagaacggttttgggccgactttcggcccaaagccaaaagaagactttttaaaacctttttcaattaaaattatttcttaaatgcaattccatttattaaaaatactttcttaactcaaataaatcccagaaaaatctaggaattatagaattaagcaaagtatttaatgaaattttatctggcccaattttatattggaatttattaattaaacttagattttcttttcaagacttttaaaataaattctagaaattccatttaaacaacaatttatatattttgaattttcagggtgtgacaaacctaccccccttaaacagaatctcgtcctcgagattcggaagaactggcgaacagatgcggatgagctgacttcaattcatcttctcgttcccaagttgattcttcttccgagtgattactccattggactttgcaaaaacggataactcgattcctggttcttctctcacttgtttccaggatacggattggtttctcaacataagtcaaatcttcttggacttctatctgctcaatattagcttcttcggtaggtacccttaaacactttttcaattgcgacacatggaacacattatgtactcctgccaaagattgaggtaactccaactgataagcaacctctcctcttctactgacaatcttataaggtcccacaaaacgcggtgccaattttcctttggtacgaaaacgatgaactcctcgaaaaggcgtgacacgaagatacacataatctccctcttcaaaactcaaatctctgcggcgattgtcggcataactcttatgacgagactgagccacacgcaatctttcttgaatgatctttaccttttcttctgcttcccttaggatatccgttccgaaaacctgacgttctcccgtttgatcccacaaaagcggagtgcggcacttccgaccatacagtgcttcgtacggagccatctgtagactagcttgataactgttgttgtacgaaaattctgcatagggtagattcttatcccaacttccaccgaaatctagagcacaagctctcaacatgtcttccaaaatttgattcaccctttcggtttgtccatctgtctgcggatgataagcagtactaaagttcagcttagaacccatctcttcctgaagtttcttccaaaaatttgaagtaaactgactgcctcgatcagacactatcttcttagggacgccatgcaaacacacaatccttgccatatacaattctgctaagcgacttccggaataagttgtctttaccggaatgaaatgagccactttggtaagtctgtcgactatcacccaaatagagtcatggcctgatgacgttctgggtaaaccagtaataaaatccataccaatttcttcccatttccattcaggaatcttcaaaggttgcaacaaaccggcgggtttctgatgttctgccttgactcgctgacaaacatcacatactgctacgtattctgcgatttcacgcttcatacttgcccaccaaaatctttccttaagatcctggtacatcttagtactaccaggatgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatcttttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcacaatacacttgaaaacccttctttggatcaggcaaaatcaaaataggagcggatattaagcgacttttcaactcttgaaaactccgctcacattcttccgaccacttgtacttcacatctttctgaagcagtcgtgtcatgggcttagcaatcttggaaaaattctctataaacctccgataatatcctgcaaggc

SEQ ID NO: 66503 - DNA, 3169 bp, Oryza sativa
ttgtataaaggaaagaaacttgaataattgtaaaaggcaacaaaggttgagaccagtcaaatattgaaggggtaaataaattgttactaagggcctcacttgatgaataaaagatagcatggtatggtaattgtcctttatagtattgttttgcatggctgattttagcatgagaaaaacccatcctcttggacaaaaatccatttatatcgtggttggtacttggtagcagtggacagtctttaatcttgttcagtttggacttgatcaaaattcctgctaagtcttgtcgaaatatattcatatcttgctgcataaagtaaagggagaacattttatatgattttcataatgggaagctttggtgcaaaatatgaatagagttcattgtggttgcctgaaatcattgtattgatgtcagaaatcattgttgattcacacagataatagacagaaaagggaatgaattgagcaacccatataccaacgttacatgtccttcagttattggatcaaccacaggaaggttaaaaatattgaccatataagaggaattttgcttaagttctaaaagaatatctgaatcacatcgtaattcataaggaatttcgcttaagttctaattaactttggttgatcatgttgcctgactcactacataatatttggagtgttaatgccaattcatatagtgctctactatcactattttagtagtgcatatactgttaatcaaaataatttcattttgcaacttgtatatatatctctacatgaggactttgcaaagcaacatctcaggggcctacaatgagttgttgctcaggtaacaagtttcagtatcaaaattcataatatgttcactacaggtttcaggttcatatatctgaccaaagtactgtccttgccagattcagttccaaaatgagacacagttctcaccaggattacaggtgacggaacactttgtcgtggctacatagcacttgcatgcagaggggtagcagcttatgaagccacctcttgtttcatcagaggtaagattgagctaaagatgatgaatttagaaacttcataagctggcatgaactgaacttactgacaaatgcttaatttagaaacctgacaagatctcacgaactaacacaagaaaatctggtctttatgcacgaactttgggtgttcagccagcaggacgttgcggagctaccaggtctacttcagcatgaggaagcagtcaaccaacaatatcggcagcaagcacatgctgggaatgagactgtgttaatcttattaaatcaaaaaattagttcatgttatgccatttatttagtgtaattatagttatatatgtcctgttgtatgcttatgctgccatcggccaatctatgccgttaggatatgcatgtaagaactcagaagcggtgtatcaatcgaaaatcgattgattttttttctcacaaaacaagcatatgatagataaatgatcaattgaaaatcggttgaatttttttctcacaaaacaagcatatgatagataaatggtctctgatcttttcagcctacctaatttttttctccaaaacaaaccgttctgttttttattctatgcgcggtcgacaaaaaaaccatgatttcttaaaatcgacccaatctgaacgatcatcctgggcttaataatttttttgtccaaaataaaccgatctgctttattctatacgcgatcgaccaaaaaccatgattttgaaaaatagacccgatccggacggtctcggacttaatatttttttccataataaacggttctattttattctatgcgcgatcgactgaaaaaccattttttaaaatcgacccggtccgaacggcctcggacttatttttcttatccaaaataaacagttctgctatattctatgcgcagtcgaccaaagaaccatgatttttttaaaatcgacctggtccaaacggtctcaaacttaatatttttttttgtccaaaataagctttattctatgctcggaagacctgaaaaccaattttttttaaatcgaccaggtccgaatggtcctggacttaatattttttttccaaaataaactatcctactttattctttacgcgatcaaccgaaaattcttgattttttaaaatcgtcccgatctatacggtcctggacttaatattttttctaaaataaaccgttatgctttattctatacgtggttttttaaatctatccggtccggacagaccgaacgtgtaccttttactacctagtagatgttcgacagttttttttaaccataacattcgatatttttagccgcatgatccaacatcaacaacggtgactgttaagtggctaacgggtccacatcaaaatacagtacaacaaacgaaggatgatgtccgtaaaatctgggagaaaaataggaagttacagtgagttacagcatgtaactgcatgtaattagcatatactataactagtataaatttgccttcaatcctcaaattggatatagctcagtgacaaggaagtcatgcaggtgacgcggaagtttgagggatcgattcctatgttcgcttgtttttgctgctatttcgtttctcatcctaagcacgaatcttgatgttaatccaatgacccagaaatcgacagtttttctctgagaaatctgtcacaagttatttagggcccctttgaatcgcagggtagaaaaaatggaggaataggaaaaacacaggattctgacaggatttgaagtgtaaaacagaggattgcaaaacacaggaaaaacacagaaatgatcgtttgattggagcgcaggaaaaacgcaggaattagatgagagagatagactcaaaggaaattttccaagaggttggagctcttgctaaatttcctccaaattcacatgcaatatgccattccataggaatttcataggatttagaaagcttcaatcctttgaatcaaagggccaaataggaaaatttcctataggatttaaatcctatgaaattcctacgtagatcctttaattcaaaggggcccttagcaattccgatccagataggtatcacgtacccaaaatccgatcggcctgagatgcggtggctgcgtcgtgcctgatgcgatcaagccaaaattaccaaaattacc

SEQ ID NO: 66504 - DNA, 18789 bp, Oryza sativa
gaaaaaaaagggaagagggttttagagtaagagctctctggctctccagctcttggtagcttcttcatacacagatccaccagaacacaggagtagggtattacgcttctcagcggcccgaacctgtatacatcgcccgtgtcttgtgttttttccattctcgcgaactttccacagactaggagcttagaatctcacccagggcccccggccgaaccggcaaaggggggcctgcgcggtctcccggtgaggagtaccacgctccgctatctggcgcgccaggtagggggctctgcgtgtgttttttccattctcgcgaactttccacagactaggagcttagaatctcacccagggcccccggccgaaccggcaaaggggggcctgcgcggtctcccggtgaggagtcccacgctccgtcatctggcgcgccaggtaggggtcgaacctacggccttctgcttaggggtccgtatcgagtgatcggcgtcccccggccgggctccgttcggctggccacgggcgacggcacagagctgcctaacccgtggaacattgagcaccttcgtcgcttctacccctaatggggttcgggtgtcaggttttgggctcgggccaaccccacacccccctcgggcgtgtagggttggccgggggctaccacatatgcatattttttcttctatctgtatttcaataaaagcattttcgatttcctaaaggctgtatctgtgctgttgtttccttttgaagaatcttgacttgaaataggtcactcgtgctcaatcctgccctcggaggctcgggtcggctaaaatcgccaaaaggggcccagaaccgagccgtgccccggggcgtggtgaactccgggggggaatcggcaaaaacccacaatcgggtcacccataaccctcggtcaccacgctcccggcctggccagtctcgacacgtggatctccccaggcactagccccgacccgcgccttttgaggaccgagacctgggcacgagcccttagtcaagctaagacacaaaaggaccacggcatagatcatcctcatctcatacacatagcaaaatgaaattgacacagaaatttctttattttgattgcagattaagttaatctatacaaaaaggaggcccgaaggccttggaagaaagaaaagaagaaaaaactgaagattggcgggggcctgggggctcactccgatgcacccgggttgccagcctcgtcgccactgtcgcccactccgccgtcatcgtcctcctcgtcggagttgagggcgaacgcgagccgaggggccgaaccctcgaagctgtggacgatatggttggcggcgtcccggacctgcgcgcgcgcgccgtcctcggtcccgggagggaactcgtccagcgctgtccagggggagaagtcggggtccctggcctggtaactcgccagtacgagctccaccgctcctcgggcgaggtccctcgaggatgacttaaccgtcccctcgagctccttggggagccgctggagagtcccggccatctccgagaggcgctgggcgaggcccccctggttggcggcgtacttcacagtccgcccgccccagagacccgcctgccgcccggcgcggtctaaacgggacacggcgtcgcgaagcatgctgggccctatctcgcctgccaggcgaagggcctcgacctccccggtggacgaattcagcgcgccctgcagatccgcgatggtgtgttcggcagctgcgaggcgggcggctaagtcgctgtcgcccgtggccgccctgccgctacgcgcccttgcatccagctcccttgcctgcgcctcgagttcagcggcccgctggttcagtgcggccctctcggcgcgggcaccttccagattgcgacgcgcttgttcctctagcgcagcctcacggagggacgcgctctccgccagcctttgcgccgcggcctcagcctcctcgagggctcgctcccgctcgatgagcgcatcttcgcggaggcggagtgcggactcctcttcggcgcagacggcttcgtgcgccgccagtgtgacctcccgaatggcaacggcggcctcgcggtccgccagatcccttaccatgacgcaggaacgctcttccagcgccatggcacgggcctcgagggtttcttcacgctgccgggatgccacctcggtctccgccgcccgccgttctcgggcagcggcagcgtcaaggaccccccgggcggcgtcgagcttcttccctagctccgcctcccagctcccgtattgaaggcggaggtcgtcctgcgcctcgttcatcacggtagtggcgatgagggcagccccccgctactcctccacctccttggcgatctcccccagcaccttccgacgggcttcgagctctgagacgtgccggcggtgtgccttgcggcccacctccaccatggcctccactgagcgtcgcccctcttcgacacgcgcccatgcgacgtcgagctccgcccgctctgcttgcagggcctccatctgggcacttaacccgtccaacaccgtggtgtttgcgacggccaaggcctgcagaaggggctctgcgctcagtggggcagcggaaggcgtggggaagagccgcctcggtgaggatgccgcgcggctcggcccgccgatggatgtgccggactcggggacgtcccccggacctggcttgtcctgagcgtcgcccgagggagtgggcccaagcgatgcgcccgcggcctcgtcgcgagctgcctcggaagtcgtcgtcgcctcggcctggcgaagtctggcctcctcctgagcggcttcttcagcttggcgagctcggacggccacctgggcagcttcctcggcttcctgaaggcgatccgcggcttcttgccggtcagtttcgcgggttgcctcggaggatgtcgtcgcctcggcctggcggagtctggcctcctcccgagcggcttcctcagcctggcgagcccgggcggcctcccgggcggcctcctcggcttcccgtaggcgatccgcggcttctcgccggtcagattcccgcctctaggcctccgtggtcgccgcattctcggcctcagattggccggacttggattggcaagaaggacgcgacgggatctcgctgaagcagaagaaaagccagaagacaaacaagatgggtgaataaaaactcgcgttgggagaatgaatatagccacaatgggcgtgggacgaacctgcgaaggggtcggttaaacgaccaccttcgaggggaaataaggtttccccgggatggttctgtcccccccatcttgtggagccgtttcttcttccgctccccctcgggctgcggcgtcggcgtggccccctccgggcgcctgctgctgacacgcgccgccccgccccctcggggaggagatggggaggaggtaccctcttgcttcctcttccctcgggcgtcggcagggcggctgccccccgagccctcatcacggggcccggaagcacgaccccctcctagggtagattgatctcccttgcggctcccgctcgcaccgtcatggcccttgggagctctctcctctgaggccccgaccgtcatcatgatggtcaggatgttggcgcgatctggatcgctgcagagggggaggactccttgggggatgagggatgcctccacggagctgagatttagcacccgttggatcattaccttgaagtcttcagggacccagtcccatttgaccccccggtgggtcctcatacagtcctcgaacccggtgtactcccaggcgccccgggcgcgccgcttgagtggcgcgatccggcgacgaaggtagtcgccgtacaccatggcccctgtgagcccctgggatcgcaggcccgccaggcggtcgaggacggcgtcgtagccatctcccagatctaccggcgcccgccagttggaggcctgcgctgggggctggctcggaagtcggaggcgcgcttcgtcggcgaggggggtgtagaaccagtcgctcttccagtcgtcccacttcttgcggaggacgcagggaatgtagcggttcagcaccggcccccgcggctggaagtagcagccaccaaccaccgacggcggtgacaccggctgtacggtgaagaaccaccggaacagccgaagggatgggcgcaccccgatgaacatctcgcacaggttcgcgaagatggccaatgtcattaccgcgttgggggtgaggtgcgccatctggagatcgtaaaactccagaacatccatgaagaaagaagaaaatggcggaaccagccctgccattgcgaaagggaggaagaagacggaccgccccgggtagcgtggcgccgggcgtccctcgcccagcgtgactatctcccggcgggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaagaaggagttagggcgcaagcggcgaagacaaggggaataatggcgaaaggaaggaagcaaatctcttccttagcgtctttatacccttgccaacgctgtgcccggttcctcgcttcccgcgcccactatctcgccccctcgcttcccgcgcccacgcttccactaatcccactcgcccgtttgcggcgcacgaggtggatatgcggttgtggcggtcgagatggtacatatcgtgcgcgcattaattacgctcgccgaccgaagcgccatcaccatatctccaggcaaaacgaaccggctcgtcccgattcgcgtgctactcgagtaatatggcagtcttgaagagaccgctcattattgacagccgagttaccattgccgatgtgcgcgatttgcgactgctgggtttctgcccaactgtggagaccagccccacctgtcaccaggccttagaaagtggcgtcacgcccgaccgcttccctcgaggagggcgatcgccctggcataacgccgggggctactgtcggtgacatgggatcgggagtatcatgactagaggcttgagcaggagcaatcacccacgtggcctgaccccctcggggggggggggggccgggcccgagggtgatgtggccgcccccctctttgtctccccgaggggtcggaccgctcccgtttcggccccgagggctgaggcgccccgaccccttgtgggttttgcgccgcgtgtatgggttaggtgagcacaacggggctcacctaaccgcatttattgcggtttggacgagcgcgtcacgccgcatgtaacgcagtgcagcgcgctcgtctatccggtctgtgacagaccggtcagattgtgggttaggtggcaacaggcggtctgacacacgcctcgccccatcccgtcaggatgagagcctccaagcactcgtccctagccggagccggcgtgttagctcctggagatggcacgttggtcccggttagatatatgccaggcttcatcccaaccattacaagtaaaatattgtatgaagaagggcgaacatgcagatcgataaactgacacgtggtgggcaagaatgaccgatttgtgaccggtctgacaccggtcatgtcgtaggcagacagccatgttcccacgtcgcacctgcttccggcggaagtggaggtaggtatgggccgtcccatcagaaggtcattcggacggcaaccattgcatgtctccgcccatttatgaagaggtgacagggtgatccccgaggtcagatgagtaaggacgcgtggccacactcaaaaacaagcagtgtttttagctttctagagaaggcaagccaagtttgagtaaagataggataagtccccaccaaaaagagagataggtagaggtggtgcatgtggtatccccttgagatataaaaggaggaccttgcccacggaaaaaaggaggactggaaggagagaggatctggagagtagatcccaggagaggaaaaaaaagggaagagggtttctagagtaagagctctctagctctccagctcttggtagcttcttcatacacagatccaccagaacacaggagtagggtattacgcttctcaacggcccgaacctgtatacatcgcccgtgtcttgtgttttttccattctcgcgaactttccacagactaggagcttagaatctcacccagggcccccggccgaaccggcaaaggggggcctgcgcggtctcccggtgaggagtcccacgctccgtcagaatggtacattcctggtttggagataaatctgtgcagccgggtatggttgttcaggatggttgggcctgagcagcatgggtgtgctgttcagtgttgattaatattaatgattaattattctactgttttataattctcaaatatttgctaaatgctgcttttgcaaatgagccctatattatgccattctttggtatccttgtacacttgcatatttgctgcggggcttgctgagtatgtcatatgctcaccttgcaataatcaattaaacctcagttgaagacaagttgcgaaggagaagacgtttggcttataccccagttgagctgcctgtgggagtagagccggagcttcgctagaccgtaattccgctgctgttttctcttttcttttgtaagtatgtaacgttattatattgatgaatctatatattaaattgtcagtttgtgtacctcggctgattcctggacgaggatttaatgtacaaattagttcggaaattactagtgaatttccgggcgtgataaacatgagtagggttattcattattactcggatcgggggactgaacctatattacaaaaatccttgtcgtatactctctttattccatattcgcgcataccttggtattagccacaaactatgtcccaaaatatcatggtcaagtataacccattgatagttagatggacccaaccagaggaacggtaaggattataatgtgccatcaatttttctcaagtagtattggctccttacacctaagattgttacggttctcagggttgctactatgtaattgggtaattttttatgaagaatagaagagactcctactgcaatatatatttacaagaaaactacaaagaggcagaatttacaataaagttaatctaaagattgtatccatgattatcacattgctctatgatcctcctctaccctgtgcatctgtagggtaaactccttgttgaatccattcttccaagcttgccatgttaggttaatgtcgaagataaagctatttttttcttatccatatatttccaagaagcaatagtaacggcttctgtgaagaaagggaatgcaaattggttgccagcatcgggggtgccacgcaggggagggagggggagggtcggtactatcatcattcgtgttgacccattgaacctcaatgccgatggggctggcgccgaaaaagtgtccactcctagaataaatttttccataggtctatttgtaaaaaaaagtttcaaaaggccattttaccttggagagcaaaatggctggttgtagtcggcagctaataggaaaggttttctcctagtgtagattcattgtgacgtggtgtaaggtttacgatttgacaacctccccttcttggatgaaactgctaattgacaacccaccacacacggctagtctcgcgcgatcggtcccacgcctactgcttttagcctatcggaattttcttttttttcctatacatataaagtttgtatggctacacgtacaaactttttttacgtctaaagtgtgcgcgtacgcgttcaatgtttatactataattttatatacatacatatatacatagaaataaaaaaatatatgtatttatacatatagatacatatttttttaatacaaatataaagttgtatacttatatgtataaagcttttgaacatactagggcccataccgactacgctttagtccccccccctctccctactaggagaccgtggtatttagggatgtagggtatggtcgatatcaaggtatatatgagtatagaataaaaagagtaatggactaggatttttatacatgttcacactccctaatgtcgtaatagtcatactcatgtttatacatattgacctggggcatattacacttagtaaaaaaaggagcagactagctaatctagcctactgttcgtactgatgaatccgcaaacgcactgatatcgctgtatcacttcaccttagagcactccaagggtattgaatcacaggtaatatgtgcactccaagggtattgaatcacaggtaatatgtatatatatctaataacatgattctatccaaggacaacaactaatggtaggcttagaggattcttatgggttaatttattagacttaagtaaaatttgctatatggcatccaaaaaatgtgtaattagctgctggacaccgcaagaacgcgaatatgctatcgagcaccacaaaaactagtaattagctgttggacattcgcgaccttattttattatttccggaggaattggagaaaaaaacttatgtaagagtacaattttgcccctgccttcattccgcttacagagcgggcgctttgcatttgcgtcccaccggccactgctccccacgcttctccgctctgccaccatggccgagtcgatcgtctctggcctcctgatcacggcttccgccgtcgcgcgtcctcacagcagccacagccttccccatggctcctgcgcgacgcgtgtcccccaactccagcgcgacaggctgtgcgtccggcccacggtggatgaggacgaggcgatgagcatcgacaacctccgcctttttcgacgtcaacgtcgacaagtggaatggagccttctacgtgcgctcgccttcctgttcctgtgttcgtaatctgcacactgagacgctgactgtgcttgtgttctgctcatcagcatattgatgcgcatgggattagcacgcggctgtcagtgagcacctatatatggcgaggacgacctcatcaacctcctgcagtcgtataatattcaattaacacatttagcccttttcccagtcttacttcaagtattccacgtttacaacatcttctttaccattactagtaatcaagttcagtattttggccgtttgattgtgcccattgttcctaacgatgtgtttacatattgtgaatttccaggttgtatatcaagcaagcttcttctcagatatcaattgtagatgaggaggattctgaaccagagtgggcagagtacaaaatcaaagagacaaacatgttcacagtagataactatcaacagctgcactgaagtttgatgatctcttggcctcttcagacatttttttaaaaaaaaattgtgtatttctgagtatttttaacgagtggtgttttttagtatacagatcggattctttcatgatgagaaggcatttactgtgatgggatcgatatagtgcgattagccttgtggttggtttgcaccggatccagtcagattgaactatattgagtgtttctctctccaatttcttcgaaaataataaaataagttggattgaaataagttcgatcacaggcaaacttgtctttattgagtgtttctctcttcaattccttcgaaaataataaaataagactgcgagtgtccaacagctaattaccagttttttgtgattccgatagcatattcgtgttcttgcgatgtccaccagctaatcacacgttttttgaatgccatgagtaaccaatactcgatttgatttggatatgtactcggacactgcacgttggaattgtatccaaggtggcctattgggccaagtccgtatggagaagcaaggcaatcgtggacagccatccaatggccaatgtgcaaccgcacatgcgaggcacaatcttgcctaggagctgacatatccaccaatcacagatagcacactaccttcctggtacgtggcgtgaagcctaggcaaccagtcgtcttacccaggaggtagatccacccctgacttaggagtaataagagatagaaaaagaaactaaacatattcattgttggatagagatcacgagaaaggtagtggcagaggacgaaaaaaatagcgaaaatcttctctctcccctcaactactcctggcgagcagctaggagttgagctttgatttcgagtcttcgacctcgccggccattatattccttgctatgtaaccaggatgccgaaggttggcatctcaatctcaatcatcactgccatctccccgttagatctggccacattgagctcaggggtgcctgattctttttttttttttttgggggggggggggagtgggggacaccaggcatgagggaagttgcaagctcggtctcggcttcctcgccggtggacggcggtgcaacgagctccacctcaacttcgtcagcaacgatagcagggatgatggtgtacgagatgtggatacaacttcttcatggcgtacaggtaaacaaaattgccaaagggtagggggcttcttggcgccgatatggtggtctaaactcaaagaggaggaagaagtgtatcgttctgtgattttttttttatgttttagcgcagtgtatctagggctgtcaacgagccaacctcgagcgagcttgcttgtctgagctcgagctcggtatagactcaggtcgagctcgagccgagccttgtcaagtctgagttttcagtcgggctcatactcggctcattcgaccttcgagctttttctcgagcttggagtatgtacatccactacaccatgccccaagtttgcttactacatatctgtcaggaaaggacctatatgctgtcaaattatttgttagcataagttttcccgacagatagggtctgtcaggccaagtgctgccggcaaaggtcttttccgacagataaatgtttgctgacagataactcgacagtcctacaaatgaattaccgacagacggaagttaccgacagatggtcctttaccgacagttaacggattactgacagatacgcagtttgcatatatcagtttttctgacagatattctgttagtgtgccctgcattgggttaaaaaaaatatagttcatggaatcaaatcctactgatctagaactgaatataccaccaacagttctcatgcatccacattccattagtactgaatataccaattccatttaattacaaatgccatgtacataggttagttgtacaaaaagagaaattctcctatacaatctacaaaatgagacaaaacgatggcaaatctacaacaggcaaggcatttcccttgtagagaaatgccactccaaaatatcttgtgaccgccatgataagttgagcatctaaaaacttgaatcagattatcagaaagacaaaagtattaagggtcagatatatagattataataatactccattcaatgttaagtaatctatgcaacacctactatttcaatacagaattgaagatcagtgtcaaatgtgcaggataagtgtcaataacataactgatgtagttccatttaattcaatctgtagcatagcttcgatattctcacaatccaccaatattaaattaccagttccattttatgagaaatttatgttgaagcagtataattgcaatcgtaacagattcaattacaatttacaagcagcaaggattgcaatttatctcacaaactatgggaacaaactgattttagcttacatgatgtatgagcctttaagttagtgttgatcttctgttccttcaggtacccttctctgacacttcagcaagaagttgattgctcacccacaggtcgcaaatcatagctagtaaataaataaaaagaagataagtgctgaagtacagtttaattggctcccacttgcaaatgttaacttatattagaattgagatgtatgtaggtgacattttcataattaatgtagatggaaaatctgaagcccgaagactgtttcaaatttgtactacgacaactcactgcaaggacagctagccacctaatttgcagagatcaactaagggagttttatttaaaataattatactaggatggtacattctacaagtaaaaactcagtaaacacacaatgtacatgcatatttctaataaatggattgatataagttggaaatggcttcactagtaaatagaacttggcttgagtagttgctgtactatgtggtgcatgcaaagttctcaattagcatttcaattattccaactggtcctgatagctgatgcatgtctgtgtgaaatcaataatagatcaaatcttaaaaaaaaatgttcaccactctttctagtacatatataataatgtctgccatgaaatgaaaaggaaatggagcaaacataatctccaatttattgaatagtgcatcatatagaagattagcacttaattgttaataccattgaagttcttgtaatggaaaagtaagcggaaatctaaaaatatgaacaattatccgtttttcaatttgatacattagatcagacagaaaatgtccataatgtggtacactacatgagaaatagtgcattttcttagtactaccacatttctgtaaacattacagctaacttcatgagaaatataaagcagaactggagcattagctaagattcatggggaaaagagacaagtaggttcaccctaaactcttttgcaccagtattaagcatggttgcaatgcaagtttccatcccatggctatgaatgacagccccagctctcatcaaataagcctgcaaaataccaatgaaaattagacagtttagaacacactagccgaatgtgcgctctttctcttttggcaaccatgattggacaatcaataaatgagaattctataaaagctcctaatcaacaccactcccgaatacggtatgctcgatcctaacagaagacacgagagtagccactgctcgattaaccgctcgtgagggggaatcgagtgcccctcgcaggcaattcgtcgaacaggagccgtgcaggctgtgatgagagagagagaggggggggggaccttgggtgcccagaggcggtcgtcggcggcgacccagcgccaggtgctgcgtgcgtccaggagctccatcacccgccccatcacctcctccccgagcacatccacggggtcctctcgtctctgccgcctcctcctcctcctccccctcttccgcctctcccactcctccgcctcccgcttccgccgccgccgccgcccgcgccttggttgccgatgacgtcgcctgcaccttgctcaccgccgccgccgtcgcccgcaccttgctcgccgccgccgcccgcgccttggccgccgatgccgtcgccttgccgccgccggaggaagcgtgagtgcgtgacggctgggtagggaagaaaaggataaggttgtggggaaattagggtttggtttatatatgataggctagatgggctttttgggcttgcaatatagtattattaatagtctaatatacaccctctaagttttgctgacatataattagctcgtactcttacaattactgacagatattttgaccaaaaatatatttagaattactgacatataccatgtctcattatgcactattgctgacatatagtttgccaaaaacctttaccgacagatatgttatcactaattgtttatttttgccaacagatgtctgttggtaattccatgtcatggtgtagtgatcatgcgagcttgtactattactaacaagcacattacagcatgcaagcttgtactactagcaccaggtagacaatatgtgagagcttgtactactagcatatgggaaaaacaattcactgatagagattgtcacacccagaaattctcgaaccagaatttctaagctgaatgtgcattaaatccctgtccaggaccagccagggtacacaaacgataattgttgacatacagacccacatcttacaaaaatataaaagattacaaatgcagcgggaaagataaaagcgagctaaaccgggaagcttgacttcaacagcggacgactccactccacaggcaaaccttgacggcagcgacgaaaccaacctctctgagacagctccaactgagaagaacttcaactctggtatgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccataaccatccacaccacgctaaggtttcacccccacccctcaaaaggcagtgggcggtcccctcttgcaccgcggtgaatccggcagctggacaaccgaacacctcggccgacccaactccatcacgcccaccctcgccaccggtgcctaggaaagggtcgagctatacttcagatcaagtagttacccactcccgcttgtggtaagcacggtaagtctcccagggtttcccgtgaaccggtccttaactgctatgggtgcgaccagcaaaaccatgcactcacagcccgccattcagaatattttaattaactgacacccttgcggtagcaccaatctaaagctatgccaatagtcagagtctatgtaataatgtgatccctttttgtgtactagttgagctaagcatggctaagcatttcctaaaccaacatctaatcattttgatacccaggttatcaatggcatatggtaaacaataaatggctaagtaataggacccatcccacatgacattgtaaaagaatgcaacatttaatagaaatgcagggtgtttgtaaattgggtacaatatgatcaaacgtatggcatgacttgccttgctctcgaactgatgagacctcagcaacgtctttgagaaactgcggatcgacgaaacggccgaaacctacgcgacaaacagagcacacaagcaaaacatgctataagactactgaaacaggaaacaaaaccatttttaatggattctttgcatttttcttgatttactgagacttgaatggacttaaacggagctcggatgaattacttatgtattttagaagataaactgtgtttttactaataaagaaaaagtccttaattaattattgcgcaataatacccagggctgacgtcatccagggggcggcgccgacaggcggggcccacgggtcagcggctcaaaggggagaggaagggggcgccggcatataggccccacgggcagtggctcaaggtggccggtctaccgtggaccgggaccacgcgggtggtccaccgccggtccacgggaccgacggtccggatcagccgggaggccgatcggacggcacggcggcggctaggcacggctcggctcggcttcaaaaccggccggccggccatggcaaccggcggcgacgcgcacggtcgccggcgacggcaatcggcggcgcgggaagcgacggcggacggggtacaggacggcggcgtcgaccgaaggcgacggcgagcgcgtggagagaggcgacgcaaacgagagagagggggaagagggaggaggggggatcctcaccggcgagtatggcggccggagcggaggatgaaggtggcggcgacgacctggcgatgaggaggggcggacgggcggcggcggcacctacggagggagttgagaaggattaggagtaaagagggtgaccacggcggccaccattgttggccggagacgaaggagaatggatagctcaccggtgtgcgaggagaaccgggctccggtggggtttagcggaaaccgagcggcggccgaggtggctcacgcggcggcaatgctaatggcggcggcggcttggcgcggcggcggctctagcggctgcggcgcgcgaccggaggtggcggccagcggcggcgctagtggcgagcggcgcggcggcggtaggaggcacgggaaagcgcggcgaaaaggggaaaagggagagggagatgcggggaagctttataggggctcgagaggggcggacatggccgggaaaccccccgatttggccggcgacgtggggagagagagagagagagagagtgggggggattcaaatcgaatcccgcccatttgcgggcgcgcgtgcggacgggaatggcggggagggcggcgacgtggggacgcggagtgggggcgcggcgtggagcggagaaggcggcggcgcggacggtttcggcggcggttgccgtcgtggggcgggcggctggaggaaggggacgacctgacaggtgggccccacctgtcagcgtcccggagagaggggaaaggggaacgggccggcccaaaggaaggaggccgagcgcgggagggagtgggctgacggcccaatagagaaaaaagaaggaaaagaaaaagaaaaagaagaaaggatttttcctgggatttaaaattgcactttggtgatttttaattggttaaaattatttccaaggctctaaaaattccactaaaaatcttggtaatgcattggagcatggggaactcaagaaaaattccaccacgctatttccgattattaattgcatttattaactagggatttagctctaggttaattaagataatttcttcgggcaatttatttaaccaatttttaaagcaagaaaaaggggaaacttctgggcgtgacagagatgctcacgaatctatcatgcagctctttattggggagtgtgctagtgctggagtactactacttgttggtctttgaagaagtacgggcttgctgctagcccgtggtgcatagataaagaataaaagaagtcaaacatactactcgttgagctgtaggtgagcagctgagctcgtcgagcttttcgagctcggttcgatggggctcgcgagccttagtgcaagctcgggcttggcttgtatgatggtcgaatcgagctcgagccgagcctaagacgagccgagttcgagtagcttgcgagccccgagcttttttgacagccctaagtgtatcggtatgttttattagttagacacaaaatgttgcagtgcccttttgatgatgttttcattcttgccttcagtgtgttcagatgtgttgatgctttggtagttcaaaattgatgtttcatatgtaacaaaatgtttcaattatgtttcaccatttgaattgtcgaaacatttttgttcgagatctgaaacatttttgttcaagggatgaaactcttttatctcattggtgaaactttttttatcgagtggtgcaacatgtgaaacacttcataataatacagtgcaacatcgtccgatgatttataaaatattggacatctgatttgtagcactctccaaaaaaaaaatagaggtgtggccatagactaaggagatgctttagcgccagtttgccatcgatgccatgaaactcatagcaactaaaatctctagccaagtcagcagtggatgccatggcagaagtcgatcaagagctcggacaaaccgtatgcagctgcacatctacgtccttcacctgcgcctctattggccacagtgtcgtatgcccgcgccgcctacacccgttgcatgctcaccattgccactagctttcccatcggtaatcaagattggtgttgatagtcgttatcgaccaatttcgaccgtcaatattacccaatatatgaagactagctatgcttgcaatgcataatttccaaataaaatatctacttccactatatactatgctattaacatctatgtaggagaagcacatataaatggaggagaatcgacaacaaaatagacgatcaatcaatcagaggctgtcgagatctagacttacggatgaataggccaagaacacataattgacatgatctaataggcccaaaattcactgttatgtataagggaggagctaagagggccacctgccaaaaatgggccaaaatggtctagcacatggttcggccgaacccctctaagcgccgatggatccagggtttcttgtggacggtggagattcactccctatgacggttggagggcgtttcggacctttccaactatcataactgtcataagtgttggtatttcttaacgacattactagaaatataattcccagtaatgacgcagaaatacttctggtatattatggttacagtgttcatccgcaagcgcacggatataccattgtaacatttcacccgagagtattccaagggtatcgtatttattttatctcgtgggaagatcatatagagagaacttgactaataatttatatattacttgtgataatcatattctaagcaggggttaagataatccaagggtagagtgacacacaagcat

SEQ ID NO: 66505 - DNA, 13499 bp, Oryza sativa
atccttttccttccccttccccttccccttccccatccggccaccttgcttttccctaaccaccatgacctcctactccgattcttgggccccccccccccccccgaccgaacaaccaaagccgaaatagaatccaagaaaaaggaaggaagaaaagagagcgcaagctcgccccgcccggccgggtgaacaaaaagaaaaaaaaaatcaaaccggcgaggaggcgggtggcgggtcgggagagggaagacgagcagcagcggcggcggcggcggaggaggaggagaagcaatggaagcgaaatgcctaccgctgtgctgcgatgcgaggggaagaggaaaataggaaacaagcgagcaaggagagagagagagagggttttggaagagagaggggggaggggagtgtcagcactggaaaagtggaaatttccagaagggcctgagatatcacctgcgcggcggggtggggcccacctgcagtcacacacacttccatctcttttttttccctcatttttttactttctattgctcgcgtccaatcaataactctctctccttcagtccaattctcgcactctgcttctctgttggccctgttcgtttccttctaaactgacaggataaacttttggattaaaatggcatgttttttaaactactaaacggtatattttgtgcggaaactttctatataaaaattgttctaaaatatcagattaaaccattttttaagtttgtaataattaaaactcaattaatcacacgttattgccacctcattttacgtgaaaaacttaatttttatcttcaggagattcaaacacaacttaatttttatctttaggagattcaaacactaccttgatagtacccacagccactttggagataaaaacacatactcctcattcgttgatctacacgaacacaatccacatctatgggattagaaaaaaaaggaaaaaattgcatatagcttccctgcaatcaaacaatcaccttggcgccaaaacacaatctcctaaatcattaatctaacaaacacaatccgcatccgtgggatacacaaaatgggaaaaagtgtagatagatacccataggcaccttagggctaaaacacatactcctaaatcattaatctttgcgaacacaatccgcatatgtgagttttacaaaaagggaaaaaaatatatagctacccaccgccaccttagggctaaaacacatactcctaaatcattaatcttcgcgaacacaatccgcatatgtgagtttcacaaaaaggggaaaaaaaacatatagctacccaccgccaccttagggctaaaacacatagggtatgtttggttcgtggccatttctagccttgccaattttgggcaatggcagtgctttttttttagcaaaaattgtctagtctttgtttggtttgctaccaaagttgcatcttgacatattgaactgagccaaataatttggcaaggcaacttttttttgccacaaaccaaacaaataacaaatattttggcagtcccaattttgtttgcttggctgagagtgggtacaaaccaaacacatcaataataatatattgaaccacaacgacacaaacagataaagagagacagaaagggattcaagagaaatcaccatccgctccatagattgcagcgtgagaagcacacggaagaagctcctcccaaagtagctcatgtcgccctccttctccttccccttctccatccagccaccttgctcttccccaaccaccatgaccaccctctcctcctccctcctgctccgcccaacctccctgttcttgcgccgatccataccttcctctcctccttccactcgctacaaccaatctactaccacaactagatcaaagattgcaagattgcaaggaaaccaagaacaagaacggcaagaaccttctccagcaatagaggaagggtttattaatagcccctggctgcggtagggaccagacacattgcaggcagaggcagcctccaggggatgcgagtgtgtgcgggttggctgccgctcgccgctgaaatgcgcgcacacacacaacacactagcacagcaaaaaaaagctatcgtttttgtcttaaagctgacacttttgtcctctccctcatcactccacctgagagtgaggggcaaacaaattggtcagtcttgtcaggagcagtagtaggatacggaggggatagaaaggccctgacatgatggtcctctttctgtgcattgtgcatgtgtgcgctgcaggggaaattgggcagattttgtagtggtttctcacttgaattgtatcccttttctcagagcagaagaagaacatgatggcattggatgacattgttgttcttctgcttgaacacctgcagatgactaggagtaagagtacatgtcgcaatcttgggagatttaggggtggtattggcactggtgttggtgttgggttcattttcttttattataaacaacacattcatatatattgtttttagttgtaacatatgctacattcgcgttattactatacacatatgcaacttatatttagtcgcaacatgtgctacactaacggtatcgcacatacacaacctagatatatttgtatactctacatatatttgtatttggttgtgataatcgtcagagttgggaaagagaatccgggaataatgtcattttcgatgtttagaggtggtatgtgtattggtgttggccgtattttcttttccactcatgctgcatatggacatatgtacgcgtctataaatattttcctttaagagggcacatttacgggcgcatgcaacacaagtagcaccaccacactcattccacatccgcgcacacacatagatcctttcacacacaagcgaggaggcattgcattttagggtgcacgcgacacatgcaacactaaccagacacattccaaatgcacgcacacacattgacatccttcacactcagaacgaggagagattgcttttcagggtgtatatgacacacgcaacaccaccagactcatcccacatgtgtgcgcacacatggacatccttttacacacgagcgaggagagattgcattgcagggtgcatgcgacacacacaacaccattaaactcattccacatgtataaacactactccctctgtcccaaaatataacaacttttagccctcaagatttgtcccaaaatataacaacttctccaccaacattctcttcccaaccaatcacagctctccaccgttcactttttccacctaactccactactcaaccaatcacaaccctccaccattcacttctacctactttcttaataatcgtgtctaactctaaaaatgcttataatctgggacggagggagtacatcttttttacacatgagcgaggagatattgaagggctaatgcccttagtgcactgaaatgcatagtaaattgaaacacaagtgtgtataattgtgcctaattggtggtaaccttaccaggaaataggaaaagactagtggtaaacataatgttgggaattgaacttgtgccaaccagctctcaccaccgagatccaaccactaagctatggcttagtcctcacatctacaaacattttattgtgatgattgcgaacatttgagttgaatgagagaaaatatggggcttgggggtgtttaaaattttgcatgatatggtgtggtgctattatgatgtttattgatactagcacaaaatgtttatgttttagttaaaaagatggcaaaatttgctacgagaccctcaaaatttgtgttatttgctgatagacagcataaaaacacgtcgcggctaaaagacactttaaaaaactagtaatttgccggaggacactttcggtggttcaattgaatagagagattctttaaaaagacaagaatgcccctagggtcaaaaagcttttgagctgagactagaacgaagatggaatataatgtatgctagtgatgtacttggggatgatggcaaatttatattgcataatttctaaatttttactctaacatcatgtttgaagcatgtggtcttaggggcattctcgtctttattaagaatttatcaatttaattgaggccaaagtgtcctatagcaaaatatcagtttttaaggatgtcttttagtcgtgatacatttttttgatgtctatcagcaaattacacaaaatttgggtgtcttgtagcaaaatttgccaaattttttttgtctcattttaagttttatatccaaataatcagattatatatattgctctaacataaaaaaatattgtcaatactccgatcacagtatccatacctgtatggttcgtttggaggatataaggatcaattgatatgaggatgcaagaatctgtaaggagagtaagggacacatagatttttgtataggtccggaccctctaattatgggtaataaccctatccctgttggccaagatcgctgttaccgctatatataaatgtctcgtgagtacaaaggggaggaaaactcacacatttatttgaaatgcatatctcatttttgcgtagctaactaacccattggaagatagcatctttattcctacacataaacagaaccagtttagaatccttctacaatccatacaagattctcctggatgcaataaatagccaccttgggggtaaaacacattcctaaatcatgaatcttcacgaacacaatccacatatgctggattcaaaaaaaggggaaaaagtgcatatagctacccagcaatcaaacaaccgccttgggactaaaacacatactccgaaatcattaatttagcgagcacaatccacatatgtgggattcacaaaaaagggggggaacacatagctacccatagccaccttggggataaaaacattcataaataattaatctacacggacacaatcacatgtgtgggattcacaaaaagggaaaaaagtgcatatagctaccctacaaccaaacaaccaccttggggctaaaacacatactcctaaatctagcgaacacaatccgcatccgtgtgattcacaaaataggaaaaatgcatatagctacccatagccacctcctaaatcattaatctagcgaacacaatccgcatccgtgggattcacgaaaaagggaaaagtgcagatagctacccatagccactttggggctaaaacacatactcctaaatcgttaatctacacgaacacaatccacatcaaaaagggaaaaagttgcatatcgctaccctgcaatcaaacagtcaccttggggctaaaacacattctcctaaatcattaatctagcgaacacaatccgcatccgtgggattcacaaaatgggaaaaagtgcatatactcctaaaacattaatcttcgcgaacacaatctgcatatgtaagtttcacaaaaggggaaaaaaaagcttatagcttatagattggtctcatttaaatttttatatccaaataatcagattgtatatattgttctaacatcaaaaaaatattgtcaatgagttatactccgatcatagtatccattcctatatggtttgtttggaggatatagggattggttgatatgaggatgcatgaatctgtaaagaaagtaagggagacgacatagatttttgtacaggtccggaccctctaattatgggtaataactctattcctgttgggcaagatcggtggtataattatatatcaatctctcatgagtacaaaggggaggaaaacttaatctagtatgctagtgtatcagtgtaaagcttgggcatggtggtcgacaactagctgttgttggcttcctcgtgtagtgactcgacaaaattgagggtagcttgtattgtgttggtttctatgtcttgtccttatcctctcttagaggtgttatattcatacctttaggtgcccattgtcaaagtagtagtagcgatgcaaatatggatacgatctgagtagttctggttaggcctaagtaggatttttgccatatacatcaggcttgtttccgtacaggactaggtatatggtggtcccactgagctaggtacacatgtatatggtatttgaaagtggatcaaggccccaaatgattttggtgattaataacaatacgattatagatgactaacaaataatttgagtatgtgtgaaggaatgttagttcttggtaaagagtatttcaatgcaaaacccgatgatagtgacaaaacgatgtgatgtggcatatgagcaaatggtataatataaattttaatttgtttgcatcattaggaaagccgtactataaaggggatgatgcattgaaattgaggaatgatttgggtgctcaaaaatcaactttccaaagtatttctcctcgaattttcagttcttgagttcttcggacttgtccgaaatgtgttttcggaattcccgaaagttgcctgagctgagaaaacggtactggtcattttcagacttgtacaaaaatcactttcagaatttccaaaaatggctgtgaagtcaaactcggttctggaaagttttgtacttcccgaaaatcatttttggaattatcaaaaatggctaagcaaccaaaatggttctaaatgtttttggacttgtccgaaaactattttcggaatttctgaaaatggccgtgcagccaaacatggttctggatgttttcagatttgtccgaaaatcattttcagaatttccgaaaatgtctatgcaagcaattttggttcttactagtacaaaaatgatttttttggacaaacaccctaataggttacagatggcccataagtgtctgcatctgtaaaaatcgaccccaattttcacatatggctccttaatagacccgcacgcaaaaatgaatttttctaaacggacaacttaaaacgtctgcactcaaaaataagggtattttcgcatgtggggatcttcactcacccgcatgcaaaaaaaaacccctcttcccattctcttttttctcccctcccctctctctcttgtggcctcacccactcctctcctctctcccactccacacccactcttccactcccggctcctcttctcccctctcctccctctcgacgacgagcactggccgcggtggtggcgacggcggcggtggcgggcgagggtgccgaggggtgtgggcgctggcgtgcggcagcctcatccattctccgcacccctcgtgcgtggggcaccctccggcggtggggggcgtgggatctggcggtccccgcacgaatctgccggcggcaccctcagaagcgactgccgcgacggagggtggcaactgcggcaacatcgagggctggcggcggatctggtgactgcgtcgacgacgggcgtgggcaacggcgaaggcggcaaccccctcggccatcaccacatgaaatggaatagattccactagtgaaaggaggagtgctttatgcgacctctcgaggaaagggttagtgaagatccagctctttgtgagctcctcaatggagactagaaactccccaaggattccaacttcaggaacacttcatcttgcaagaacctcagtgaaatccctctctccctcctctagctttagttgtttgtgccgctacaagtctagttgttgtttgtgctagttcttcattcttatgggtagctagatctagcatttctttactcatgtgcatactttatgattttcggattttctgaaaagtcttgcttccgcatttacttaagtttttaaattagcctatttacccccctccctctctaagcgtaagtgaccctttcagtatcccatatccaggacactgacaattatattgatggccgatttgtattttaaattattttgtataaggttggcttagatctatcaatgatatatactatgtagaatcaattctaaaagttagttggatgtcttctcgaaatccatacaatccacacccaatggtccccatagtcgcaccaaaacctactgcgtgagagcagatctagttcaggcacagtgcatgtggcctcgtgatgattttcaacagttgtatggatctgttatttaagacgggcgactattgcggtcttcaaagccactgtgcaattagttgtttttctataggacaagtcacaactagagtgaccgaaggagagcttttgctgatttattttatggttaattggatctgtgtcattgtaaatttgacatattagaaaaatatcattactatctgtgatatcagctgggtgtcattgaaattttgtgaaattctaaccatgccattgccgtccagttttctgtcgtggccatcaatttctatcagtcctcccctttctcactcttctctccctgctaccaatctgccgccggtgtgggcaacatcctttcctcattgacccccgcaggtgcggcctcatcatgctacggaggaggcttctcttgccacccctcgctgttgtcctcactcatagcgttggcggtggcctgcactgtcttggagaggaactgacaaggagagtgtgtgaggccatgaaggaggctgcagtgaggtcggccatgcgggtgtggaggagcagcgatgggaggagtaggaggatggggaggatgccgacggtggggaagatagggaggatacggaggtaggggaaggggagggtgagaagagtgggaaggaggcggaggaagtggcgaaatctaccattggagacacgagcccgactgatgttgtgccccgttgaccttgaactcatcatctttgcctctaaggtccacgtcgtgaccgctgtgcattcattgttccatgccacacagcttcaatcgaatctgggttgagttggtttggagctgaaggggagcaagcgctaggatgggaggtgggtgttggccacaatgaggagctcgtcggcgctaggaggggctccatgtccaccgcgcactcggacagctgcttccagccgacgcgagctagtctgtcgctcctgcatatcctcattggcaaggattggagggagggcgtggggtttgggaggacgatggaggcgatgaacctgcccccatcgttgtcgccgccatcgccaatggcttcgtcgtcggtggcctagaggcgcgacttcctcgctagacgccgcatctgaaacgaggtggagagatatggtaagaaagaagaggggaggatggagaaagaagatggaattgacatgtgagtcccacgtctaggggttttttttgtctatatgatgacggaaaacatgatggtgatgacatggtcttaattttgtgtaaattcgaatgacatgaatacgaatagacgaattataagtagtatttatctgatcagcatatttgtactggaatgttccaattaatcctttattttatgggacaattgatcgtatctttttttaaactaaaccggcaggaatttcctgccgattatattttcaataagcagcagtcgatcatatctaaagaggcagcagtcgatcatatctgttgaattggaactatccagatttaagctaatgcagggaaggtctcctctgcagtacaagagcctgaggcccctgagcctcccccatttatcgagtcgtgtaagagcaagtttaacagtatagccactgttagctctaaatcatatatagccaaagtaatagctaatttatataatagttgctcactatactattaatatctggtcccatctgtcatacacatattacgtcttagagtccatactgcagctggctacagatctgtagcccgctgctcttttctctcttcctttatctttttaaaatatgtttatagttagcttatagtctgctattattttatctctttaaaatatatttatagctggcttatattgtaactgctctaagacgaacgaacagagggtaaggatataaagtcccagacatgatggtcctatttgggcagtgcgcagcagagcttatccatatccatgtgctgctgcggcgaatcagtagatttctctcttttcttttctttctccttggattttgcctcttctttccgggagcagagcatggacatcatcattctcattggacacatgagattgtcacaatctgcaaggttcatctgcctagatttgccaaacctttttgtccaagctcaccaaagattttgccatcaaaatcaaagctacaatttagccacaaagtaaaaccatgccatactttttaagaccagttagagcatctccaacggtctccttatccctctctttaagttaaattttggaaattttggctcaatttcaccctccaacagactggctattgggctggccaaagtcctccttccactagccaaatttggccagccaaaatagcctagccaatcgtgggccccacgccaacaacatccctctcctctttctctctccgccaaccgtcgtcgtcgagatgccatcgctggtgctgtcgaggtcgtcgttgccggacgccgccgtcgccagccgtcgtcggcgctgtcgccgtcgccagccgtcgtcgcgtcgtcgccagatccgctgttgccgaacaccgccgtcatcgtgccgttgccagatccgcgaggtcgtcgttgagcctcgctagccgtcgtcggcgccatcgtcaaccgtcatctccgaggtcgtcattgccggacgccgcaccatcaccagccgtcgtcgatgccgtcgccagccgttgtcggcgccgtcgccagatccgtcgccagccgaggtcatcgtcgcctgccgtcgtcatcgccatgccccggcggattcagccggtgcggcatgtagtagaggacgccgccatctcactcctgtcatcgtgttcgccgcccgagccgattggccaccccgcatccacgcgagctcgccccgagcggtggcggcggcggcggcagcacctgctgcgagctgagcagagtgggtttggggaaagggggagagatgaggaagaagaaagggttgtaaagactgacacgtgggtcccactatcataggctcataatagagaggatgaatagagaggctgttggagtaaataagagtttgactggctaaattagatagagagttggccaaattgatatttggagagttagatttgaagagactgtaggagatgctcttaggcatggatcctcagtttgcagtgaagtaatcttacccacacttatagttgtcaaccaaacacacgtttaatatgatcaaactcgtctaaccacaagggtggctatcaacaaacagcctcacgtactactagcaactgtgcaaaaatctgacagtgttcaaaaagttaaatgagatgcaccggtgctataaaaagtgaatgaatggaataatggcttaaaatcccttccatgacaattctcctaaaaagacaaagagctacaataattatgaagactatttcttttaaaaaaaataatacaactcttttagcaaaactgcagcggcactacaattttaactttgcgggtctaaggtgcaacccggacctaccagataaacaaattttcagtttttttataacaaaacgttcaactattattgtaataatcttttggactgcctattaatattaggtcctctttgtttagacttataagccaacttataagtcgaaaagtctaaacctaaacaaacaagcagcttttccgtttggcttgtttgaagccacaagccactttaacactattaagccaaaagctaggttggagaagcttttttggcttatgtgaggtatttttggcttatgtgaggtagatgtatgactcaaccactaaacttaggacattaaatccattgtcttataaatcatataagccaataagctgacttaaaagtctaggccaataagcctaagcctaaacaaaagagggtcttagattcggagctttaaatcttatggaattttcaaccaacagatacattccgttttaaataaaataaaaaaagagacctaataaaaattcctcaatctaagaaaaaaatctatactcctttaaaaaaaatagcagtggtggtagttagcggtgaatgtgccaccacccatgccaccaactctctaccttttagaatgaagaaatgacacgtggggttccaccaacaactccctacttcttttgagtgaagaaaggatatgtgtggccgaatgacccacatatccaccaccccacccaccaccatctctatttttttatgaagaaaaagtgatattgtgaggccatatgcacatatgttatttacaaatatgtagaatttaatagtacggaaaataatgataataataggttaacgattattttcatcaattagatcctgtttcaatgcatggacaatatgctatgctagtagttataaaatctaattttggtgtattgtaattaagtagtgctatgtaactaagtgtaattgcaagttggatttataggagcacgaatcttgatacaagatcctacggacgaaaaatcaaaagataagagttcaaaaatctatcgcaagtgaaatagtaaaaccttaatttcttttgtggaattgtagcaaatcgataattttggtgacatggttgtcggttcatccgttcccaggcttaattccatggaataagttcactttaggtccctcaatttgtcctcaagtctgattttcatcctcagtccagaaaaccggaatgcatcccccaacttacaaaaccatacagacgaggtctctcagtagtattgtgcccggtttttagatggcgtggcgcctacatggctcctttgactaggtcgtcgtcccatgcgacattgacgtgatgtttacgtggcaattcgatctcggaaaataataaaaatagtgggacccacatgtcagttacacacaaaataataaaaaaaagatgggggtccatatggtcccatacgtcatcctcactccttcctcttcactttatcccccctcactcccatgcactgcaaggagaagggcgagcggcagcggccggatcagaggggtggcgagtggagcagatgggtggtgggcgaagcaggggcggcagctggaacagaggggcagtgggcggaccaacagcgggcggggggcgagcacctataagttgttcgtcgcttgggccatcgggcgggagagcttgggacaacggtgctctgttagcctctgtggccctcctcgctccccaaccccatcggtgacgccgagttggccgaccaccgcagcgccgccctcataacagtcatggtttcctcacctcgccaaggtcactgcccgccatcggttcgttatgcctgatgcttaactagctcgcctgctacgttgtctccttgccacccacttgcccatccgccacacacccttctcgttctacaaaccaggccgatgcctctccactgccgtccccggcaaggagctctgttgtacgtctctctcggcatcgatgccgccatctccc

SEQ ID NO: 66506 - DNA, 10701 bp, Oryza sativa
ttatgggccttgatgggccgtgtgtagccgtgcctatgctatgggccgttgctttgctggcttgcacacgtcatcgcgtgctggctttccaacacgctcgaaaattcaaaagttgtctcccttttgatatccccacaaaaatctcgagccccacttgccggcgacgagatggattcagctcttgccgccgccgccgccaccgccgccgtggcggcgttccccaacttcgccgatgtcgccggcgccgtcgcgctcctcgttctcgccgactcgccgccagcgccgtccccgcctccacctcctcccactgtcaggtactacttccgcgcgcagcactctggttttctccattcggtgttcggcgcgacgaattcaccgccccgtgcggcggcgcctccccgttcattgcagcgacgagctctcgtgctactcgggatcctccgcgtcctactccggcacctcggcgaggtcgtgcgtgtccgactccgcgcagcgcggtcgccccgtcgaccccctccgcgtgctcgccgtcgtcgcctccctccgccgcatcgaccccaaggtaaataatctgatgtgctagatcgcgaacgccaatagtttcatcggtgctaatggctctgctcctcgttgactctaggtgctcgccaaggcgacgaacacgctgtttcagggcgagtcgtcgaagaagaggaagggcgtgtggatccacatcgacgacgatgaggacgagagcgagaggaacagcgctgtggccagcgaggggagcaccgtcacggggaccgcgtctgcaagctccacggccacgtcggggagatcccaccggcctccgcgggcgagtggcggtggcgaccagctgccgcgaagggcggacaagatcatgaagtggttgtcgcggccgggagcggtgccggcaacggagacgaccatccgtgcagccgtcggcgacaatgctggcaccagcaaggcgctgcgcttgtgagtaccacactgctgccaattgcaatttgaaacgcttttgaaatggttgtcatgttaatttcaatttgaagcggttttgaaatggttgccatgttaattccaatctgaagcggttttgaaatggtttccgtgttgctaaattgtttgtgtggaatccgcaggctgctgaagcgtccgggctgcttgcgacgttctggctctggtggccgcaatgatccatatgtttacatggtatgtgaaactcatgcctactgtttgaattgagacgggaatacgaaattcgatgcatgttctgtgctgttgaatgatggtggctcattgtattgtagcttaagagattttcagattggagtagtattaccctttgatagtgtgcaaattttttgaatcgagttagtgagctactgagcttagtaatttccagtggcccagtgggacatacacatttgaagcagttcttaaacctgagttaaatttgcggtagtgctcactgatcactctttagtaccccattctagaagctctatttattgtgttgggagctcagcacaggcaaagttcacagcaacagtgacatgttatgacggccactgcacaggcagacatcacaaaatgtgatgtctcaaatttgtgaattatcagctcttattaactttgcagaatacattcattactatttagctattcccatgatttctcatgagtactattttccttttgatgaattttcaggtcacaggctgacccaatgaagttaactaagttgtgtttatagcaaaagagatggtaactgtaaagctattggagaggccaagtgacttctgagcagtatttagtaatttctactacctgtctgtcttaattactgtttaattttgccttcctgcatataagaagtatagccataggagaaagcaaagttcccatgttagaaagagcttgcagatatatttgtaaagataggctactggatagaaatatagacacacaatcatacacccagagattttatgtcatcgcgctttatattagtgtatgtcgaactggagtaatcaagtataatgagttccattttcagacacttctttttgcaattaactgttatctgaacttctctgtgggaatgaaatctgtgctgttgaataggaattattagatattttgaatagtcccttctgtcagctctttattgtacaaatagcctacggttctgatgaacaaatctgtattgaagttcaatccatttatttctccttctgttgcagaagctagtgaagctaccaatctccacattggttgtttttcacatataactaaagctaaactaacgcgctacgatgagcatacgctagagttagctttgttctgaaatctgacagtggaagcctttgaggctttcacagcttgatccttttgtctgcatactttagttcctcttcttactggagagcatgttcttgaaccagaaagctgagtccttggggtacctctttagcgtcttgtagtccacgtagacgatgccaaaacgggaagtgtacccgagcctccactcgaagttgtcaagcaatgaccaagcaaagtatccaatcactttggcaccatcgtctatcgccttcttgagctcagtgatgtagtttctgtagtatctgattcttactgtatcatgcacaccctgagtgatactgacgttgccaggttggtccatacctgtaagagcacaacattgatcatagtgtaagccttctttaatacttttcattgtcaacaaaactattattcggagaatcagggaccattctgatagaattagtaccattttcagaaaggatcattgtagggtttccatatgtttcctttacataggtcacagccttgttgattccccatggcacaatgtaaagccagtaggagtttgcctgcgtgaattcaatcaattcaactattgaagtgtgatgatttaacttgaaattcaacttttcctaactgttcaacatactactgtacaaatgtacaatacattgactgccacttacttgagctccaatgggcacgccgtttcgttcatctggaaaagacatgagtgcatgagcaactgatccaattaaacagtactacaagaaactgaattatgcatcagaaaatcagaaggatttgggggtggagtattcagaactcacaggcaaacccaacatgccagtcatcctgataactggtcggtgtcaggttccatggcccagggtctttcatgtagaaagaggtgtagtggttgatgccaacataatctattgagtctttcaccatcctggactcctcatcactgaaggttggcatcctgtccttgacgatttcgagcatcgagtatgggtaccgaccatggataatggggtcaaggaacctttaaggagatcatagtgtcagtttgctgatccaaaaaaaagggtactttcagactttcagtttgtggctacactatcacaaaaaatctagactgctactagacctgagcatctgaactctggagtaaataatcgataatttgatcctgaaccagatggtgttttcagatttttaccatccgaggtgaaaatctcttgccctctgtgctgcagccctatcagcattgctgtcactgaatggttcataccagacaaaatccaagagaattccaatcctccccttttgataaagctgttcaattggaagaaatgcattgcagactacattctcagatacagggatagcaaaagtaactgagataatttgcattgcatagtgtaaatccagccttgagctgaactgtcattctgctattttacctgatacttttcgcggtatcgcttgacggcggcagcatgagaaaggatgagatggtgggcagcaaggtatggttctgtcgtggagttgcctcctgcatcacagccagagcaccttcccggggcatggaagccattgtcatatcctagagcagcaacgcatctcggctcattgaaggtaaaccagtccttcaccctgtctccgaacgtctggaagcagaaatctgcgtagtctgcaaacgcctctcttcacagtagaatacacattttttctttggtcaaatatatgcttcaatcagcttacaaattttgaagttcatagttttcaagttgaaatgcttacacgatgtttgggcttagccagcctaagtactgctcatggagtgctaatggtaggtcatagtggtagaggtttgcgtacggtttgatgcctaattcaccaagagaaggtcaggacactgatgcagagaacctttgtagtactgtctaaggtaagcaagtgtcctaggaaagttacctttcttaaccatgtaatctattaacctgttgtaataatcaactccttcctggttcaccatcccagtcccatctaaatttttatagaaaactccaaatcacaaactccactgatccaaccaacaacaacaaaaagaactgctgcaggtacagacataatccacatacttgggaaaattcttgaccaagagatcgaaaatctatacgcatcaaagcccatgttcttcattatgttcacatcttcctacaaccccaaacaacaaccatcaagcatcaaaagagaaagaaacaccacaaaccacaacaacgagaaaacacaatcaccgaatcacacacacataacacattacacaccttgtacctatgatactcatcaaccgtcacatcggctgtggcattattagggatcgtccctgtcaggacacaagaacacggtaacaacaatgagcaccatttaccatctcacctgcactgaagtttagtactctgaatctctgattacttttacctggtttctctatgaaagcgtcccagatgctagggccccggccaccctgcttcgccatgccctccacctggtacgccgacgcggccgtgccgaacacgaacccctccgggaaggctcgccggctcagcccgccggcgtcgtagatctccgggttgagccagtagcattgtgccggtggcagcgtcagcagcagatgagctgctgctgctagtgcaagccgcagtgctgctatgaatttcctcatgtctgcattacacacagagggagcaggaagtctggagacaaaaagggctttgtcttccggtggcatataaaagatgggaggaggtaaaagaaaactgagcgcctgaggcttaccaatttttacagttactgattcagtttttcaccctgtgtttattggcagtttgcttctcaaactaagctgggggcagcctgaatcagaaggcctgaaaatggagggaagttgcaacagatgcgattcccagaatgataggaagggccgcacaatttgtaagtttgcctcagttttctgtggaggtttctacgttccacatttccactattgatgtgcccaactttgtttgttgtgctcccaatcttatcttttaattccttgacgaccttgatggaccccattctgtaaattgattgaatgaatgaaagtttggagccaatgacgctcacactgactgaagcatcgctgtggctttactcctagatgaagttattaaaaaacacggatttttaaaaattaatgagcaaagataaacatattttaacttaagataaacttaaaacacccgtcctaaaatatgatcatttttaaataaaacgatactactttaaccgataatatctacaaaagtaatatgttttaagtaaaaagagttatatattataataatttatttaattataaatctagcaacattaaatttatatgattgattttttttacttttttctactaatagttaaatttaaaaagtttaacttcactcttctaaaaatacttataatttggtacgaagggagtagtaatttaaaatggtgggagtgagtacttcaggctaaccccaatcggtgctagctaggctgtgtttaaattaaaagtttggatccaaacttcagcccttttccatcacatcaacctgtcatacacacaatttttcagccacattatccaaccaaactttttagtcacatcgtccaactaaaatctaaactttatgctgaactaaacacagccccagtatagtgcagcaagagatctggacacgcatacatattgcaagactgcaacacgtgagaagcctttgtcagttgtcgctagttcactgccaagatcagcgcccacacacacacggaaaagcggggactcttgcgcgcagccatccggtccgcgaaacgcgtgcaagtcttgccctcctcctcctcctcctcctcctcgtcgcgccgcgatcctaatcctatcctcccccatcatcttcatctccggcgctgtttgtcgcgtacggcgcaacggccgttcgttcttctccgctagtttaatccgctccggcgacgtacgtgcagcgtggcggcttttgcctctacatcagcctccgcggaaacgggccccgcgacggcgtgcgaatttcttgtgtaataactgcggggttttgtcgtctcgacaaatcgaccgcagctgattgatggcaccgtgcacgtatacgtactagtacgtgccaccaccgtccaccgacacttgtgatcatacggtacacgacagatttgtttcgacgccctgcggctgcggatcgcgtcgggggcccgacccgatgctacgtgctcagacaccgcatgtgtcacgcggcacgaggcttacgtacacacatatactcgtggagttttcggttacccatatcctctaataataaattatttataaaggtaatttttttaatgtgatctaacgacttaagagctcaatgcttaaaaaaaaatatttaaaaaaatcttaaaataaactttaaatttaagttatctttgattttgatttattagggtagccgattgagctcatgatctcgtggcctagccgcctagctctcgatccatgcctcaagctccctctcatcttgggccaaacagcaccactaaagaaaaggccgattttgttctgaatgggaccattatatgggctcgtgcccaatatttgcctctcactctctgaccgcttgcattactgtggagattatgggtattccatatctacacggcgatggtattcgaactgggtacaggatacctaatgtagatagaatatcttatctgtatctcgggtttgtttcttaacttgtgtatcaaggaaacaccctgagacttagtcggttacgactgtattttacctttatcttcatattccgttaggaatatagattatcttttgtaatccggactccttccaatatataaggggggtccgggcgcctctaggggcatatgctgatttttcccgaatcatacaatcaataatacactcggcggattcatccccggacaggagtagggtattacttcttttataagaaggcctgaacctgtataaatcctttgtctccaaacccatacactttccaagcttgatagccacccccttttattattgccgaaatctagtttcgacagttggcgcgccaggtaggggtagcgtcaagcttttcgccgatcagtgcaatgggttccgtcaccggcatcgacgacctcgtcttcccacccgggcagacgtttcggttcggcagcctcgatttcgtcaccaacaacttcggcaagatttctctccttgactcggaatcagaccagtcgggagagaatcgacttctagttccgtttggattcccaaacgcggcagaaagttgcttcaagaccatctcgatcgagtcagcttcaaaccactcggccgagatcgcatctactccaacaacgccagatcaagacgatgagccttacccatcaatcttgatgcagctccctgacgattcggcagccgtctccaccgccacgccgtctccatcccgtaggcctaggcggaagtcggtcttaacaccgatttcgcctagcttcagggaagtcggcgtcatcctccaaccactcggcacggtttcaacggaccaactggatggctactacagctctcccaccgtcgactcacgtcccaccgaaatcgtggaatacgatgagttcggttctcgctactacgacgacgcggatcttgacgacttcgacggaagcctagaagacaactacactcctcttttcttcggcgtctttatggccgacaatgaaacggaggagcagcgccaagcccgggaagccgaagcacgttgcgagaccgagcgccgccgactggagcaggagcgccaagcacaagagcaagagcgactacgccgggagcagcaggagcatgagcggaacgcgaaggaggctgaagaccgacggcagcgaaccttggaagctgggcgccgagcgcgtgatctcatcggccagcaagatgttgaagggataccggttttccgtacccctcagcagaatgcggttgccgcgatcaccctcctcgacaccctcctcaaggaaaacgagcacaaccaatctgatcatgtcgtcaacatcctgaaccagaccaagaccatgattgcggcctcggttccagttaactccgaaagcgtccacacgccgactggtagccgagttccacacttccgatctcaggactaccgtcatccaagcctcagcatcaccggcgcaggatccaatcgcaggagcaggggtcacgacgagcggtccgcgcactcgcctcccgactaccgtggggagcgccgagtagaacggccacgttctccgcctcgtcgccgccccatcgatcttcgcgacacaatcatacagcgccgagcagctcgaggccgtcaccactcgccagaccgctacgacgacgaccttgatggggtagcagccttcaccgacgacctgcgtcgagtggattggccagccggcttcaaaccgactggaatagagaagtacgacggtaccactaacccagaatcgtggcttaccgtctacggtctcgcaatccgcgcagcaggaggtgacaacaaggccatggcgaactatttaccagtggctttagcggattccgcccgatcttggctccatggattgccccgtggtacgatcggatcttgggccgaattacgcgaccacttcatcgccaacttccaaggcaccttcgagcgtcctggcacacaatatgatctttacaacgttatccagaaatccggagaatcccttcgagagtatatccgacgattttctgaacaacgtaacaagatctccgacatcaccgacgacgtcatcatcgccgcattcaccaaagggattcgccacgaagaattggtcggcaaatttgggcgcaaacctcccagaacagtcaagctcatgtttgaaaaagccaacgagtacgccaaagccgaagacgccgtcaccgcatcgaagcagtcgggtcccagttggaagccgaaaaatacgccggctacgggaggaagtggaagtaacaatcataaggaccgcaagcgtaagcctgaggaacttgttgcaaccgccgctcactcttctcgacagcgttcgcgcgtcaacaccttcgacaagattatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggacgacggcgacaccccggctggatttcaagaccaccgcaaggagctcaaccatattttcggcggccccatggcttatgagtctaaacggaagcagaagttgactgaacgggagatcaacgctgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcattgatggtggcagtgcactcaatatcctcttcgccaagaccttggatgatatgcagattcctcgctccgagctaaaaccaagcaatgcgccttttcacggagtaatcccaggactatccgcaactccacttggccagatcaccctcccagtcacttttggcactcgggaaaatttccgtacagagaacatcagctttgaagtcgccgatttcgagacagcataccatgccatactcggacgcccggcgttagccaaattcatggccgtcccgcactacacatacatgatgatgaagatgcctggtccccgaggagtcctatccctacggagcgacatcaagcaagccgtcacatgcgacaaggagagttgcgacatggcccaaactcgcgagatggcgtcagcccgagaggaaatccgactggctgcaaccacggtgagcgaaggaaaagtgcccgctgccaagatttcaaaaagtggggaaaccgaagccgcgactaagaagattcccttagatccttctgatcctaccaaaactgctgtaataggcgccgagttagattgtaaataggaaagcgcgctcatcacctttcttcaaaataataaagatatctttgcgtggaaaccttcggatatgcccggtgtcggtgatatgggaccgggagtatcatgaccagaggcttgaggcagactcaatcgcccacgtggcctggcaccttcggggacgtcgggcccgagggtgaggtgtccgccctcctcctgatttcccccgagggggggtcgg

SEQ ID NO: 66507 - DNA, 2359 bp, Oryza sativa
cctggaaattttatcgtactagatgcatatgctagtttgtccaccattttcctgatgcttcttattcataccactcttggatacacagtggaactcaatctattgttcacgccttctgtaatcgtattcagctccatcctttttctgttgcatggcttgcaattttgtgatggatactaagtgagcagtgacattgtctttcaatggtaaagttacactcatcgatcaaaagatgggatgatggatatacataaggatattatccatttcacaaccatgtctttttccacattccgagatcaacccaaaacaacaaaataagacatgcgtgttacagtaacaacttcgacttcaaaacgttactttataccttgcacatcaaaaccacttagtgtaaaagaagagacttgaatattttttttaaaaaaaagtaaaaaacatacaaaaaaacagttagaaatatatatatactgtctggagttagaatatcttttgagttgagggtaaaaattatttacgcatcatcccatcttcgtactagatttttgaagttgtagctagctgttgatctctatgcttcacaaactatactatcttgtactatgttgtaactgcatagttttattcttttatttcaacttgtggtgttaaatgtaggtaaatcgtgaattttgcagcttaaaagaaacatattttttttgcatttaacgaaaattagtacatgaagtattccacagtttgggtgagttcctttcactcaaacagagccaagagtagagattcagatcagctgcaagactaacattgctgaaagttagcacacatgtactgttcactacttaaaaaataatttttcccgacacttggattttattttttcaagtggactaaaaatattctcgcttgtgaaaatatcagaagttctataggtctagccccaactgaaaaaaataatcaatttatacaagtgggatctaaagaagtttgcctgtgaaaatacccttcattttcgcaggtagacctccttagcctccacgtgcaaaaatcaatggcagtcgggacctaaagaggcccgccagcaaagcgtggaggcacttttttatccagcatcgccagccaccgacaagcaatccttctccctcacctacgccctccctcactcaatctccctcacacctctactagggcttcgatccccatccctctccgtccagcctccaggccacttggcgatagcgggcaaggcactacgttcagcggcattagcggaagcagggaagggatgacgttcggtggcatcagcggcggctacaagcgcggttggcggcaacgggctggaggagatgagaggtcgctagtggaagctggcaggctcgggatgcaacagcgacatcgacggcgatgatggcgaccccaccattgacgacgactacgtacgagctcgggggaggcggatccactcagtggccagcttgggagaggggtgtatgactatagcaaggttggaagaggcagatccatcgccgacggccttggatccgccattgccgagctatgtagtgtcggacccaccgttgccgagctcgggagggggtggatccaccaccagcagctcgggagttggggtgcatcgtctacagcgaaggggagtggcgatggctgtggaggccttggattggcatgaacatactagaaatctgctggtcagaccgcctgatggttgtcagttggaccgacatgagactcccagccgaccgactcctaatcgacggtcagggtgtccggtaagattataaggtgtccagttagaccgttgttcaaatttagatcaatttagtactagtgcctaattggctatctaaagatacattattgcatatgagatctagttgatatgatgcatatttgtttctcgttttttaacatttctaccacgggatagcaaaatttccaagatttcagattttttggaatattttttaaaaaattgaacaaactttagcctaagttgaataacttttaccaaattcacacaaaaattgaaaactttgggcaaaatagtttcgttcacgcgggggaggggtgttcccgatattgcaggaattggaagtgaaattgcatgcataggttataattatgaactgaacatatgcaggtagcctcacatttctttcatcacaaaaattcttaaaaaaacattctgtagatcttgaatgtcaagcgtggaaacatcgtgtcctccacagtttaccatgtgccagagcaacattcatccaactgaaaccataagcttgcaaggtcaaattttcctggatgcctccttgtccgatcaaactgagatatacatgcggaacttgat

SEQ ID NO: 66508 - DNA, 11414 bp, Oryza sativa
tcgctgttgacccccattaggagcgagggggagggagatagagagaggggggtgaggtggaggtagtgggacccattgacatgtgggtcccactatgtttatcttcttgtttgactgacatatggccccacatattttgttgtaatttttaatttttcaattttattttttccatatcagattgctacgtcaatgctacgtaggacgaagacatagttaaaaggtccacgtaagcaccacgttagccagaatcggggtcaatactgctgagggatctcgtttgcactggttttataagttgggcgatacattatatccggttttttcgaccgaggacgaaaatcagaccggcaacaaattaagagacctaaagtgaacttattccattccaggccatcccacgtgttttgatgggcctcaattttcatccatccacgaataattggcgttgtatttgctaatggccctaggcctgtgtggatcgtccattttgctttcactctaggcccattacgtcgaaactaactcactgcccggacgaccgggtttttccaggctctgggtagccgtacgtgtcaaacaggcagcaacctggtgaaagtcctaaaatttaaacgattttattcgtgtataactacatgagtaaaatcccatatattttaaaatagagacagtagctttaatgccatcacccatcataatcacgtttggcaatataggcaggggtgaaccataagccatgcaccatggtctttcgtcctgcgaatcagccatgattcggggtttagattcattcgttcctgaatgtagattaataaaatgtactaccttcgttttctcaaaacatgaactaaatctttactattataaaaaatgaagatgtttttgccggttatttggtacgttattcgtgtatgagtcggtttttaaattcgttcgcttttagaaatacagatccgtatttgagttgagttttaactttattcgtttttgaaaatacagaaaggctcatataagaaatctctttaaaaaaactcgcatgctaacttgtcataattttctagaaaatatatatccaagcgaattctcacaataaattttacattgaacaataataagattaaaatagccttcactcgttgcaacgcacagacattttttctagtctttgaaatatgtttgattattcattttctaaaaatatttatataaatagacaaatatattaagtatgtttaaagtagctttggttatagctcaagttgcactcttttcactagctaagtaattgtgttgatcaaagtttgataaaataaaattcaaacacaccctatattaaaaaagcagaggtattgtattgccaatatacattaatctatattgccgatggtcttatttttagtacaaatattcaccatacaacaccgccacaatctatattgacttctgttgcgaaatgacggcggtgttgctcccatgttttcccagcctcactttgatttttcccatagtccacacaactcatcaccgtctttcactggtaacaccaaaggcaacaaacaaaaaccacaatttacatgggtataaggtcattatttagcatttgttggctagcttgttgctacactcatgcccttatataggtgtgtttggcaacattttggataattttttgttggtttgtttgttcataataaaggttatggtaaataaaaataaggttgcatatctagcccctagatttcaattaccagaaaagttgcttcgttataggggtgaaagtgaatcggataatatctaatccactccactccaaatccgtccgaagtgaggatatagtaagggtttatagatattcggcggatacgaatttggctatggatacggagctagacgtggtgttggcgatatcctgcagatctggtggagggtttggtagataacccgactttctcatctcatggaaccactctatttgacccatttcacataagacagaccatctattagttgacctaataacctatctctctcacacacaggacgaaccaatgcaagctgctaggcaggtttgccgtcacactcccatgcgcacacaagcggcgaagcaggaatgcgggtacgacgcgtcattgcctgtggctctcaacgttgacgcctcctctggtcgtccccatcttctactccccgcagcaccgcctgctttgagtttgctttaaattttggtgatatggtataaccgctattccgatctgttttcacccctaattcattatcaaagtttacaagtgcacacattattcctacagcggaatgctacgtgaggtcaccttgggtatggaagtgtgtgaggtggtgtgacgagtttaatgtgtaataggcactaataaaatttgatgactatagacacgaaacatctttactactttaaaaggacataatgatgatggtgaactccactttatacattgttgaaattacccacatttctcatcctagcctatatatcaacaaaattgctcacctttgtcatctcactcctgacttctatcatagccacaaaccccaaatctccccctttcctcatcattttctctcctaccaacctccatgtcacttgctttctcgctgcttgctcccatcatgatctctgctcctcctactcaacatgttggcacttgatgctcaatgtcccttgcccctcccgtcatgacattcacgtactttcctcctgctcatatcctactcagcacatgagtaagggggttcacacctatctctttgctggcaaagaagaccgctattgagtggagtactagttagctacaacattgccacatctcttcctccatatatgctacatggtccatccttacgtgactatgattctacttagatttattttttaaaaaacatattgtgtatatatatccttttgtcctcacttaggtaccatctagtgccaagccttgggtccttatagatatcatgatattatttcacccagccacatcggagccatattatttgcttgccgcacaacatgttaaattcactcgtgcgcatatgcatctacctgaaagggtcaattcggcctagaggctaatttaaaactttatgcggaagctaaaactgatataaggtcggaaagtctgatccacagtcagactatccgaaaatatcagatagtctgatgttggatcagactgtctgatccaccaatgaagcacaacaagtagatctatcacacaaacaagagtaaagcacaaatagcgactagatctatagcggcacaattaagcaaagctaaaaggaggatgaagggagatcaccaatgatgaagttcacgaagttgttcccggagttcaaatccttgaggggattctactctccgttgaggagctcactaagagccgggtctttgctaaccctttcctcaagaggttgcactaaccactccttccactaaggggtatctctttcctttgcggaggcgagatccggccttcacaaacttctcccggccaaccacacgtagatcggtgccttgggagtgacacctagccgtctaggagttctcaacctccaagagtaacaaacaccacacaactcttggtcaaaccctagtgctcaagatcgagtgaaacacacactaggccctcaaacaccaaatccacaaccaccaagatccaccacacaaagaacaaggagggatttgagagagggaggaagagctcaaagatccaaagcaccttagcactaagctcaacccaaagtgaatgagaatgaaatgagttgggtcaccctagaaaagggttaggtggggggtatttatagatgccccaaaatgtggccgttggaggggaatctttcagcccacgtcggatagtccgatacaagatcggatagtctgatattttaaacctccaaggcaacgagaaacagagaatgaagttccatgaaattttggactttccgagacattggactatctaatgttaaattggagtatctaatattttagaagtaaaaacttcgtcctcaaacagagacttaagttctatgaaatttcggagtctttgtatcatcggactatctgatccgacatcggatactccgatacttagaaaaactcattcgataggattttttcaaatcaagacagttctgtgaaaaattggatagtccgatacatcggatagtctgatttcaaatcggatagtctgatgttgctcaagtaaaaatgcaataactttttactccgaactccgatttcgaagatcttggactctatggaaagctagtttcgtgggctatcaaacccaacataaaacatggtccaaaaccttcaagagattttgaaaaacttgcaaaaaaacccggtgtaagtgttgtgacgagtgaaacaactcgggattgaaattttggcttaggtttttcaactcacacaaagatgaagcattttgagcactagtgttctaccaattatatgcatgtggtatccctcttaatagtacggcattcctacgacacaatgcaaggtaaaagatacaatataacatttgatcattgccgcattgcatcttgatgtcgcattcatggggtatgcatctcattacaacatgtcgaggacataacaaccttcacatttgcttgaataaaagtgttagtcctctctaatcgcattgtaatcaatcatcaaaattattaggggtctagatgcactttcactaccaaactagatttgttgctaaattgaattgttatgtcattatatatgtagattttatcttcatagggcctataaaacacccttatacaagatttttttctagttattcaaaataacatgtttcgcttgaatagggtattgtcggcgtagagttagaaactagggatggatgatgcacttatataaaaaagtgggttgagattcctttcagcgaatggggtactggcataataccttatcgtgtttttaatttcattaaactaaaaaaataggcttaacttttactcctacataagaaaaaatgtatatgtaagcaatgacatatatataagaaccaatttactatgcttgaaattacaatggtgttgtttcacttttcctggctgcagcagcagtgactgtcggctgtaaccattgaaaatggctgctaacggcaacaactctaagctactaaaacaaccatcactattgatcactaccaatatccatacctctcgccataacataatccgacttcattaaatttttcttatttcacctatataagataaacacaaatatatatatattcctacaccccatgtctaaagtctgatcttagatcattgcatcaatcttgatctcaccaacctccatgagagagaagagatcaaagccctcaatagtctttggtatcctaaccccattcatcatcacgtgcaattaaccaacccatccgcgccaaattacagaaaagcccctccatttctcaccttctcgcccaccctcccgtccatgtccatggtggtcgagcaccaccggcgcggccaccgcgagctcctcctccccctctaatggcgcagtacaggcagtcgggcggcttcttcgactaccgcggcggccaccaccacgcgctcccggagtaccaccggcccctcccgcacgcctccaagccgtcccggatccgccgccccgggaagcccgcgcgccgccgctcgccggccgcggccgccgccgtcgcgtccgcgctcctcctcgccggcgtgttcctcctctcgcgccgcctctcccgccaacccgcaggttcgagatggctttgacgccgcagcttccccccaccgtggtggtgtgatccttttctttctttctctttttcttttttttttccttttcaagaagaagagagaaaaaaagtttgatgtgttcgggggctcggtgcgcatagagagttctcgatccgatttcgtgtctcaacgtgatctcgtgtgcatttttcgcagagatcagccaagatttgggcggcggcggggaggggttaccggagtggaaccggagcaaggagctcaagttcggccatggcggtggaggccggagcgcgcaggattcgaggtactgggaccgggacgatcggaggcgggacgaggactactcggaggacgagaaggagaagatctcgggtgcaagtggaaataatgccggtgtcagtgataaggttgtgacctctgatcctgctgttgaggagaaagggttgaccatggataccggcggtgccgccgataaggaggctgctgaggtagctgaaggtgggaaaggagggaccttgtacaatgaagggggcaggaaagagctcgagcagtatgaggcggctgcgatgggagctgcgggtactgggatcagggaggttgatccggatgatgagtatgacgatggcattgatgcacaggacgatcttgatgatgctcagtcgcattcatctgatggcgggaggaagcttggcgacagtagtcatgagagcaccgagagtaaggaaaatatagctcatgatagcaccggcaataaggaaagcatcgccttagagagacgcacggaaacaggtgcgggtattagtgatggtgtcgatgttattgatgctgctaatgtgaaccaaaagaaggtttcggcgactggtgataagaaacacgcgtcaaaaaagaaatcaaagcgcaagaagactggtgagtttgttcttccccaaatttaagtgctagagtcaggcgatttgaattcagaaacctgatttcttgtttagcttagtggacatattgatcctgctactgagaataactaagctttctgcattttatttctgtttcaatagccttctgtagtgtttagaggtaattctagcttgcttctatgatatcagaaacaccaattatggaatctggttgtaagaaggtactaactatgtgctattcatgttcgatagacataaatcagttagtcttggacattttagagtgccaactaatctgttagttccacaacattagtatcctttaaaatgaagattgagatgttagtagcacagcagcatcatgttgtatttatgtagtgcttgatttacaatgtttatcaatatgatctattgatttctacgtttgataatttggtatcacataaaatactcttggtatctagcctttgttattatggatggttttctaatctgttggataaacataaatcaggttcaacttgtgaaatgaggtttctgaactccactgctcaactcgtagagcctgctaaaaatgagaaatttgctagttttaatttggaatatgtggaagttgaagacaaacctcttggatcagagtattgggagccaagatttgctggccaccagagtttacaagaaagagaggaatcatacttagctcatgaccaacaattaaattgtgcttttgttaagggtcccaatggtacaagcactggttttgatatctcagaggaaaacagaaagtacatgagcaaatgccacattgcagtatcttcctgcatctttggaaattctgatcgtctgaagactccttttgggaaaacagtatgttctttttctgtaccaacaaactcctgaaaaaattatgatacccctaatcctgcatgagttacaaccaatgtaactcttgtcaatgtatttattttggttctcttgtatattttggcaatcgcaaaattagcgttctttgcatgatttgtcttagaaccttataatctcagtagcttcatttttaccataggtacttattggctctgttagtaggcaatgaaacataaaccttatataataggcctgtgaaatgcaactgaaccttctgcaatgttagtttggatatacatgaatatataacctcaatctccatacttaggttaaacaattgctgacctttccattctgttgttccaatgctccctgaatctttttaaatgcttcagaagttgatggaaatctggtaatatttaagaaataacttcatatgatatctgtctacgcagattacaagtctatcaaagaagacagtatgctttgctatgtttttggatgaaatcacattacgaactttggaatctgaaggccaaaaaatggatagttcaggtttcatcggtatatggaagatcatattgattaagaatatgccttataatgacatgcggagagtcggcaaaataccgaaatttctggcacatcgtcttttcccatcatcaaggtaaaaatgaatgttcttatatatggtggttgtacttttttttttccacattgaatccacactgtcatgtttatgggccaatatcattcttaatcctcagctgaactgagctagtaactcccctcccccaagataaatcaccttgggaaatccaagcagtttaccagctggttactattttttttatcaaaaatattggccaacactaactgccagaaaataccagtagtttccagtcataaaccggtgccaccaggtggaaatctgttttcacattctgccctgtccctatcagtatgcacattcctgactgcctcgctactagtagcaatcaatcctgattccttcaattcagctgtatctgtgttgatgctttgctggtctcagataggttgagctcacgtggaggcatatgattcagtagtactgtttatgtttttttctgattcgttctttccaactgcattagaatcactagcacaaatgaccttaattcccacatgtatttattgcccttttcaagttaagaaaaacaaattgagaagtcctccttatttcaatatttagggtgttttcatataatcatttgctgtgccacattatatgtagagaaacacacagcaactcccaatatattatgctgtctgtcctaaaagtgtgcatgaatgtgaaaacatgacatcttgatgttaggtgaatgtgctcatttgaacaagtattgcttatacttgctccttcaatttattgtgcttgttttaccaacctgtttttgcatgcctaaagacattactacttgtgtcaggttctcaatctggttagacagcaaattgcgattacaaaatgatcctatccttatcctagagtattttctttggcggcatggctatgaatatgctatttccaatcattatgatcgacactgtgtttgggaggaagtggcacagaacaaaaggctgaacaagttcaaccatacaataattgatcagcagtttgagttttaccaagcagatggactgacaaagttcaacccatcggatcccaacaagctgctaccaagctgtatgcattcttgcctgctagtttattgctagtgtatgagctattttgatctaagtttttcttcttctttttttttttggttaactttgtacagatgtccctgaaggttctttcatcgtgagggaacacacaccaatgtccaacttattttcatgcctatggttcaatgaggttgatcgattcacacctcgtgaccagctcagctttgcatatacatatttgaagcttagaagaatgaacccggagaagccatttcgccttaatatgtttaaggtgggtacagttgaccatctagctagctagtttgaccgcaaccatactaaatctaatttacatgctattctcgttcaggattgtgagaggcggtcaatagcaaagttattccatcatcgatcagaagagagacgcagcagtccacaactaacaagatgacagagattctttcggaatgggtggtgcaaggatattttaggattttacctttgatatagcacaggatggcacaggactattcagtgtcaagatttatgcccctgctgaggaatttaagcctaaaggtcgcaagcgattctactcctttactctatgatcctgcagaccagttcctgccgcctttctattttgcacttgacaaaggcggattagggaactatggccgtttgattttcgtaaattcttctgctctcggtaaagttttgttcattcttttggggtgatctgggacaagtggggcatgaactcccagaactagtttagcactgtgtattatcatatggttgttaaaagaactaccaagtgaagacatgattccgatgtaatcctcaatggtcttgttgaaatgtaatactacaacaggaaacaaaaccttctgtaatttctctgtgatagcaaactagcaatttttttttgtctgaatttgtggaatctccaggcttcccttgtgcttttgctagatcagaactgagaatgaataagtgatcatctgtttgttttttgttccatgtactacagcttgctgcaattgagcattccttcaacaatgaagaagtgaccatctgattgtgttttgtgctctgaacttcaattcacctcttaactgaacatagtttactcctgcatcaactgcaatgtagatgtgaaattgcatctggtgtttcatctcttttagcagatataaaacaaatctaaacttcagatgctttattgatcagtatgtcacactgaaacaagttacaaaccaaaggagaaattaaagtataaaaggaaaccaaatataattaaacaccttcataaacacatactcacacattgcaagaagctctaaaccctcaacaaaacaactcaaattgatcagtcaaattagcatccaccccaggttacatacataccctgctggtttccagattgctcaaggtcaattaacttttcagagattagctaacatctaaaaattcagcccagtgtgagggccttatctctgaagatgccaagcatctcattcctgcccttgatcacctcatcaaacacttcatccaaaacacaatcaaacatctccacaccttccctgagctcacctgatcttgttcttagaagctcaacatggtcatcttcttgttcttgtttgccatttttggtctcttcttctccttccatcttggtgttgatcatcatggacttcaccaccatggccaccctctcgtgctcggcgacgcccggccgcctcgggaaccggtcggtgatcacggagagggattctcgccatggctggagctcggggaccgggacggcggcggcgcggccaagggtgcagtggccgtcgtcgacgtcggcggcgagggggacgatgggtgaggtgagggcctggagcacgaacatcgacacgacggccatggtgatcttggcgacgagcatgacgaccaccatgccgccggcgtcgtcgtccccggcgccgccgccgccgctggagctagacatgatcttcctccctagccgctccgcctcgctcaccgccgccctcacgtcggacagcctgtggcggatggcgcccgcgtcgtcgccgcccggctcctccttcagccaccaaccgccggcgccgccgccgttcttcgcggcggcgc

SEQ ID NO: 66509 - DNA, 1263 bp, Oryza sativa
agacgtgttgtcggagtcgtccgtcaagcctgagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattagacttagtatgtaattattgactacggaattggggcgacaagtagcaattgactattgtagtcttaattagacttagcatatacgcacgaaacacttagcatatactgactattgtagtcttagcatgtaatattatttgagttttaatataagattattttatttgtaattagacttagtatataattatttactagctagggttgtacaatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgacacaatcgcggagggaagcagccagtactggaatgaagaagaggggaacgaggatccaaaccagtacttgaacgaggaaggaaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcgacacatcataacggaagtgcaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcagg

SEQ ID NO: 66510 - DNA, 12904 bp, Oryza sativa
cgccggcgccggcgcagccgacctgcgcggcgaagtcgacgaccatgcagtagcggtgcagccgcgacacggcggacttgaacgcgttgcagaagtcgagcagcgccgccgtctcctgcatgtagtgctcgaaccagcacccgccgccgtcgccgcctccgccgccgccgccgtaggagacggcgctgcccaccggcacgtcggccttcttgaacatgaccagaagctcccgctgcatccgcttcaccagcctcatggcgtcggcgcaccacctcatcgacaccgccccaccgccgccgccgccgccatcgccgtcgtcctcctcacgaagcagcgtgctctccagctgcgcgaggccgtccaccagcgaggcgcaaaaggcggcggtgtcgccgtcgagcagctggcatcgccggcgagcaccaccaggccttaggcatctcatcgtcgtcacgcatgcaacacaagaattaaatcaaatctcaagaaccaaggatcaaacaagaaatggtgaattgggcatcacttttatgttgtgcaaatacaacaatataataatgatctagtgcaatttgttcatttgcatggaagcaaagttgggtttcttggaggagtaggcaagattaattttttcaaaggaaagaaggggaggagtgaagcaagaggataactaggtatgcatactattccatgcatacacctagctttaccttaccttgcttaattagcacttgtgctcttttgatttggcattcttgttcttggagtttggagattggagacaactcaccaaccaaccaaccaaccaaccatcctttggggcttttagctatgccaggtctttgatttggatgtagtggcaaactggcaactactaataacttatagattgacttgtaaggatggatggatgcatggggccggccctttggtgccttgcagggaagaaatggtataatttttactctcttaggggaagtgttttaagctcttgagggcatgtgtccttgttttcttacgtggttcaagtaattaacaaaaacttaaaataagatttagacaacgtactttctccgtttcatattataaaactttctaggattgtacatatgtctagattcattaacatatatatgaatgtgggcaatactagaaagtcttataacctgaaacagaggtagtacattattatgatacgaatattagggaatgatctaatatcaaataattacaaggggtgagacttcgaacccaaatcgtctagcccaacacgtcttgtggagctagccggaagacccctgagcgtttctcaacatactttattatgccatgtgtactttcacttgcaaaattaaatttgatctatatgtgtatgtgaacgaaatttgatctatagatcagagggaagaaagaaagtgcagcagttgcattcacaattggatctgtttcatgcactcctatacgacatatgcattggcattgcatgtactttatactttaatttgttgcaacgcattttaggtttcggtactggacaaaactgaggtgggatgtcatgtgtgatgatttatattttgattgtacaatggagtacactaaaagtactccaattaatccagctgacatgattatttgaggacagttagttcatcattctttccaaaagcacattcaccataatcacatctctaaaggcatccctatttttttttcagattattcgtcggattattaaaaacagattatttgctctctaaaagcattcttctgcagtattaactgcttagataacttatttttaactatttattaagtttgtttctcataatgtttaatttatccctatgatcaaatacacaatttgtggtaataatctgctctataatcaaatgactaatacatttggaaatctgaattttatcacaatagagttggtcaattttatcacaatagagttggtcagtcatgtcagttttgttaataatttaagatgtataggacacatcatcgtatatacctcggctgaaaatgtggtagctaggtagaagtattcagggtttaaaaagcaagtcacagttagttaataataaaagtctaaaaaaatatgatagttcagatcggcatgacttaatatgctctggggtgagacaaaaataaaagtctcctctttggactgcttctataattctcattaattactaacagtaaaaactttctttcacgccacaaccattaaataagctccgtaagataagaaaagaaaaacaaagtgaaaggaaaagaaatggaaacggtcagagcacgcttaccggtaatcacaagtcactggcgtcctaagcttaatttgctcagctctgacctttcttatgcagccgtgcatccaaaccgtgcggcaagaaaacaaactatgcggccatgtagcgatgttgaccttgccacgggattcacgggatgtggttgttatagtgaatacacacttggttctactccctccgtcccataataagcacagttgtaagttttaattccaactttgaccattcatcttatttgaaatatttttataattagtatttttattgttattagatgataaaatataaataggactttatgcatgacttaacttttaaatttttttcataaaattatcaaataagacggatagtcaaatgttgggcacgaaaacttatggctgcacttataatggaacggagggagtagtaaagtataaaaattctaattctatttatgtcctaagttgttgtctcaagtttggtcagacaactaagcaactagccaagtttcttatagcggaaccagttcgtccgaatttaagttctagagttaacacggatgctcatatttacgactaattatttttttagtggtaggcgacgtactcatcaccaacgaggtgcccatggtgattttgtcaacctcaaaatatatgtcagtccagttttttggaggtgcttatagaagtaggatgcgcgtgtgcgtgttcatagatacgagcgtacgtgtattgttagcatctacttttataccgtgtttctaataaaaggaaaataataataataatatttacagtatcaaatgagcatcattacatccatttgaaatatatattttcatgatttacttccttgattatgttagatgttcatactcttctcaacaaaattaaagaattggatccttagtttaacttagaaaaaaatatagaatcccttaaattttaggaaaaaggaagtatctaccaatagctaatcaaaatatggaaggagctcgaagcagcttctaggcacgcctccgcaccctcgccttatggccggagatgctacgaattcagacctgaacgcgggtgttcatgcccttgccgtcgccatgagcccataacagtaggaagatgggagatttgataaagagacacgagagaagtcgttgctatgggattcgtgaggacaagtgtctcatgcaggaagcgaggtccttcgatgagtaattctttctgtacaaccctttaattttaactagaaaaagtgtccgtacgttgtaacgggaagaaaaaaaggaaaatctcgctggcagattcggtcgtctggagcagagaaacgtgagccgtcttccatttcgaaggtagagtaagcagagcgcaactgattggtgacactgaagatgatatatgttttttcatgatttcacatgtgttatgtcttggatgcaactcatattccgcttattgttgtgctctttttcaaggatttgtgttttgtcacatcctgatttgagtttaagggattttgtaaattatttaataaattatttcaaaatttatattaagtttcattaatttacaagtgaagtttaatatgagaaatataatttcctaattaaaacatggttgtgtttaatcattaataaattctccatgattaattatactctttgaaatttttcaattattaattttaacaatacaaagaacattttcaataattatttaagcaattattaatcattaaatgatctagataaatatttttttaaatacgttgagtatccaactattttcatgatttttcttgaaattattagaacattgaaagtgtttttgaaaattcaaagttcatttcagtgattaatttaaatgaaaaagtagttaaaatcgtctcgtcttggaccaattcgagtaaagtctgctttccgtctctctctctctctagcaggctttacctcctctccggtgaagtctaatctgtctcctccttttatcggcctgtttgctttcttcctttccccttcggcccagcagcagcagagcaagtctagatagcgtttggtgaaaaaaaaagtctagatagcgttcctcggtctctcctctctctgtcgcccagggcccatgtgccacagtcttcttcctacacctccagaccgaacccccgtgcccatgcgaagcccgcgctgcctctccttccaatcccacctaccgagggatgaaactgttcggatagattccgtccgtctggaccattttttggattcgaataatttcggtcggaactatccagaaattttcggattcggaaacgaatttggattattttctcggaaacgaaaacgaatacagtaagggtactatccgtcggaatcggaaaacggtcagaaactatccggaatttttttcggatatcctcagacattgataaaattttagaaaaaacacgtatatatacataactttttcatacggaatcagatgaagacaaactttatatcaacattgtagatctcgatgagatctacaactttcttattgactattttattatttgagatcatttaagggtctaaatattcattataatatatcatattaatttttacaaaatctcagatctacaattcaaacaacatctgatggagatgtgttctatatcaaagttgtagagctcaacgggatctaccactttgtagtttataacatttgtatttgaaagcatttaaagcataaaacaaatattgcaagtttcgaagatgtaaagtaaaataaataacatctccaatttatacaatggcaagtaagttatacatcaagtaaaagttcttgagaattgaaaatgataatcatatttgcatatggatctcttagaggaacaaccatgaaaatcgattttcgcatacggttgtgagaccgtctacaaaattgatgatataaatgttggagatgttgaatgatatctcttccttgatcaagaaactcaatttgaggggctttttatataccagtaaatattcgccaccgtattcgttctgtctcgtattcgctccgtatctgtattcgataatattcgatttcatttccgtattcgagttttcgattccgattccgattctgaaaaaaaatatgaaaacaaatatgataaaactagtttccgtccgtttccgatccgttttcatccctacacctaccctttgctctctttttccaaattggatggaaaaatgggttcccctcaatctcctctaccctttcctcgaaatagacgaaaattatgtaagactaatgaaaagttatcaattttttttaagtagtaagatttgaatttccaaacgtttggcttatggatcttcgtgccattaaagatatcaacctactgtcccatccgttcaaaacctcagctgaaaaatcagagtcatcaagatttaaatcaatacccctcgaatttgcaattctgaaattcctgataaatggtggaaggttactgctcacttccttttcgctgccctttggcccaactgattataaagtcttgaggaacattcccttgttatttacatatcatctaaatagttgtgattttttttaaaagaagtcaacaaaatagatcaattcaggcattcagctagtgacaaactacaaaacggacaggaatagcgtctgcaagggttcataacaattcaaatcttctagtactacacattactgctcgttgacatgtgggcctgaggatatgtgagggccacatgtcagtaagcaatactgcaaaggaccctctcacttggttcataaagggtattaaagtggggtctaaattgtaggcatgtcctaaattggaattttcttttattttttgtacttgtgttttttttatctttttaaaaaaatcccaaccaaaacttattttcagaatatgaaccttttgcataccaacccgtctgacgtgacaaaacaatattgacacaccacacattgcaaatgtgacatctttatcctgctacgccagctagaccggcgtgaccaaataacgctgccacgctagccagagtggcgtgtcagtgttgttttgccatgtcagtccggctggcgtgataaaaagtttagattctaaaaataagtttgggaagggtttattttaaaataaaaaattcaaaaagtttttttttaaaaaaatctctaaacggagtagtttaaacactccatgcatggatacctctgaacattttactcggaaaaaaattcctaacattgagtgcgtcgtagacgggggcggagaggctcggctaattaatgcgtagtgtctcggtttgacattccccataagaaaatatatctgacaatatacatatgtaactcaagataattgcatgtaccaacgggtttagacagtaccggctgaatgcaatgtcctgtagtcctcttcttcatcttacccattatgaagttgcccgccaccatcgtcatcttcttacccataaaaataaatacacttataaagaaacacaagtaatatagtagtgaaatcatgggtgcataatttcaaatcttaatatccataatattacacactatgggtgggtttttaatggcaatttagtgtgatcgatacatgatatacagctggtttcggtctcttaaagtatgtgctaggacacgtattcgtggggtctaagtgtgtggtacgtgccatagaatagaaaaaagaagtaaactgaggtgaaaacctataattaattacggttaaacacagttttttcgtatctgggtaagatggatgctctcgaccattgggattgacctgcaaatcttttctcatcgacgatctgatccagagtatagtcagctactcctaagtaaacctgtcttcaatttccggagtggtacatacttcagcgcgtgacgtcgatcgatggatcccaggctgctcagagccgcacgccgcggcgacttcgcggggctcgaggctctacttctgggcgccgccgccgccgccgcgccaaaccaagtcgccatcgacgtcgtcgtcgtgcatcatcatggcgccgccgcggcccccgggcaacaagcgcctgaggcggcgccggtgccccacctcctggacgcggcggcgacgacgccgcagggggactccgcgctgcacgtggtggcggcctccggcgacggcgaagggttcctgcgctgcgcgcgcgcgatctaccgtcacgccgcgcgcctcctggaccgccccagcgcgagcggcggcggcggcgacacgccgctgcaccgcgccgccagggcgggcaacgcggcgatggtagggtgcctcctcgacatggccaggcaggaggaggaggagctcgccggcggcacgggcggctcaagggtagccgaggtgctggagaagaggaacgctcgtcaggagacagcactccacgacgccgtcaggctgggcgacgagcagctcgtccgccacctgatgtcggtgcacccgcggctcgcccgtgttccggcgccgggcggcgggatgtcgccgttgtaccttgcggtgtccttgcggcatgaccgcatcgcggaggccctgcaccagcaaggcggcgacgaggtctcgtattctggaccggccggccaaactgccctacacgctgctgtcctacgcagcgcaggtaattaagttcaataaatcaaagatataaccgatcaatcaaagatactcctccgtcacaattctactgctcttgaagaggtagcattaggtaaaaaaaatttagtctaaaatctgtacctcatagtaccttataatagctaagtaccaaaaaataccaaatttataatagaaaaaatggtatctcttggtaccttctcaaaaaccgtaaaattgcttcttaaaataaacgtagttatgagttttcgtatccaactttaatcgtctgtcttatttaaatttttttaaaagaactaaaaaaataagtcacgcataaattactatttatgttttatgatctaataataacaaaaatactaatcataaataaattttaaataagatgaacgatcaaagttggacatgagaacttatggttgtacttattttggacggaggaagtatatatgaatataatgttttctcatcatataattattagttcagtgaaatttactcataatataaattcaagaaatgacagaaaagatactggaatggaacaaggggctcgccggcgaagccgacgcgtccagcagcacagcgctccacttcgcagcagcctcaccggagaacaacccagagaccgacagtagttcactcctccgccgctgtctccgctcgccgtcgagccacggccgccggacacccacccagcttctcctcgaggccgacccctccttacccttccgcccggacggcgacggcgagtaccccatccacgtcgccgccgccgccggcaacctgaggctcgtggccctcctcctcgatgagcactgctgcccggagtgcgccggcctccgcgacgcccgcgggaggactttcctccacgtcgccgccgaccggggcaggcaggaggtcgtgggattcgccgccgacgacaagcgggcggtggcggcgtcgatcctcaacgcgcaggacgacgacggcaacaccgccctgcacctggcggtcgtggccggggacctgggatcgttctggtgcttgctgcggaatcgcgaggttcgcctggatcttgcaaacaacgacggcctcactccggttgacctctccaggagtaccgttcctgcggggctttactacaaaacggtaaatctagactagttttttgaacattttcacttcaccgtttctaacgtgttaaagagtaaaccaaaataattttatacacttttaattgagaaaattgattatgattctaggagtgttggggtggggtgggtggtggtatattagccccgtttggtaggcattttgtcgaacatatatttttttttgaacgactagcacaaaccggtgcgaaattctattgatagagcaggaaaaaaaaagtacaagattataaccctggagagtcgtaaccaggaaaagaaaaaaaatagcaccacccacacgacgacatcgccaacacacacgccgcctttgccagatgacacagcagccaccacagctgccaccgccgtcgccaactgccgtcggccaattgccgccgccgccgtcgccacaccgtcgccgccgtcgccgactgctcccatcctccagatccagccgagaggcgtggatctgggggcatcgctgccgtcgccgccaggcatcgagccgccggccacagtagctgcgcctccgagcctaccgcggccgcccgcgcctgctccgccgtcacgcctgacgccgccgcccggccgcccgtgcctgcgccaccgtcgcgtttgccaccgcctgtcgcggccgccagcgcccacgcctcgccgacgccgtgcccgcgcctccgcgaccggatccagctgcgagcgcgccagatccggtggtggtgacgccggatccgccgccatgcgcctcgacgccggcgccgctccggtcggccaccgcctttgcgtccacccgcgccaggagctcgggagatggccaccgcgagccccgccgccgccgtcctcgcgagccgccggctttgccggccgctcgctcaggcgacggcaaggcagaggaaggggcggggaagggcggcggcggcggctagggttccgccgcccgagtcgcccgacgcgggggccaggagagagttgctggggattgatgtcgaacacatagttggagtcgccctgccgctgccgctgccgccgccgctgccgctcaacccgcgcgccacgcccgcccctcccgtgcgcagtgggccgccgccgcggccactgtcgcacgcccggccactgccgctgctgcccgcgcgcctcccgtgcgccgcgggccgccgtcgcatgaaagtaacgtaactaaagacatgaatgacgattcagatttaactcaagaaagatccagctgctaatgttttctaggtgatgtggttcaattaattcatgttgagattattttttctccaacatatatacaatatctgtactgattgtagtaattttgttcatgcagagcgcacgaacttggatcctctggtctctggtagaaagcaacgcactcggcagcaacttccggcgcaacgatcacttcgaggaggagtacgtccccaagaaagacgagagcgccgagtcaaagaagatgacggagtcgacgcagatgctgggcgtcggcgccgtcctcgtcgccgccgtcacgttcgcggtggccttctcccctccgggcggctacggcggcgacggcggcggcgcgccggcgctggcggggcagtaccccttcgacgcgttcatgtacgcggtggcgatagccttcgcctactccatgctcgccacgtttagcctgatgtactccagcacggcggcggtggactggaagctccgccgcgcgtacttcgagcggtcgctggcgtggatgcggcagtcgacgaggagcttgctggtggccttcgcgctcggggtgtacctggtgctggccccggtgtcccgcaccacggcgatcggcatcatggtgagcgcctccggcacgctgttcctcaggaacagggaggtgctgcggatgctgatgtgcgcgtacgtgctgcacaagaggatggggatcatggtgctggcgaggattggtgtcccaatggccgtcgtcctactgcagtccagccttatcttcgtggttatctttggtgcacccttgtgtcctccgttatgccttctggttttcgttgggaagctagtgcatgaggatgtctcgttcctaagatatgtaaatggaaaggttggttcattaccttttcaataaaacttcagagtaatagtttaacctgttagagtttgtgtcaaatatgtattcatagtcagttacagtttagaatttgaaattgtaataggtataagttagagttagagttagaattggactctatcctaggctctatctaaatagagtggcacacctattataaccgcatgacaaattagcatagcgagaaggaacggttgccgacgacgtccggtcgttgtaatatgttggatgggggaggagtgactgtaattagtgtcccagagatatatgctttggttgaactccgttatcaaatatcatgcatcggtgtcgtcatcgtatttagatgtcctatagtatttcttgcgcatttgattcttgatgatgttttcgggccggttttataacactatgaaatgaatatgcgaatgtctgattccggattcagaacattattctttcattgtagaacctttatccgcataaacattcaacgtttagaaactttctacatagaaattttcaatgtaggaactttctacactgatgtcgaaagttactagtaacatgttttgcttacaaacttactactccctccatcccaaaagataattacagattattcaggtataaagtttctgtgcagaaaatattaatataaactaacctctcaattcaaccaatttattttccaaactcgagtagctatgtacatacttctaacttctaaggatgagagaaacctcaaacatattgtatgtttattacgattcatagcactgaaatatatcatattttgtattatgtttgtttattttgggacttaaagagtagaggggtatgtgggagaaatgggacccagagtacccaccaccatctactcgcggggcacttctctgtttgggcatggcccttagtaggctgctcataggcagttcattccccgggcgtggccccacgtgggttgagcccggggcacttttttccccactggctgtacttggtacacttctctgctcgggaattcaccctgtgagttgtttcagctgactaagggacttaccatttttcagttgattggttattacacctctaattccaaatataagttagtctagagactaaagatgtctataacaattaaaaaaagataaactatttgttacaaatacgttttagattttgaatagattaatgcatgaatacatgtgtttcatatatgtattcaaattcatatgagtaaattttacaaaactacatacattttagccaaattatcacaaaactacatatttaacatgatgaattacaaaactacctatttaggagtagcacttaatttatcccggaattataaatttaggtaaaatatcacaaaactataagttttatatcaacttttaatcacaaaacttatatatataaatcaaacatagcattagtgctaaggatttggaccaaaaattttgtagtttgtgattattttattattaaatatgtagttttgcgatacttagcctaaagcctatagttttatgataagtttattgctaaattctgcagttttctaatatactagatgcacttttaaaccccaccttgcccactccacaaggagtctaaatacactttcgatggcccggggagggctatcgtggtgttcctactagcctaaacatgaagacgtgtttcatggggtcccacatctccgccagatgcggtgccaggtggccgagcatgtccatcgcatttattatggattt

SEQ ID NO: 66511 - DNA, 16353 bp, Oryza sativa
ttgcttcgccatctgttccatcctggcggcttgcgctgtttgaaatccagatgattgaggatgcaattatgacagcataaatcaatggaacagatctggatgattaccttttgatgaaccacttagttcgaagtttgcatcctggagctgggcgattcggtcccttaactctttctctgtctttttggcgcactccctggtctcatgcagctggtccctaactgcttctagagttcccaaatgaggaaccagcttttccaaagttgtagtcttggcctcattgcgaagatggattctctgcatgatggatcatggttcagtcctgctaaaaagaaaacaaagttaccgaaggccgtcactcggaagacttacatttacaatacgagtggcttctccgagcgctttcttcagctggcacacttcttcatcttctttttgacggtttatgactatgccggcggcttgtgagttctcgtcccaccatttgatcaagataggaggacgagagtcgtcggtcgcctttatacgagggatttcttctccgtcatcacctgatggtcctgatgtgtttccaagacattagacggatatactgaggttatttaaatcaccattgttcgagaagacaactaacctgaagatgtacctagctgagcgtgaggtggtctttgttctttacctgaagacccagctatcgagtcgttaccagcttctggtccttgcgaagtcgtcgtctgcgcttctacctcggggatctcttgatcagggcctgcgtacgactggtttccagtcgggggctcttgagttgttgccgtttcagttgttgccgactggtttccagtcggcggcaggtcactcggattggccctatcgcccgaagcatgggcgccagtcggctggctttcagcggtcggctggttttcagcagtcggctcggggtccttggatatattttgctctgtcatggcaggatcggggtcctttccagatggatctatatcagatggtttcctgcagagtgttctttcagtatttggcattatcttcatcggaaaacatgccgaagcggaaatcataccgagagatctaatacctggaagatgttctgatctttggcattgcacggccagccaattttttcctgggcatggtgcgctttgggggtttattagacaagcccttatccccagatttatcatcgtcgccttcatcatcatcgagtaccagctttctcttgcgaggacctgtttgaccagtcaatttggaggtctgaggttgcggatctggtctgatcgttagccctccacctccctgcgcggtgtgttggcgaggagaccggcgctgagtgactggtggatctgacttcatcaatgcatattcctgaacaagatgcttccatagttagtcaactcagcatgaagataaaattatgttctgatcacggtttgagggtttccgatgtatacctgtggaggcggattgaatgcattatatggcacaactggcaattgatgagagtagctgactacaattgcatttgagaagattttatacatcctctccttcatgattttgaaatccagggaatctggttcttcacggttgggatcatgtttgccgtcgaactcgaatgctgtgcgggatctttccttgattggcgccagtcggcatttgatgaagtgccgagtgatttgctctccctgtaagccttgttctttaagatttaacatacgatccaacaactccaaggcttgtactgcttcatctccgattggaagagagttccaagtatcttggtacactggaggaagacaagagtacccgggaagagcaggctcgggattctgaacatagaaccagtttgcatgccatcctttgttcgaagtcttgaagggcatcgagaaatatttttggctcagagttccccttagttggaatcctgcccccccgactacacacggtttgttcttgtttggttggggcttgaggaagaagatccggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagatcctcctccgttacgtcggacgacgcccattggccttcgaagctttctctctcttccgccatcggtttcactcaaatgtgctgatttgattcgagggatggcttgggagaggtgagggattgaggcggtggatcacgggaaggattttgatgcacttttcggaggtggatttggccggagttgtgaaccctagttcgccggcgcagctttgcactgtagcagggagtggggaaaatggcgagagttccggcggggaagacgaagcgccgcttggatatcggatttttcagttaagggtatcggaggtgctaatgggcctaggcctgaacagtacttcagcccaatacttttaacagcgtggcccattgtgttccttagggacttaggcatattttgctttggcaatattatgcacacaacagtgttgcccaatgctgatgaaatcctttttatgcggtcatataattctttggaattattgcaatgcaagttaaaaaggtgtccgacagaaaggcgttatgctgtttttgcaagcttttttaggctacaaaagctgtttgggttaactaggaatgacttgtttttattatagtcatttccttggcgtgttatatgcctgttttcatggtaaatagtcatggcctaggctatttgacttatttattaccataatctttatggtacttgatgggtaatctttagagtttttttattcggatgcctgtcaagtgagttcattcgtgaaccttttagagtgtaaaccactcggatttcttttattgtggctaaaaagcagtcggctagcatgcctatttaggcgccgcgtacgcttttgtcatgtaatgcacaatagtgttattattttgtctttcaactatatgtttagtttgttaactaatcacatagttgggggctacacctaattaggtgcatctattcgatgcaccatattctttatcttttcgccctttacagtccactcggcagattttggcttgaagagtttgaagtactcggattatcatctttgagagggttacgatggtcgactgcaaaggactcgggggctactgtggagattatgggtatcccatatctacacggcgatggtattcgaactgggtacaggatacctaatgtagatagaatatcttatctgtatctcgggtttgtttcttaacttgtgtatcaaggaaacaccctgagacttagtcggttacgactgtattttacctttatcttcatattccgttaggaatatagattatcttttgtaatccggactccttccaatatataaggggggtccgggcgcctctaggggcatatgctgatttttcccgaatcatacaatcaataatacactcggcggattcatccccggacaggagtagggtattacttcttttataagaaggcctgaacctgtataaatcctttgtctccaaacccatacactttccaagcttgatagccacccccttttattattgccgaaatctagtttcgacaattactatccctgattctctgtttctttagataataatctctgtgattctctgttggccttggcagaaagcgacaattcacatctgctgcagaaacttgcgagagccaacagccaagcgctcttttcctacacgaagcaaaattttgagagcttaagattcaaacagcttcttggtagccagcttctgataatttaaaaaagccagttttcttagcttctggtttctagttcattttatgaattctacaactacaacttcttaaaatttagaccaaaatctatattatttgaagaagcttctaattctgaaagaagttacagtagcaagaagctctctaaacatacctaggcgcgtgtaagtgtaaccttgacaagatcctggaaatggcgctgtcaggctttaattcggatgagtcggacgtgagctggacctgatgtttttgcccggtcttacgtcctaaacgcacttgtaatctacagtcgcctcgaattgacagcggaagcggattacgacatcccctgactagcgcggatctcaaagcatttcatgtacgtccctgattccattttttttagctagtgtatgctgtttcacactctggaatatctgtgtcactgtccaagcttcgtgtaggcagggttcgtaaaaccgaaaggattttaaaaaaccggttagttttcgtgaaacctttttatcatcagttcgtgaaaacagtcatttttagccggttttcgtatcgcgttgatcgaggatcactggttttatcggttctcggcaaatcaatgagtgattttcactccgaaaacgaaaaggcaaacgctgtgtgtagcacctaggagtatactactcctctacttgctcattcgtttacgtgtatctggcggtcaaacgatagtgagtcggtgcaataggaaaaatcagatgaaagttatctgttcagcttcaaaatcacatcccaggtgacacacagacagcacaggaacaaggacacataacccaaccaaccgacatatcaaaatttagttctggtttagttttcaactttttcttcaaatttttaactttttattaaatcaaaatttttctacacatataaactttcaattgttccatcacatcgtttcaatttcaatcaaaacacaccagctcgcaatacatgaatcgcgcacatgtcagtcgaatcgcacacatgtcaggtcaaaacgtcaaagtaaaacttggtttgcgagggatcttctagggagtgcagctctgtagcaacatttgcagatgccgttgaatgaaatgcaaatcatcagcacatgggctgcaaagtctgcaacgcaatgctttgcacatgttcagagttcttcagacccttgactgttaatctgttatcaacaacgagatgctagcacctcgaaagaaccaagaaactgtagaaggtggataaggtcacgatgatcacgccactcaaacgacatggacataatcatattattaatcttttagtagtagtatctaatcagatcttaaccttttcccccctatgacaaggatgttctgaactttctctaattcttgccgggttaaaaaagaaatgcaggaatcaatcgtcgcgtcaaatacaaagttaccacagcaatgatacaatcaccctcagtgaaaataagatgccaaaaaggggctaccgtacgaggacccttgcatacgatatggccccttgtttaaaaggtgacaatggctggtccacgcggaccataccatacaagcaaatcaagcctctctgtaaagcagcccaaaaaataaaaaaaaaaacaggaaaaacctctctgtacgtgcctgcgtggctgcgtgctcaacgtgtgcccgacaaaaagcccaaatcatttcacccttaataaaactataaaatacattcagaactccaaagatcgagaatccaaacaaaaacaagaaaaataaaagacattgtgatgcctacctttccttattttgcttgctttcctctataaatgaatgtcagagctcatgcctttttccttaaaaaacttgtgatgtctacccaacgtcttagaaaaatgccaatgccggagtgaaaaaaaaagtgagatgagcctagcttaaatggttatgttacttaggttgttttcttcccctatctttcccaactcacctctctcgttttccacgcgcacgctttctaaagtactaaacagtgcgtatttgcaatatatatatataggaaagtttcttaaaaaaatcatattaatttatttttcaagtttattttagccaatacctaataaatcatgcactaacggtcgctctgttttacatgttgtaagtgagggttcctagctcccactcccgaactcagcctcttatggcagaacacctcactcgactttaagttttagatttgatgcaggtactcgtatttatggttaaatttttttagtggtacggcaacgaaatgtttggtgtgacttcatcaatatcaaaatatatcggttcaaatcttccggaggtagttatagagggacgaatatttgcgcgttataaccacatttgtatttaaaaaatctaaaaagagaataaccctctggcaaaatttcccaccaaacaaaacgtctcccaagtcccaagaacgaaagggagaagaggacatcacaaaccgacccacccactgacgatccgggcccaccacgtcccgtatgactgtatgagttgtgacgccccatcaccgcagccaccaatacgtaagttgccgcacgagcgaaaaggccacaccaacggtcacagattagcctccgcctcctccctctctcctcctctcgccaccaaatcctccatagtccacaccccaccaccactccaccaccatcccaaccaacaacacttcgccatcacgccgacgccaggaggagccacgccacgccgcgccgcgctcgcggtcgacctcctcctccccccggtgccctgacgacgacatgggcgccgccgacaacgccgccgtacgggccgttcttggctctttcctctctctctgagtagtgtctactgtctactgtgcttcttcttgctcatggggttgctccgttgttggattcgtgcaggcgccgccgcggggagatgtgccggagaggggcagaggagggggggagccggaggcgaaggagagggaggtgaaggtggtcgtggtggacgagccgcctggggcgccggtggcgaggctgcaggcgcagcggccgctggcgccgctgcaggtgaccacgcaggcgccgccgccgcccatgtccgtggcctccggcggcgttgagccgccgccacaggtggcgactttccagcccgtcatgcagaccccaccacaggtaactaaacaaatgcccaatttgctgatttctttttggctgaatttaaaattcggtggtctctgaatcttcttgatttaaatagtgagattggctgagtcttttctacgcatgtggggtgtgtgtgcgtgtgtgagtgagatcaactgtttgtagcacaaaactggttggtggacatgtcaataattttgtttggtataatcaagcaactcttttgtatagttcaatcccctccacttgacatttcggcataaaaatttctgcgatcatgtggcgactttggctgcaacgacaatggcagaattggttttttaactagttccaagaaacagtttttagaggatacagaaagttgagtttgatctcgttttatacaattctaaaccacttgtactactattttactttgaaaagatttgattgggttttggatatattttgtggtataactcgtatctgagtaaaaagaaagttgaagtattttgcaagttggaaatgctttcaatcaatcaagcagattagcaatgtttgcactcagcaacaaccgaataaatcagcaacgcgtgcagctatgtgcgagcccaaagttgctcagcctttcggtgacagaaaaagataagagaggtggtagtgtttgacacgatttcttaatcaatgtagcctaacgtatagccttcattcattagatgactcatgtgtaacttaagctctaatacctccctaatagaatacctctagaatagagtaatgcactaatgcttggaatcgaatctccagttcaccgtacaagttgattttcatagcaattattccataggtaccaaaacctattgcccgttagattaagtagtagattaagcttcaggttgcagaacatgtgctaggtaatgtcctatgctaatccaatttggttgtaattgagtaaattaattaactttgagtgtggcaggtggcgttcgcgtcgctcaattcgcgcgtgtacaccaatggcatcacgctgtgcgtgttcctggtccacctcgccgcggccacgttcgccgtcgggttcttcgtgttcagggccgtcaaggacatcgtgcagcacccgcgttcccggaacgcgcagcgcgagcgaagcctgctgcgggaatggctgcctccggtggagggcgcggtggcgctcagcatcgtgctggcgttcgcgtggcagaaggcggtgcgggcgtggccgcgcgccatggtgggcgtcatcctgtggtccagcttcggcatcacgctggcggtgggcgcgatgctgatgtgcttctccatgccggccaccgtagggctcggcgtcgccatggtgatgttctccatcgggacggggctgtacgcgtgctgggtgacgcgccgcgtcgggttcacggcgcgggtgttcgagcgcgccgtgcagccggtggacaagttccgggggctgaacgggccggcctacctgatggtggcggccgggttcgtgtggatctccgtgtggtgcgtcgcggtgatcggcgcggcgaactaccggttcccggggctgaccatcctcggcctggtgctcagcttgatgtggacggcggaggtgatgcggaacgtggcgaacctgacggcgagccgggtgatcgcgctctactacctccgcggcatgcagtccagcgtgcagttcagcttccagcgcgcgctctcctacaacctcggcagcgcctgcctcggctcgctgttcgtccccaccatcgaggcgctccgcatcgtcgcccgcggcctcaacctcctcgagggcgaggacgagttcatgttctcctgcgcgcactgctgcctccacgtcatgaacgccatcttcgagttcggcaacagctgggccttcgtccacgtgagcttcgacggacacacgttcttcgttcttgttgctccatggtttaagtttgtggtgacaatggcggatgggtggtggtgtttgcagatcgcggcgtacgggagggggtttgtgcaggcgtcgaggagcacgtgggagcagttcgagaggctacaggggatgccggcgctggtggactcggacatcacgagctcggtgtgcttcctcaccggggtcaccagcggcgcgctctgcgtcgcgctcgcggggtcgtggacgttcgccacgcacaagcactacaccgccaccgtctcgctgctcgccttcttcgtcggatacctcatggttcgcaccgcagcttcgcgccccacctctctagacacattttctttcggagatttgttccgagcgagtgaaaaagtatctcgagataccgttacctcacgataccaaatcgtttccgatcgttggatctagctggacaagatggacattgttagatccaacaatcggaaatgatttgttaccggtatctctaggtattttttgttagaccgaagcaaattttttcttttgttgtgctcacgagaatttttgttgtgcagacacggattgggatggcgctgccacaggcgtgcgtgggatgctactacgtgtgcttcgcggagaacccgacgtcgcggctgttcgatcccacgataccggagcggctgcacaagatgcaggaaggcgccgacccgctcgtgccgacgccgcgcttcccgcaacaacaccccggcgccgcctgatcgcgacacaaaaaagctcacccgatcaacgagtcccaaaccctttggagattcttgcagaaacacatgagaacgaggtgatctcatcctgtcgcctgtgcagcctgagctgacccggtaggcgagactcctctcgtcgttgcgtgaatgggaggcaactcgagatggaatcatgaatcctttggaccatgctgcaagtgtaggcgagcagaatagtagtagcagagaatttggacccaacccctattgctagactttcccccttttcgtttctgtaaatttcccccatttttttgacaccaccgattttttgttagtgaaattagatgacaagcctgaacatttcatatttcaggtgtgtaaagaggtttcattacatctataggaaattcttgtgaatattatccaactttttttttatccttttaaggtcatactcctatttgtttccaagatgaccatgatgaagtcatgaactggaccttataattgaagggcacagagtatcagagcagacatgtagttggaccagactgtcttgtgggggcactaacaactttgcataggttggttcatcacgcaataatggatggtagatagtgaaaaaaaatgtcacatctccatatctccgttctacaacctctttcgttttgtttggtgagtgggtgtagacgctgtagtgagcagggtttcatttaccgcggtaaaccgcgcggttaccgcgcttaccgcagggtacggtaaggggtaaaccgcggtaaccgcgtcaaattcaaataaatttgaaaaataatttgaatttttgataaattttatacggtttgtcgcggtttgtcacggttaccgcggttaccgtgcggtaaccgtgcttaccgccggggcgcggtaaccgcggccccggcggtaaatgaaaccctggtagtgagtaacacaaggaaagaaccacgaccaccggggtaaggccgagtttagttttaaacttttttttttcaaacttttaactttttcatcacatttaaaaatttttcacacacaaacttctaactttttcatcacatcgctccaattttaattaaacttttaatttttgtgtgaactaaacacaccctaatgcatttcatttgatgaagtagttgaacattgaattcaatgaactccccccaccacaagaacatccacaatcaatggaagggcgaaaatgtagccgtgcttgcaacagcacatgtccttacgtcctggatgacaagtttttatattgaaacgatgagaggacgctgtgtaactcttgtctttattattttcggtactactacgtattagggcctctttagtttgcggaaagaaatttttttagtgtcacatcggatgtttcaccagatgtcggaaggtgtttttggatacgaatgaaaaactaatatcataactcgcctggaaatcacgagacaaatcttttgagtctaattaagccatcattagcacatgtgggttacggtagcacttatggataatcatggactaattaggcttaaaagattcgtctcgcggattccatgcaaattgtgcaaatagtttttgtttttatctgtatttaatgctccatacatgtgtttaaagatttgatgtgacgtttttgagaaaaaaaaatttatgaactaaaccaggccttactccctccgtcccataatataatagataatgggtgcatgtgacacatctgtccagattcattttactaggatgtgtcgcatccacccattatcccttatattatgggacggatggagtagtatactcctctgatgatgagaatttagcctccacttagcaaaagatctactcccttcgtcccataaaacaccaacctagtactggatgtgacacatctagtactatgaatatagatatacatttgtccagatacattgtactgaaatgtgtgtcatatcctgtttagatttttttttttttaccgagggaggtccatgaactcgtagcgtgtcttgtcaagctttcacccagtcgtcacgttgcgccaccttttgttttgtgtggtccttcgctgaataatcaccgtttgattacgatttttggtcatgtttctttaggctttttacccatggattgtcgccgttggtggaatattcgagagagatgtggaacctttcattgcacgcacgcacacgctgcgccaccaaatttagaccttgtttagatgggactaaaaacttttaagtccctatcacatcggatgtttagatactaataataaatattaaacgtagactattaataaaacccatccataatcttggactaattcgcaagacgaatctattgagtctaattaatccatgattagcctatgtgatggtacagtaaacattctctaattatggattaattaggcttaaaaaatttgtctcgcaaattagctttcatttatgtaattagttttgtaagtagcctatatttaatactctaaattagtgtttaaatacagagactaaagttaagtccctgtatccaaaccccaccttatctccccgaaaagatgacgctcagccttattgtttcacttatgtctatgtttattaggttaaaagttaaattttcagttttaaatttaaagctgattttaatttttttttcattagagtttacttttcagtttttaattttagaacactaagaacacgcatataaaagtttattcacaaattgattttcgtttgcaaatacgttgaataagccaaaaagatggggccgtaggtcttggcgtatttggcctcttttgattgtctcgagtcattttccagtggctgaagatggagacgtttcttccgagttacaccaacgatttcttcattttcttgcgccagatgacacaggagagtatctcgttttctattccgggtcgtgtgttgtaaatttggcgtgcccttgtgcattttgtcacttggtctgtgagtgctaggagggcctggttgacaggccgtgggccgtggccttgttgctgggaccgatactttgggccgtattcgctggaaatccgtgggccgtagcctattgggcctcctcttcgcgcgatttcttcttgatagcgtcggctgtttgtgttccatgtgcaaattatagggtgttcaggcggcgattctctcctgtgcaacaacgctgaaaattgtcaagcgatttctgtccaaaaggcattttacttctatagctgccaaacacaagtacacggcagtacgacacaaatcacgatgctttctaaatttgtaaattggttggttaattgaaacatggagaactgatgttttctcagaataattcttttttttttgcggggaagaagggaatatattactcagaagcaatatcctcacagacagtttgtgagataaaagtacaatttctcagaataattctaacagtaacatcacagtactctaacctaggaaactccatcagagcatactgcttaaacgtaataattacagaaaaaaatgcggtcagaatgacaattgaccacttcacatttctcatgatcccaaatgatccattccatctgttgccaaatgccgagcaggcattgacatccactatatacaacatcacgaaaacctcttgagaatcatggcgtagaggagctcgttccacgcgtccggcacgccggggaggcaccagtggctgcagtccgccctctgcctcgccggcgacctcgccgccgccgcgacattgaacaccgacgggtggccgtccctcctctgcgccgtcatcagcgtgacgttcagcacacgcagcttcgccgccgccgtgccggatctcgatggctcaaatgccgggttcaccatccctggccaccggtgaagtgaaatccttgatgagttcagctcaggtgttgtctccttggcgcaaccaccattgctgctagccctgcaaatttttacagaattgatgctgattgaatgttgcaatgtactatgtgtatgaaatttgtaacagtctacagaaaaaattttctgtgtctgaaccattttcggtttttcactgaccttgtgtgtgctggtgaatatgttctgaaaatgaccagggacttgtgtgggtttacttcacggtgaacccagctggttaatgtgttcattgctctctgataggctgcctcgatgctcatgttcagaatcaacttcttgcctacctggaaattgcagcgtctggcatgacaaggttagtcctatgaaaaagaagagagtaaattgcacttcaaacgaaacgtgatctaaacccaaaaggttgagatatttatagtccttaaaaaaatacctcgaggtatctaaattttacactaaatttttttacctcgatatacttagtacttggatatactaaattttacactagcaagtgtggtaccttccggtatcttttcaaggatggtaaaattatttcaaaaggttttacaggttttactcgtagtttataagattttcctttagttatatgacgcggtctaatgcaaagtgaaatttattttgacatatttcggtgcaaagtaaaaatatggagcaaacccgatgcaacgtgaaactacatttctacccggtgcaaagtgtaatttaggctgtgtttagttcgtgcgccaaatttttttttaagtatacggacacacatttgaagtattaaacgtagactaacaacaaaacaaattatagattctgtctataaactgcaagacgaatttattaagcctaattaatccgtcattagcaaatgtttactgtagcatcacattgtcaaatcatggcgtaattaggctcaaaaaattcgtctcgcaatttacgttcggactgtgcaattggtttttttcgtccacatttgattctccatacatatattcaaatatttgatgtgatggaaaagttgaaagtttgaagaaaaaagttgaaatctaaacacggccttatactaaagaaaatatttgtaacgtacagttgcagaagcctctcacggctccaccagtggccggtgttgaacacgacgacgtcggcgtccttccaccggtgagccctcgcgtccatggcgtcgagctgcagcgtggagcacgcggcgcccctgtgcgcgcggcgcggcggggggcggccgcgccggacgaggtacggcgaccggtagtgctcgacggtgcagttgtagtcgcggaaccggaaggagagcgcgccctcgtgcttggtgatggggctcccgttcacctcgtagatcgacgccgccttgtcgccgtcgccgtcgccggcgaaggcgacggccgtggcgagcatgcatagcatcgactcccactggttgcggccgatcgagtcgccgacgaacaccagccgccggtttcggagcgtctcgagcaaattcttcgcgtcaaatctggaaatggatatcatgatgagtaacagcttgtcagcttggccatcgatgaactgatcgcgagagaatttttggtgttggaaggagaagaaaaccttgggagagtgcaatggcgaggctgccacctccacttggcgaacgcgtcgtccggccggccgttctcccggcaccggaacccctcgtcgacgaacgggcaccgccgcggctcgacagcgggcgccgctcgtcgtcgtcgtcacgcacccactcgccgtcgacgacgtcgcagtgctcggcagcggcgacgacggcgacgtcatcgacggcgtcgctgctgctggtggtggtcgccgccgtcgtcgtcctcacgagcacgctgatctcgccggtgagcctcgcggcgccgaagccggaggagacgcgacgaggaggaggagcgagagcgcggagacgagcacgcaggcggcccacgccacgatctggtcgctcgcctgcctcgccctcgccgccggcctactcctcgcgctcgccatctccattgctcactcgatcacgccgccggcaatggcggtacaggggtaggagatcgaatggattaatcgcttgccgtgatcaacctgatgattgcttactataatatagtattaactcgttcttggtgttgccgttcttgatcgagatggagggacggttgctttgttcgcttgtgcttggaatcaacaaaacttcttttttcttttggagatgttgatgaacaaaactagcgttggatgtttcggagagcccaaacccaaagggatcaaaggtgacggcgagtgcagttaacgaagtggtagtgtgcagttgaacgttttgggttcgtgtcttcgtgatcagagggcgtgcagtttgcacgctcggccactcttttatcttgtcctaatatctagcgatcggtggagtgttgaacttttttgctacacgcaagtaaaaatttcgtacaaacttcttactacttccttcatataggtgatattcttccctgcataaccttcgccaatgtagccatacattaatacaatcgcaactctcattagctcatctgttttggaaatataattaggatgtatttaatgagagcaactatgtaatctaccatatcatttccttagatttgctagaaccacaattatttcgaa

SEQ ID NO: 66512 - DNA, 8915 bp, Oryza sativa
tatccgatgtcctcctggtacttcgagaagccaccctgactgccgagttcctaacgacaacccgtcatgaccatacaaccggggctaaatacggaggaataaacaccccagggaattaacttaggattatataccggcgcggaggaatacccgtactgagctgtcaccatcagcggcccacctctcatccgctatatataaccccaaataatgatatcccgtaatctagacaccacgtctaaactactagatactactctaatatcatcgtcatgacatatagtaattgcatatgcaaacattatacccgcaccaaagcatctcccagataagctagccgtatattcagtataacatgaacataatgtaaagtaggcattcatatactcggaaagtatttcaataccataaatgcatatagaagagtattctaataaaagtacaaagcttacaaaagagaagagaaaagctactagagccatacccgaactcttccgaaggcttccggactcctgatttatactctattcctattccaccagctagatactactaaactaaacttgagagaaatgagagagctattgcttgaggtgtgtgtgtgaagtgagaagaggagctccttttataggcaggtaatgatagttgtgacggttggaatggtcggtaataccctccaaccgtcattggggatcaatcccagccgtccatccaaaccctgcatccatcggcgccacgggaagttcggtcgaaccatggactggcccaacccagcctatcttcggctggcggcctcctttgttgtccttctctgtagacttgtgaattttggctcaatgtgtcgtgttatttctgagttcttagcccattcatacataagtctggttctcgacaccgtctgattgatttatcgtctgagttgatgtcgattctcctccactttattgtcattctctgcaaaagattagtatacctaatactagtggaatattattattctaatagatatatgcaatgcaagcatcactagttctcctctattttagtaatattgacggtcaaaattgatcgataacgatagtcaacaataagctgcctatttaaggagctcccctcactccctccaacacacactcaagcaaggatcaaatctctctacaaagctagtattagtgttagtggagtagagttagaatagttccaagtccgcggaggcttcgggagttcggtaaagttctgtagcttttcctttctactttgtaagacttccatttatcaatattatgttcttctttatataatttcggtgttttattccaatcatagaatatgagtaccagtcttagtttattcatgagtattataatctgtggttaaactttctgggatttgcattgatgctggtataatgtctaactactaggtcattagtttgcttaggctaagccaagagctatggtttcagggcttagttgcttctacactgattgcaagactgtaagtagtaagtagtaatttaagcatggagcttaggttaccgcttatcattattttggagtatatgctctgggtgatttgtaggccgctgatggtgacagctcagtacgggtgtcttccccgcagtttatatccctacatacaatttcctggggttggatactcctccgtatcccgctttggttggatggctatgacaggttgtcgtaaggaactcggcaaaccgggatagtcttgcgatgcatcgggagggcaagcttagctatgttgcattgttaaaggggttataatacatagtgtatactagttagaatatactaagatgttgtatactagaagtacaggaatagaacgtatctaaactactaccccttagccataattatgagatgtagaaattagctaaattagctgtgtgtcactctacccttaagcttacttacccctcatagatcttgatgtatacaagtaatatataaactattagcatagtactctcttatcatatcttccgttgggattaaacaaatatgataccttggaatactcctgggtgcaatgctacaatggtatatccgtgcacttgcagatcacatctgtaaccataatataccaggattatttctagtgctattgctgggaattatatttccagtagtgtcgctaagaaataccaacaagcatttatgggctctcctgaggagggagaacaggagaattccaaggtatcatatttgtttaattccaagtgaagatatgacaagagagtactatgctaatattttatatattacttgtagacatcaattgggattttagaaggcagagagctagggttcatcaggtccacaagtccacaactaataaataccactacaagagatcttatgatagatgacacttcatttacgtcacaaacattgaatttttcgtcacattttgtaatctgtgacgctcgcatgacgaaaattcattcgtcacctataaggtgtctctaatggcgttctatgacgaaaccttatttttttcatcattaatctagtgacgatccttccgtcgtcataactttatgacgctcaaattcgtcattatctagctaaaaaacgtcataaaatatctaatagcccattaagatccatgtattgagcaccctgtttatgggcttagcccaatggcaagcccgactagattttagcctagcccatctacgatgtagcatattttcagcccaattctattatatctattttctttaatatcaaataataaatgggccaagtacattgcaaaagcccatataggcccaaacattataccacactattttcagcctaatcatattatattcatttacattagtatcaaataacaagtgggctaagcccatataggcccaacaatcaaacacaataacaacccatatagcacaaaggtaacaacccaattagcatcaaacatccaatacaacacaaaatttacaacctagttaacagccaaatccagtcatgttccaaatacaatcacaggttcactgagttactaagtacatgtaactatcctagcaaaataaacaagttacagtcacattcactaacaaaacaagtcgcatgtctgaatcacaccaatcaaaagatattgccctctcatcatgaatcagcaagtcgacatgaaaagggcagacaaacctgcatggcatgatatgcagaagaaataacaagtggaacttgttgcatattgagcacaaaggaatagttatgaaacatggtacaaatgactaatagtattgaaacattgcacataccttatcaaggacgccttgttcaatgtcatcattaccttcaagagttggcaaaagaattgatcatgagcatacagagaatggtaattgctttgatttttttttagaaaaaacagattttctatacctcttcatctaaatcaagatagagctcatcaccatcttcagtcttcagcatccacctaccatctagcgccctggggaaaatgagcagcaaagaaaataaagcaacataaatttatgtagaaagtactttcctcatgacaaacggaacaaggtagcagtctgtactcagcagcctcaggtgacatccactgtcctcagcagttatagagtttgtttttaaacacagataaagtaatccagaacgtatttaagccatcgcaaagattctgttttagttcctgactgaattaaatttcaatagtattctgtttcataataaccaatctggttttcaagcagatgcaacataacaagttaatctaagaggaatcaaaatcaaaatgtaagatataactccagagaaaagtaagcacctcaagttttcaaattatagtagttactgctgtataggaacaacaaaacaaaacattacctagctgtgccatactgcatcaagtgcccaggaatgcttatatcactgaagaaatcaagtgaaactgccaaacagatgtagccatatcagctcaaccaattgtttgtgaatgcagcttttcctactaactagtaccagaagaggaaggggccatttgtaacttctatacacatgtgaggcacaattagtccaacagtaaagaacaggaattagtgcttgtcaaagataaaatttatatattcagtttaacagaatactatgttgaaaataaataaccatagttcagcattaccctccagatatttagctagcaatgatttgtgtaccccaacaaaagtaatcactctaatgcaattgaggatattgattccaggttagtaatcaggtctacagggacaaagaaacatactaggatattaaccagcgccaaacttcagttaaatagacctttctcgacagttgcaagatgccaacacacagaaaactcagcccggcgcaaaaaaataataaaaaaaaagtaaacagagaaaactcaattaatcattttgcaatctactttttttttagcaagaagggcagatcccctcccatttccattaaagaaaccagcacaaccactacacccagaacaactataggataagtatataagctgagaagacctgataaggcaattccatccccattggcacccctgaactagcctaagcaacaatccagtaaagttccagcaaaactactgctaatgaacagagatgacgcaatctattgcaaattgcatcagaaacagccctacagaagcgaaactcgaaatatctacacagcccaagtataatcaagaaaagaaacctttaggcaccgccagtaaccacagaccaaagatcagttcagtcagactcacggtcgcaccgcagctacttagctaattaagacgatacacgcataacatagtaacacatagagatggagattccgttagcagtagggttgtttggtctgctggtggcagccacggcgccggcagatccaccgctcccacacccggcagtgatggaaacggaggtcggcgcggcaagcggcgaggggcgagcaagccggcgcggtgagcggcgacggagaagaccgccgctgcaggccgtcgacgctgccgcacggtgtcgccgagccgcccgaggactgccgccgctggccgtcgacgcagccgcacgccgtcgcaagccgcccgaggaccgccgccgcgcgatctggccgccctagtgtcgaaaccagatttcggcaatattaaaaggggtggctatcaaactgaaaaaatagatgggtttagagacaagaaattttatacaggttcaggccttcttaatcaaagaagtaataccctactcctgtccgaggattgatccgccgagtatattattgatcgtatgatctgggtgaaaatcgtgcccctagaggcacccagacccctccttatataagggaaggggtccgtattacaaaatacagtccatatccctaacggaatatgtagttacagataaaatacaatcgtaactgactagaatctcaagtattccttgacatacaagtttggaatttaacccgagtcctcttaaagatattctatctatacatggcaccctataccctgtcggactatacatgacgtgtaggtatggggtatccataatctccacagtagcctctgagacctttacagtcaacgaaatagtctcttctcgtagcacaaaatgataatccgagtgcttcaatttcttctgcattgatctcctgagtaccaaaatcaaagactatttggctagaaatattcaggactgtttggcttggtcttttgaatatctgcatcagtgccaacattctaagagggaaatagttcttttaaaattggattttgagaaagcttttgatactattgaacattcagttatattaaacatcatgaggcagaaaggcttagatcctaaatggataagctggatttctcagattttttcttcagcctcttcttcagttatcctgaatggtgttcctggcaaatccttctattgcaaaaggggtgtaagacagggtgatccactttcacccttattatttgttcttggagctgacttgttacaatctatagtcaataaagcttgttctcagtgagtttttacaatgccaatcccaacacctggtaatgaatttccgattgtccagtatgcagatgatactctacttttttttgactgcttccaaaaagagcttttctgtctcaaggcaattttgaatacttttgcctcttcaactggccttaagattaactatagtaagtcatgcatgattcctctgaatgtagatttggaaaaggttgatcatctctcaaaattgtttggttgctctattggtaagttaccttttacttatctgtgtcttcctcttggaaccacaagaccaagagttatagattttgctcctctagttgatagagtagagagaagactctcatcaaccactgctttgttatcttatggggacagattgaccattgtgaatgcagttctttcctcccttcccacttactacatgtgctctctttcacttccaaagacagttatagaaagtattgatagagctaggagacattgcctgtggaggggatctgatattaattctagtaagaagtctttggttctctgggcaaaagtttaatagaccttagattgcaaaataattcccttctcttgaagaatctgcataagttctataatagatatcctgttccctgggtcagtttgatttggaatacttactacactgcagaacctcctcatgctgttactcctaaaggatctttttggtggagggatgttttacaatttgtggatatttttagaggcatctcggcctgtactgtgcaagatggaaaatcttgtttgttttgggaagatttgtggaacaataaagtcagggccttggtttatcccaaaatatattcttttgccaggaattcaaatctctcagttatgatgttctctacttctgatctacctcagctctttgccttgccactttcagagcaagcttttcaggaatatttggcaatgtcagctgcagataccttggagcatcttaatgatgagagtgatcgctggacatatgtttggggcaatggtatcttttcctcacagaaaatttatgccatgaatttttctcatgtccatgtgcctgtttatattaaatggatttggaagagcagttgtactatgaaagtcaaggtgtttgttggctactcttaattgatcggttaaatacttatgacatgttagacagaaggcattgctcccctcaaaatgcttccttactctgtgtactttgttcaacaggatcaagggaaacaactctccacttatttttctagtgtccttttagcactcaatgttgggcgcaatttggtgtggtttggaatctttctttaagctttggtgaaatgttggtcacggccagaaattcatattaatctacccattttattgagaaggtgctttatgttgcttggaacatttggaagcagaggaatagtttaatttttgaaaacattgttccctctgttccctcttggagagttctctttaggaatggtctctcccttttagttcatagagtcaaaaattctgagagagatacattgttacagtggttaaatttgttgtaattttttctcctttattaatataaaatcttaacggtggggacttcccctaccgtggttctttcaaaaaaaaaatcaaagactgtgtagagctaaaattaaataatcaggtgcatcgaatagatgcacctaattaggtgtagcccccgactatatgagtagctaaaagctaaacatatagtcaaagtgcaaataacatccatccgagtggctttacaaccgcatcatccatagtatcatatagctaagcatatgcatcgttcaataaaacatctagccgactgctttagctttaatataccaaaaattaagatataaagaggcccgagtaaaaaatactctagaggtccataaatcagcacatatgacaagaatctgagtaaaaattctcaaagatccatcacatgtggtataaatatgttatcatgacaattaatgagtcaaaatagcctaggctatgactcacgccataatcaaattaagcatataacatgccgagagaatgactgttcaaaatccaaccatctcaacaaaacccaaacagcctttgcagcctaaaaaggcttacaaaagaagtataacacatttctgtcgggtacctttttatttgcatcgtagtaattcaaaggaatcatctaactgcgtcaaaaaggattttaacagcattgagccataccactgtgacaaaaattgccgaaacaaaaatgcctaagtccctaaggatcacaacttagccatgctgataacagaattgggataaagtactattttaggcccaggcccattagtactcccgataccctaataacaccagaaaaccaaacaccgcttcgtcttccccgctgagactttcgccattttccccattccccgctacagtacaaaaccactccagcggaactagggttctccgattctcccaaatccaccttccaaaactccacagaaatcatccgcgaatccaccgcatcaatcccccctccattcccagccattcaccgaaccaaatcatattatccagatcgcatccatggcggaagagagagagctttgagagtcagtgggcgccctccgatgtaacggaggagaacctgaaggagatggtggcgcacggtgttcttccggcaaaggagatcattgggtggtgtccagcatgcggcaaagcattcccaacccctgacacacacgaggtcgtggtattttctcatttcttctgtggcgggttctctcttccaacctcaagattcttttgggggattttggatttctatgggattagtttgcatcacctaaacccaaattccatagtccat

SEQ ID NO: 66513 - DNA, 2116 bp, Oryza sativa
ttagcaccggttttcacttcgtgtagcagatgccatcactgaccgatggtttcccagtcaaaagttccagcaagttgtctccaaaactataaatactggcagccatcgccaacctcattgtgtatgcatattctgcaatcataattcaacagaatttagtttcagtacatatctgatatcccatagatttcggcagtgttatccgctagatgacgggagggggatgggggaagaagaagggcgggagaggcgctgggagggggaggggattaggtgactggtgcgcgggtaggggtggcgctggcagcagaggacgtgatgtcatgataggaatcggatgcggatgaagcttagagaaacgacggacggaaaatctgtggcaattggaaaaatacgaatttttttaagtatatataggttagatatgcataataaaaatgatgatacgtatgatgaactaaaaattgatcttggtttgcgttgcagatcactccgtggggacatttggtttgacaactgttgggcaaacaatctttctttagtttgtcttttatccacattgtttggggtgtgtgaggctcgagccaaggagaatcaacagtctgaccatatgtcctcctcgtcaccaccctcgtaataaattattatgtgtaaaatcatgagttcaaatggattttattagattatagtataatatgtacgtcttgttatcttcattatgattttacctcttgtggtatttatgtactccctccttttcacaatgtaagtcattctagcatttttcacattcatattgatgttaatgaatctagacagatatatctagattcattaacatcaatatgaatataggaaatgctagaatgacttacattgtgaaacggaggaagtattattagtaccaacctccttaatttaaaccttgtgtgttcttaatgcattactacctccttaaatttaagccttgtggtctttattattagtacctcagtaatttaagccttgtggtcttgatgtactaacctccttaatttaaaagccttgttgtcttgatccattagtacctccttactttaatttgtaggcagtgtcacaacttaagagttaagagtaactttaagtggtacaactatatgtttgtctcgaacttttttatttgtgcatgactccatgcacccaaatacaacttgctcacttactttcatgatgccttgtggtgaactgtttgctatgttgttaagattgctgaaatatttgtggttaagacgcatctttgttcattgttaccgacagttaattgatgctttatgaacctcctattctcaaacagcttcctagcaagatgatatcttgttacttttttttttttttgcctataagatgtgcttgttttcctaggtggctgggctggtgccaagcgcctagtcattcttggtggctgccaagcttcttgtttggtgttattcgtgttaagtgatgcataattgcgatgagcaggtgcttttgttcaaataatggttcatactgcaatttccatcgggtgtcctttcagcagatatttcagtgctattggttatgattacctgttgttattttgctccgacgtgtacaataaaatcgccgaggctgagagcctttatgaggcacaagcacaagtatagcaatcaccttatagtatcacccttatactaagtggaaaaacaaaacttgtacaccgtaataacccctcaatttttttctttaaaccgtctgctttatatcctaataactcaattttagtatcacgcttactatggcaaatgctgtaactagaaaatgtggagtgaagctgagatttgtaggtcagtgcctgtttagcacagctccatctcttttaaagttagagtcaactaaacagtttcagctccacctaaaatgagagcggagttaggtagagttttatcataaaatgaactagagatgtgaagctaggtttagacagctgtacaactccacttcagaccaactcttataactaaatttaaaaatttgagctctaccaaacaggctgtctgtactactacccgcttgattttgcaaatgcactacacgctagctgctttctgttccgggg

SEQ ID NO: 66514 - DNA, 20796 bp, Oryza sativa
gtaaatttgaacaaactacgttcgttttgggacaggcatcatgacatgtatgtatccactagaccagtaaattatcaagtccatgaaaactatcaagtataaatcagtaatgcacgaaacacatttcctattgtaccttcagatataaccttacccaccatgcatcaagttttccttaaaacacatggtaaataattacttgcaaagtgtaaattgagtttaaaattttgatagcacgtgtaaaatacttttacttatgtgttactgcattatcataactcgcacaataaactgctccctgaataatcaattggaataaaatatataaattgcaacaactggaacaaattgaattaaactgcttagctgaataaccataccgatgtcaggttcttcatcacatggaacatctaattctggtaaaagagaatctgtgagtgcaccaatggcatgtagttcttggcaggccttaagacaaactgtctccttgagaatagaaccttctccttctacattaactgtctgcacaggactgctcttaggaagatgcagagtgcatgtgccagatgccttgtctatatcgaatcttggtagaggattaaaatatctagcaagtcaaaatttgacccccatcataaacttgaagcaattgtggcagataattctgcgcaatataaagtaaacgaaactattaagtgtgaaacagaaaactaactcatccgatggaagctttgagcagaaaaaatgaattaatggaacgctggagtttagtgtcacaattgctctagttgactcgacacggtaataggtatcctcgcacaaggtgttctcaagtggttgacaagaaattgatcccaatctcagagattcctcccgcattatttgcccacttgcgagaaacttctctgcattagtttgagcttccacatcccccctgatgcagaaacgtgtataatgcacagtaataaaatgcaaaataggtcaagtaacgatgacaacaaaaggaggttatcgtgtcatctaaaatcagaaagatgacggataaatccacagcaagtgcctacaatagtcataggatctgaccaggtccaccatccaagagaattttggcagttccatactaaaaattcaaacaattatttcagttgaaacttattaccaggatgatacaccagttacctctggttctggaaaataccatcaggaaccataagtcaattttataataaaaaaaagctttataaactgctattactccctagtataatccagcttggatttaagagtcaacgttaatatttagtgccactatggatgatttgattcactacaaaaaccaactgatgaaatgggaaaagcaatcactaatataggtaaccactaacaatttcctggcactaaccagggattcttttttttatccagtgcatgcaactcttttgatgaaatgtgaaaacagtgaacagagtccatggaagacacaaacaattcactaaagatggaacagttaacaaatttgcacagagaacaaacaaagcaacaaaattgaaaacgtgccttccgacaagtaaaagatagtcagagttttccatcctagctcgaccacgggactgtataaagctgcatactgttgctgatggatcaaagcgaattaccaagttacaacttggcacatctaaaccctcctccaaaatttgtgtggcaataattatatgtacctgcataaccatcattctctcatcagagaactatcatactatgacttaacagaatgcctatagcatacttaacagaatgcctatagcataaaatacaagtaccaatatcgaacctttccttttcgaaaagattcaacaatttctgtatgatttttcctgctctgagatagcaaaccaggacggcttcctgccatgtgcttaacattccacccagacatttgatgaatagatgaaagtaggtgctctaatactatgcttgtgataactctctcaacaaacacaatgcatcttaagtcttgcatatgcctgagagagagagagagagagagagagagagagagaaagagaggtgttacttattgaatgatcaaaagaacaaaaagttttagtacaagaaagtagaagcataagcatctcttacaatcaccaagttacttattgaatgtcgttttgcccgcgcggtttggtctttaatccagtttgcttcgaatattagtttacctaatagtacaactcatatgtttgggcattggataagaagacaaccacacaatttgagatctttggtcttattaggggcaactaccactatttggtctatttggctttgcagaaatgatgtggtttttgaaaggaaaaacatatcttcccctttgcaggttatcttttttattacacattggctctgctcatgggctatccttcagaaggtcaatttgcggggtactatcattgcggcttgtcaacacttggagctagtggccatggagttttctaccccggcgcatgggtggcgttctaggctacggttagagggctcctgaagttctttttgtccctgctattttggatgatgagtttatcttttgtttctttcttgttggctgtgtgcactctttgggtgcagaagccagaggtgctctcagaataattgtatcacttgatagaatttactgagattaataaagcttccattatctaaaaaaaaaactttagaacacatttttcacactggctggtatgtgattatctattccatggaacttacttacacttcaatatccatctaagaactaacctataaaagccagtaatagggaatggaagtagaaggtgaaattcaagaaaaaactgtatgcagcaggaaaataatagtggtactggaatgtatcatttctgtactacttatatgagttggtggtgatgggttgtgctctacacccccaatccttcaatcaacctttggtgaaacaatcagcatagacgtgtgtcattttactcatttgtacttctattgaaccaatatatagatgatttaattatgttcatatgtatgtggttgtcagttgatccaagttaaatattttaaatgtggggatttttttttggcatttgagtaagccaacttatgcgtgtttatctgagatttgttacaagagatgggcaaatatgctagttctcccagaaaaaataaacttttttttcttgggaactcttctttatttttttattcagattttcaaatgtaatccatggggcatgtacaaaaggcacatgcatattgtagaagctaatggctctttctctgtactggtcatccatgatttttcctattttctgattatgtaaaaccatgcatatcacttgatattaactcacagcagacaaaattcaaaagttgattaaaaaagaatgaaagaatacaccactatcgtccaccctatacagaacctttggtaccatttagtcgatgcagtctcaaagggagagaatgagaaatattaccaatactactataagaatagccaaatgaatgcaatctcaaaggatgtggctgtgaaatattatcaaaagaaaatatcagaagagtattttagcacctgtactgcagaagagttcgaataaggcaatgaactttgggtgtcaatatcccatcttgagaatcagctggaaatttttcaccaatatgacctgaaaaaaaaaagcaaagaatgaaataaacatggtatgacctataaattggaatttcggcaagtggatgccatctatggtttaatattcagttagtatcgcatgtatcataagtgaaattatgttaaaaatatcatagtattcataagtgaaattataaacatttttctagtatccagatagcaattcatgcagacaacagactagacaacattttatttggtaattgagaattccagaaagcaaatgctgtcatgcaggtaaccaagaaaagaacataaaaagcgcaacatgctagagaaggtatgtttgtaaaagccagagctgtgtagtatgtaccattcttcaagaaacatgaaagttctctatgtacttcttcgctgtagtttctaatgaagccctcaacatttttatccaatgtttcaccccagaaggataggctgttttcctcgtatgattgtacctcagcagcctgaaaatacaatgttaaagataaattgggattccagaaagtactataaatgtgcagtgaaatctttattcatacctttgctgccagccatactcctagattatataaacaatatacaaatgtatgatgcaattttgatatcctttgcttagcgttttccagagatgaaccatgtagttttctgtccagagcttctatatgctaagagaatgaaacaaaattgcattggtatctggtaacatatatacacaggatttgttaaaagaagttacttaaagcattacaaaaagaatgtcaatgcatctcaataaaaaaaaacctcctgcttaaaatattgaatgtcatattcagcccaagcacaagaagccatgaataacaggtccatggcatgcaatactaaaggtctggcacatgctctaactaaaaaaagaagtctaacaacaggcttaacagtctctgagactgataaatcatcactaaaaactgtctttttgacctaaaccgcattttagaattcacatacttctgtagaacactggctgtgctactgtaataaaccctaacttttttattcttcatttatattctgaaagatgccattgataggtcccacgttttggcatgcaggggatatcatttggctatctgggcctgtttggcagagcttcagagcatcctggctataaaattgttagaggtcaagctagcggtagactggggtgttggtgcgccatcctgtttacatttcagcatagaccaatttattttagcctaagaactccatatttacaaaaatacaagagttggagctcaatccagctcagcatattatgcttcaaaattcttgaagctggaacctaaaagtaggtagacaggagtgtttaggtgagtcatcttctttacattttggactaaaagtaggtacttaaaccactttgttttagcctacaaaactatattctgcaacaacataggagttgggagctctccagaatagacccttactaggcttcctctcatttcacatttattctaagtttctaacacttctccccaactcaatctctgttcccttctgtaggcatgccgaaagtgccaacctctcccttgtatcttaccccaaattggccgccatgcctagtcttaccactcaacttcatgcagtacagtaagcaacttgtcggcaagcaacatgtaactgaacaatagaaagcactgtttaccaaaagggcaaacaaaatgtagaagaatgatagtacctttttattcaatctattcaaacaactgagaatattggcatgcagctcagatgaaatgttggaatcgtcaaagtccactatttttgtagaagcaaatggtatgtactccgacaaagctgattcactatcaacagtgtacaccttgaacaacaaatgcatcaatgcttatttcccaaagacacatacaggtaactaaattaggaagaatgattatcgtaactgcagggatcacgtaattaactgaaaattacatggcctgaccttggaattcatgagattctcaatctcagaaatttgctttgaataattgtgcggattcaaatctatagaaggaacagtgtgacagattagatgatcagagagcctgtgcataaaacataagggatgatcgtttcgcccttaccttttgaataaatgagcgaagcagacatcccaaatatccttggcagagggtctgacgcactagaattcaactgggggtgataaaattcctgcaagcgtcgaatgatttgtctaaattggtgatacagatcagcaggggaagggagacatcaaagattctgactgaaatagtaaatgtggcaaaaccaacgctgcatgttccaattatattggcactagtatgtaagttagagcataggtgttcctatgttgatgagacgaaaatggaaaatgagagctactccactactaaccccacccgatcaataaatgtgaagggaaaatacgaaagggcgcaatacggcggcgggtgtaaacttttgtaccttgaaaatgcaggcgtacggcgtattgcccctggcgtggtgacactcgtcgaagatgagcagcgcgatgtcctggaggcggaagaagctgtggcggaggttgtcgagcaggatctgcggcgtcatgacgagcacctcgccgtcctccagttgggatcgccaggtggcggcgtcccagaagtcgacccccatctcgccgcagaactgcttgacgacgaggtcggtgtgctgctcgacgacgcgcgcctgctggcccacgaggacgacggtggggacgaggaagacggcgaagcggcgcgagtccggcctccgcacgcggtgcgcgtacgcccggagcagcatcaccgcgatgagcgtcttcccgctcccggtctccaggaacgccagggtgttcccccgcaccgcccgctccagcgcctccagctggtacctgcacgccacgcgcaatcacaaacccccaccaccaccattagcatccaaaggggaggggaggacggcgaatcgcgatccgtcaggcgcgcactggacaccccccgggcctcaccatctggccattgtcttcgggtcgggcggcggcggaggccggagcggttccaccgccttggcgcccccatctcctcgacctccggcggcggtgagggggcccacccatggcgacggcggcggcggcggaggaggaggaggggtttgggggaggaatcgggggaggcggcgggatgggggtgggagagtgaggtggcgcccacgcttggggccgcttccgcctccgcctccttcggtgcacgcacgaatccgaaccgaattcctacgagtcgcgcgcgcgtgtgttgggctcgaacaatgacgagagataaatgatcttatgggggggaagcgggaggaggagggatgggaccaattggtagtgggaggcttcggggcgaaggattcgcccccgccggttcgttcgagtgcgccttttgagttgacgaggacccgaggagaggcgaccgggaccgcgggggaatgggcgcggccgtttggcgtcagatggaggggagggaatcacaggtggggtactgggggtatgtggaaggtcggggggcggtgacgtccttttgggttttggcttttgcaatggattaaatattttttagatgtcatgtcacatgtcacatcggatatttgatacgaattaaaataattaaacgtagactattgataaaacacattttataactctggattaattcgcgagatgaatcttttgaatctaattaatcattgattagcctatgtgatgctatagtaacaatgtgctaattgtggattaattaggcttaaaaaattgtcacgtgaattagctctcatttatgtaattagttctgtacgtagtctgtgtttaatactctaaattagtgtccaaacatctaatgtgacagggactaaagtttaaagtctagtccctggattcaaacaccccctcattgcaggtaataaaatctcgacaattccatgtgcattgctctttcaataaaaaagttcaatgctggtttgttttctaggatttgggttccttaggccatcaccaatgcgtactctcaagtgtgtccctgctcacagccgtcgccagtccatcagtttgccgtccctagcagaggggcgcgtcttcctccgctcctcagtcgcttttcgtcgagccacggagctaggggacacgttgggcgacgtcgtggcttgaggacacggctcccgcacctgatttttctccttccacccttggcctcttcgctgagaggcccatgtgttgataaaaaaacacacactggcctgggaggtctgcttaactccagtgcaggtcctaaatcttgctttcgggtttcgctgggaggagacagagttggcgacgacgaccggcgatgaccctgtgacggagacggctcggcgaccccgcgcgctgctgccctccgccaccgcgcccgtccccgcgccgcttgtcgtccgccaccgcggctggtgagagagaaggagaaaggtgacgatgagtggcgcaagagagagaggagagaggcgacggcgacgaccagatccgaccaccgtgcgctgcggcagccggcgaggacggagggcttcctcgtgcagcggtggcgaccagatctggcgcaggctgtcggcgcagtggctggggatggcgaggagggaggcgacgtcggtggcttgggaggtgacggcggtggctggggaaggcgaggagggaggcggcagtgagcggcgtgggagaaaatggcgagcgggcaagagagaggggagattggcgatgcgcgcgagagagaggagaagcgtcggtggggaaaaaaagtcatcggtgggctatggagagaggagggtagtataggaaaatacccaccgtgggctttttggttgggacacccattgtgagcttgagtgccttcacccagttatcttatattttgaggagcccatccaggggtatctctcattgtgagctgagtttctctacgagtgtcctcaattagtgaggacactctaggaatagctcacattgtagatacccttacagtaatatgttgtgtccaactcatacgacttctcattatctgtgttcgttccggtgacattgagggagaaaacccatcgttttccacgcgcacgcttctaaatatccaaaaattatgtcacatcaaatatttggacatatgcatggagcattaaatgtggaaaaaaaatccaatttcacagtttgcatgtaaaatgcgagacaaatcttttgagcctaattataccatgatttggtaacgtggtgctacagtaaacatttgctaatgacggattaattaggctattcatctcgcagtttactggcggaatttgtaatttgatttgttattagactacgtttaatacttcaaatgtgtatccgtatacgtcaaagtttttaaacctaaacaattaaacacggccaaagtgtcaaactttactagaagcagctgtgcagtggctatggtagaaattatatgttgctactgtagctactaactgccatctagtcataccgaacacgaatcacgtgtacactttttaaccgttaaaagataaatatattttatagaaatatactaagactagttgggtgcccgtgcgttgcaacgggaaaatatgtatcatttgaaacatacaatctatgccatatagaaatatgcacaaatcaatgaggaatcatttccttgatctgaacaaaacgaaattgtaatgaatctgattcatttgccaagttattatgctatatattaagaagtaaaacttgtagatcttcgaattcagcaaagaggaatatggacatgtgcacccacgtcaattctatgctttttttatataaacatggtttaatcacattccgtagcacacaaagaaaaatagtatgcatgcatatcaaaaggatcgtgtgaaaaatgagaaaaggagaggctacagaacatgggtactaacaattaactgatgaagcatgaatttgtgatattttcaaaccatgccaaaatgttaccatgcatttcttcaatcaccaaatccgcatacagagctagaatgagcatctctgaacaaatataattttcatcaaggaaattcgagttcaacaatcagataattctaattacaaactaagagagataacaaagaatgatttctatatcagtctatctttctggtcaatggtagcccgacacattagtgtctcaaacacgataaaatgcccaaacatagataaaataatgaaaacaaatccatttagttgttctcatgcccaaggtgcatgcaaagttttatatgggcatggtatcttaaataaagtttttaaggggttattgaccaaatggaaggactactgaacaaaaggacaatattaggtacctcaaatgatgtgtaccgtcagaacatttaaaacaaacttgcatggattcaaaaccttaagctgcttttcatctggcaaaataactggaatattcataaatgaacagcaacaaactgaatttcacgatcttagaggacacaaataattgaaggtgtaaagtattcagttaaaaatatattgtgctgaaaggttgaagccttcttttttcagagcaatacatgcttaaaacatgacaattcaagagcaaatgacatccgatgactttggttctaatttaagcagttactgattctgtttgaataagctgaacaatctactacagactctggtgcataaatcatgtaaatgtgcacgtgaaacccacgtcaataataagataaaacagagaataagcacataatattttcacgtctctaataagatgaaacagaaaataagctcctatacaacaatttaataattccacgtctctaataagataaaacagataataagctcccatacaataatttaatgaccatacaatactttgtatagataatctttccgatagaaagagcactgctacagaccaaaggatgaactgccccaaacgggcatagcatgagtacagcagacccattacatataacgttaaataaaaaatacataaatgaccgtcttcctattttactgccaaatgatgccttagaaggctcatagatggaggaagggttatataggcctcagtcctcagaagtacctttccatgaacccgagttaaatacaatagaggtgaccaacatcagttaaaagaaacacatgtagtagagagaataaactttatgcaatgtaaattatgaactaatgctcacggaatcagtgtcagctaaaaaaatgtgtggttatgtattaatgtgatctaaattagagttcgtaagtactgcagcctattctctgcaacgttaaatggatacggaaattgatggggcaaggcaaaccggcaaagtgttctctcgtactgcattccagataatcaaatgtgcagtaaacaatagtttacagcgatatgcaataatattaacaaccttccttttctatactcattaagcttaattgaaggaaatgattctgccaagatgcattgatagcagtaagatgactgcattggtaaggaagataatatacaggtaaagaaactaaccgtgtgagcatagatgatgcaatttactccatgactgaatcagggattagtgtattttctgctcgcatattgactaaatttcattgagtggagggcttctctcacatttatagaattaaggtgtgggtttatcatcatgaattcaggtgtggtttatcaccatgaattcccatcagcaattgcgctgatcatcagaacttaacatgagacacttaccatgaggaagtatatatataatcacatccaaaattttatgtctaatgtgagcacctagccagtaaaacaactaccaggatcatgaccaaacagtatgttaataccataggagaagtcgttatagtgatgagtgtgcaccacatgtaaatgcggcatcacagataaataaattgacagacacaacatagatcaacgatatttccattgcatgttaaaaaattgatatcgcagaaattaatcaagtaaaaacaggacaaacagaagaaactggtcttactttcacagtagggaagagtacccgggtgatgaagaaacctgacgtcctgaagaaaagtgagcttgtgtccagtggtaagatttcacttcagatctacgccgtttgtgagataataatttaaataccatgggtaggtacaggatcaatactcttttttcgctggtagtactctcgcatcttttgaagcctagcttccttgtcgccagcactaagagcagcataccgctccctagcacgcttccgcgtaaattaaatcggagttaaattagtgatgccgccaagtgtacctgcagaaacttgtacagaaatcatttcacaacatagcaacagtacgaagcagcgagacgaaaagggagaaaacagataatgtccacaaatcagatacacattgtagatataccttcaacaggaaactgtttcttttacttaaaacgaaattgtctaacaggaaactgtttcttttacttaaaacgaaattgtctaagtgatactttcacatacattttgattacagctcgaacaaagcagtacagtgctaaaatcactttgaaaagtgaattggtttctggacatttgctcaacatatttatgaactttagttgatttgtaacttttctagatgggggatgtctagcaatcgaatgccatataagaaattttgtttaccttttgtagatgggaatgtccctcagtgatggaggggagacgggcgagtactgcatccacctgccgacagcatccagcgacgaccggaggactggcggccagcttccggtgcggcgcgaaagggaccgtggtggagatcgacggagaggagcggatccagtcgcgagatgtggcgtaggcgacggacttttggcgtggacgtgggctgcgcacggggaagcggagtcgacgacgaaggccgccgcgggatgggggtggtggtctagtgggaggccgggatgtggggggttgatgcagccggcctgcggaggtgaggtcgatgatgaatccggcttgtagacctgggaggtcgtgggcttgtggggcgtggattccacggtgatttggggacgtgggatcggcgatgggagaggagcgaggcggcgcggtggttgggcggggtggggaagtggcgtggtgaggacttccggcggcagggatcggtcgagggtgcgcctacgtgatgaggcaggaggagacggcggcgatgggggcgtcggcggtggaggcgtggtgcggcgactggggaggaggatggggcgttggtggcggtggcgctggcagtgggggcgccgcgggaggagccacctgatgacgacaatctggagccgatggcgacgcggaggagtaggcatcgaccgcggggggagccggggaggaggagtaggcgttggcagcggggaggaggaggagtaagagtcggcccggcggggggatctgaagcggactcgacggcgggggattcggcatcggttgcgggtgggtggtggattcggcgtcggtggtgggtggacggaggagtaggtgttggtggcggtggcggtggcgttggcggcgggtgatggggaggaggaggacgcggcggtggacaggacggcgtgactggcgttgggggcagtgtctagggtttcggagtccgccgcaaggagtcctccctgcgccagcgatggtttgacgaaggcggtggcggcggcgaggcgagcagtgggggagggagctggtggaggacggcggggaggagcgaaggcggcggcggcacgggacggttaggggacggcgatggagctgtcggcgacgcgatggaggaggacggcgatggcggcggggaggatcgaaggcgacggtggcacaggacggttagggtacggcgatggagccggtggatgcgggcatgcgggagcgatggagcggtggatgcaggagggataaggtgaggagctgggtggggatcggtgcaccgttggatttagcaatctgacggctcacattccgcgtgtctgtcagagctggagtcaccgccaccactatagaattttaaattagtagagattatttgaaaaatcgtattaatatttttaaaatttttaagatataatacttaattaatgatgaactaattcaccatgttgctatatttgccgggagtgaagatttctgaacctataccttcaaaagcacccaagcagtgttgtgtaccggcggtgtagtcggctgtaaatacgacacaatagcaaaatcgttctgttaatgtgacaagggctactattattattcattagtatttatgaacgtcaaaattccatttttaacgattaatcggccactttttttaataatccgggtaatcatttgcatattgcacttgacgatcttttagagtaacaaatttatttttttacgatcttgttttgtttagtgttgtttagtactacctccatttttaatggtaaattttgctacaggacatcgcgacttcgtggaattagctccaggacacctcacgaagtgagttttggggaagacacattctcaaaacatggctatttgtcataggacaccgcgcccatttgtttggtatattcgtgctgactaggcttgagcaggcccacatttttacgtgaccaggccaaattgccctaccacatattctttaggcccacacagattactataaaaaaaagaatattgggttgtactccagctccacacagttagtgggaagcaaccaagtcagctccatggctgccgccgcccacctggatgggcttcctcggcctcctcagcttccgctgcagcgccaccgccgtcgcctcctttggccacgcgcaggacgacgagctgcatgtcctccacaccctccaagcccacgtcgccaaccgccttgccgcggttgttaacaaccaaatttggtaacatcagcgtcggagagaagattagatcgaatcaaagtcggaagcggagatcgagtttgaaaacagggcaggaatcggctgaagtccagatcggctatgacaagatcggctgggtctgagtcaggttaggtaagccgatgtggccgattccgacaatacgacttgtacacggcatcaggttcaagttaatgtacttcaagatgattgccacgcatggatagagtcctgggaaggcaattgtatatattaattaggatattttatgtaaattccttatagataaatgtgggcaaaagtctgccgcaaagacttatgatatcttagagtttgttagagataatggtcatgtctggtatgggcatatcttataatcctcgagtataagtagaccccgagccctatgtaatttttaacgacagacgttcaacacaatttcggcgcatcgccaccctttttacttcagttttgtttagacgagttcttgttttcgggttgagctgcatcgatttcgatcttcaacaagaggtaaaattcattatgatggattgcgttcttaggattagtgcttccatctttatgatactctaatcccgtttatcccgtttatgtaattcatcgagttatcatatgtcttacataatctctagcaatatcatcatctaacctgccatcggttagtatctgttaatagagggtagccgattaggttaaatattaatattgatctagattatatgagacatctaccattctatgaaacttctagcgacttgattatctagatatcgttcttcttttcatacttaatgctgcatcagttgagtttgatctattaagtcgtgcttagaatattgatctttagcctgccctctagttgccgattagaatagcatcggagtttcagccgatcgtatctgatttaacttcatttgttatatatgccttattgatatgttaaatctgccctttatgttaagatattgttgtatctaagtatgttaggcttttgctcaatatattattcttgctttaatatcttgatatagagtagtatcggagtattagccgatacatgctagatctatctgatcggctatgttataaacatatatagtcttgttattgacatatatttcgatctaagtgatttatactgtctcggcatgatgaccgatctatcccaatcacttgatttaagtatacatcgatatgaggagtatatattgttaatatctacagccaatcgagtagatttagtccttctttacttattcatgactgccgatcgatgcacagatgacatcggctcaaagataaatgatatgtcatcggcatctagccgatcggctatcatttatggatttaaccacggtttctttgcttctatttcttgttgattacaggatcaaatcaactggcacgctaatacatccgaaggcgagctttggacctacactggagttaagtagatctcccaggccacgtgttttctgtcaacagcggtctcccatcagccaccgctcctctccctcgccttcctctccaagctgctcgacgtggtgctctcctcatccgacgccttccgcgacatcctcggcatcggccccgtcgccgcgcgctctgcaggccgcctgcctcactggtgacctcctcgaccacaccgttaagacactcgacatacttaaagccgtctccctaatgctcgcttcgctccggggctcgcaccgcaccgtgctcaccgccatgtcgtgcctcctcgccccgtcgctacaccacgcccactttggccgcgcatgccaggccatctccaggcaattccccgatgccgccaagctcgctgccgcgccaggctgtccttcagcgtctctaggaacaggtcctccggccgccacgtccacgccatggcggcgcacttcgcaccgccgccacagtagtcgcccacgtttgcctcccccggcgcaggttgcgggctggggctggcgctctacaccatgagctcggtgctcgtccgctgaagcatctaggcctccggtgttaattttggtaattgttggcgatatggcatgaggcccttcgaccaaacatgctgaaagcatgcacccgatgaggattcaagcccgagacatcaaggttagtcaaggcgaaccctccccatgtcgaagactatggagcaaggacgacgagaggcagggaatcgcagccgagctggaggcctcctggccgaagggcgcaaggcgaagagcgtacgccgaagggggacgacttcgccgtagcaggttcggccccgggaaggccgaagaagctatcctggcccatcaagcccaggggttaattgggtcgactataaccagtcggcccgctaagggcccatgaacctcaattacgctatgtacccatgtaaatatccctttcataagggcaaccatgtaaattcccctgcataaccaaagccctagtagtaagacctgtaatgggggctataaatagccccatagggccatgtaatagggggatccaagaaaaattctctaatcaatacactttactttttttctcaaccactgttgagtaaccacgtctttcgacgtatgcagttgtcgtttcgacaacagctggtgccgaccgtggggacctccgagcgaaaccactgagagtgaatgccaccgaagaaggtcgtaaaggaaaaggttacaaggcgaaaggaaagcgacgccggggcggatatggccaccgaagagggagcagagccttcggcgcctgtcgctgaagatggaggagcgccatctgcttccgcacctgcgccatcactaccgccttcagcccttgctacctctgtgcaggtgccgaacgcagctgacatggcgaaggcagctgcggcggcgagggcactccagaccagggcggagatcctttcgacaagccaactgctggtgccccaagccactccgtcacagccagcagcggccccaactacgctcgctgctgtgcaagtccaagtcaaccctgaccccgagacacaaaccgaagccgacatggaaggcatacgacagaacatgacacgactccaagacatgcttcgccaaatgcaaggacagcaacaagcgtacgaggcggcaaggcggtccaaggtcgcctcggcaccaatcctctagtattcggcaggctatgtcccaccccaagtctatccacaagtgccgacccagccccttccaccacaagtcgcgcgagcgccaatgtacttcgccgggcagccatcgaccgcagcagcgcatccggcccctcacgtgcaactgcaagctcaaccggtcgctgcccaagtacatcctcaaccgcctagccaagtgccacaaacaatggcagaaggggcttcagctctgcaggcgcagctccaagctttccttcagcagctcagccaaccccacaacatttcaagtacagccccttcggccctcccggaggggaatacaagtcaagatgcgcctagttggttgccttcaaatcaaccaggtctgggggcttcgccgtggagtcaaggaccgcaattcgactccatcaatgctgctcaggcgccaaccgttcggccgcaagcaccaacgctaggcttcagagcaaaccaagcaccaaaccagatcaccatgacatggtcacagccaactttcgacccattcatggcggctcagcaagcatcaccaatcggggctgtgtagccgagtgccatggcccaatctcacgcgcaagccgtgatttcacccttcgccacgccgtacccgcagcaaggtgctgtgaacagggcagggggcgaaaaggggcaaccgctgagtgggggaatcaagacccgcacaatcccaccccagtgcaagttcccacccgtcccacgctactcaggcgaaactgacccaaaggaattcctctaaattgacgagtccgcgatcgaagcggctcatggcaacgaaaataccaaggcaaaggtaatacatctcgctctagacggcatcgcccgttcgtggtatttcaatttgctagccaatagcatttactcatgggagcaattgcgcgatgtctttgtccttaactttcgatgtacatatgaggagccgaagatgcagcaacatctgctcggcattcgccagaggctgggggagtcgataagggagtacatgcgtcgcttctcgcaagctcgatgccaagttcaagacataaccgaggcgtctgtcataaacgccgcttcggctagtctgctcgagagcgaactcacaagaaaaatcgccaacaaggagctacagacacttgaacacctacttcacatcattgacgggttcgtaaggggcgaggaggattccaagcgacggcaagctatgcaagctgagtatgataaggcttccgtcgccgctgctcaagcccaagcgcaagttcaaattgccgaaccacctcctctcactgttcgccagccccagccggcgatacaaggacaaccgtcaaggcaaggtcaagcccctatgacctggaggaagttcagaaccgaccgtgcgggcaaggctgtgatgactgtcgaagaagtgcaagccctccgcaaggagttcgacgctcaggaagcaagcaaccatcagcagcctgcccgcaagaaggcccgaaaagacctctactgcgccttccacagacgctcttcgcacaccacggagcaatgccgaaacattcggcaacgtggtaacgagcaagattcaaggccacagcagggagcagcagtcgaagcacctcgcgaagtagctcaagaacaagcacccccggccgaacaacgccaagatgcacaacgcagagtaatccaagtgattacaagggccgacccgccaatccaactgtcgaagcgacaaaagaagatgcagctgcgaacgatccacaatataacttcagcaggcgaagggtctccgcaatatctgaaccagcaaatctcttttgggccagaagacgccgaaggagtaatgttcccgcaccaagatcctctggtgatctcagccgagatagctagtttcgaagtccggcgaatcctggtggacgaagggagttcggccgatgtcattttcgccgaagcataggccaagatggggttgactacccaagcccttaccccagcaccagcattgctcacaggcttcggcggagaagcagttcaagttaatgatagccttcggctcgggggaaaatagacgcgaagagcaagtattgttcgacgttgtcgacatcccgtacagctataacgccatcttcggccgtgcaaccttgaacaagttcgaagccatttcccatcacaattatctcaagctcaagatgcccggcccgaaaggagtgatcgtggtcaaggggcttcagctttcgcctgcttcaaaatgcgttttggccataatcaagagagcagtacgcaatgttgaggccgaaccgcatgaccgggcgaaacatgcgtcaaagcccgcacctcacggcaagatagtcaagatgcagattgatgatgccgaccccacaaaactcgtatcactagggggcgacatgggcgaagaagaagctaagaacatcctagaggtacttaaaaagaacattgatatcttcgcctggggccccgatgaagtaggaggtgtttcggcagatctcatcatgcatcacctggcagtcaagccggacgccaagccaaggaaacagaagctatgcaagatgtccgctgatcgctaggaggcagcaaaagccgaagtccaaaaattgcttaaggcaggggtcattcaagagatcgatcatcctgagtggctggcgaatccagtgctggtgcggaaatcaaatggcaaatgacgcatgtgtgttgatttcacagacttaaacaaagcatgtccgaaggacaatttccccttgccacgaatcgaccagctcgtggatttgatagccggttgcaactcatgagcttcctagatgcatattccggctattaccagattcgcatgaacccggccgacatccccaagacagccatcatcacaccgttcggcaccttttgtcacctcaggatgcctttcggtctgagaaatgccggagcgaccttcgctaggctggtgtacaaggtacttttcaagcagttggggcgaaatgtgg

SEQ ID NO: 66515 - DNA, 24410 bp, Oryza sativa
cctagagttagtctctgtatacacggtgaatttgatgtttctatattaaattacagtgatttaagattttaaattttttatctatattaagattatttaaatattatccacgtaattgtaggaatacccagcttcaaaaaatcttgaaataaagttgtgtcaaagaggactctgtagtgatggttaacgaagggccattttggtttaataccaaaaacatgccctactaatttattagcaaatgtaaatagtttgtgtgttagtttagattgaggtcaaatatttggtagtgcccctatcctatttggttatattttagaagtttcttcactaaactataataatattcctttatattggtagcaatccaaatgttagctaaataattttaccctatcaatattttagtagtgctaaaatttacctagagtgtgatattaccaatgaattgatagggtaaggaaccaaacaagcccaaaaacctcagcttcaaaagaaaaagaaaaaaaaagaagaatagacttcgcatacatgatgatcatcacctggtaatacaaatcgccaaaggattaaagcatcaccaacataatgtatataatccaccccaaaattttgttttggtttcttaaactgaaaatagaaagtgaactcatctctttaagagaaagcctaaataaaaactaaaaatggaccattcttttaaactaccaatagaaatctcccattccatcaaagatcaacgctgatctccctccccaacgccaatttcccccaccacaccatcccatgtcagttgttctttccctctcccctctattccccactgttgctgcccccacctctccctacttgcaggggcggatctagaaaaaaatagtagtgagggctgaataaactacatcatcataaatcaaatctccaatccccacatcttatgaatctatggaaaaaaaatagtgggggcttaagggggtctgcactgtcccgggagcggtagtggggtctcaagatccccctccccccaattgtgagtccgcccctgcctacttgccctcgttctgctaaaaaaataggaatatgagtcgtcgaaacaacttccttcaaatgctactagacgatgagtcttcgtcggatgacgacgatgaattaatttttgaggtagttgaaacagtgtatgatagtaacagttttacatttagatgcaaaattattttgcatctaaaatgttgaaaatgattttcataaattagaaataccaaaattttccaactaaagacctaggtgagtctaatataacttgtgcctatatgaaactttgtgaataatttaaacatttttcctttctaacccaaaataaaaacattttggattttacttgcattgcataataggtcctataaataaaatgtagggagtggcaaagttcttcaatcatggccacacctaggaggggaagcaaggagttgaattgaagatgggggaagagaagctgtgaagtgttttacaaggatgtcgagcttgccaccgtagaggctggcgacctcgcggagcatgcgttccggctggtcccggacggagacgtcgcggactgagccggtgacgcggaaccccctgccctcccactccctgaggcgctcgcccagctcggcctcgttcctggagcaggtatgcacggccgcccccagcgccgccagctcgtccaccaccgcacgcctgcgcatgaattccccgcgttgatcgtagaagcaacagaaggctccgcggcggaggtctccctagccagcgagaaggggataagtgtgttggggtgagtatccgatgccgccggcagggttttaaatttcgaaattgctatttctgtcgaggacactgaaattttagaaatttcgaatttttttgaccgaaattatttaaaagtttaactgattttgaatgaatttgaatacaatttgacaaattcacaaaaaaattgtaaaaaaacgaaaatttcgggcgagatatgagcttgccggtgggagggcaaaattaacgaaatttcagaaattttgcaacgaaatttcaaaccctagccgcaggtgtcgccggtaatgagggtcctcttgctggccgaggggccatcttcccgcatcgccgctggccatggccttagtactgtggttcctctttgctctagctatggcaatcctgtcccatctgtttgcaggaaggatgggggtattttgcgaagaagtcctatatcggatctgttctttagaaaaaactcttcgaaaatatatactgtaaagtttatatagtgtacaaacctagaaactaacattggataaaaattggacatataagatttattcacatcactcttagtaaatttttcactatttgtaatttttttattaagagtataaattttactcacgataatgtggagaaatttcatacgtctattttttcatataacgattgttttatatttacactacttatcggtagttattcggttgttttgtgaaaagatcagaacgcggtaagcctgtaatgatcagaaattttcacataaggtctccagactcgggagtccggccgctatgatcgatagcggtccggtctctactactctctccgttttacaatgtaagtcattttagcattttctacattcatattaatgttaaagaatctagacatatatatatatatatatatctctatttagattcattaacatcaatatgaatgtgaaaaatgttagaatgacttacattgtgaaacggagaaagtatcaagcttcctccggatgaaccgtgggatgctggtcagagagagttagcctggagcgttggccagttcggacttcggaggatacaaaaaagtatctaaattcacaacacaaccattctattcatgtcttcttcaccagcaacatctgttcaatctccaaataataataataataaagaaaaaaacctaattaaacaacatcttcagttcacctgcctttagcgaggcttcggttggctttgtctgtaagagcttggtcgatcgctgctgtaatcgctgctagtgtttccctgactccccggcgctcttcttgatcgtggcccgatggactcacccgattccatgatggaactgtaggtatcttctgcgtacgtagtcctaaatatagagtttagatcttctccatgcgtttgtccttgcaagtgcttcaggatctgaaaggagaaaaggaacttcttgtcacatataggagtatcaaatatcagttatttggttatgtagttattgttctattttattctggaacaaggcactaccactacttgtacagttgtactgaaggtttagcagtttcggtgtttcaaactcaaaacttttcagggaaggaaacgaacctgaaccatggatggacgcagatgtgctgattggcgcacggcagcggcggcacactccatcattcgcatcattttgttttcatcataatcatctccaatatccggatcaacaaggatatcaaagttgccttcctccatagcttctgaaatcaagggttttgcctgaagaagcaaattcagaaatgttctatcaggctagacatcaaagttcctcttagaactacatttattggagtgaaggaaatgtattagatgtcaaggaatgaattttgtcaagattcaagaacttctttttgttagaaactgacccaaccaactaacgtgctgtccatgtaagactcagatgactgaaccggcagccttccagttatcagttccaagaggacgacaccaaaagcaaagacatcggctttgtcagtaagcttcccgctagacaggaactctggagcaatgtacctgcagaaaagaggatttgctatgaatacaatgagggataatatatacttgtgctatagatattcatgttcagaaattagaatgaacaaactcggaatacatagggaatgctgaagagaagtactgacccaaatgtgcccattattcttgtggaaacatgggtgtggtttcctggttgctactttgctagaccaaaatctgcaacctgcaaaggatcaagacatactgagtataggactgtgcaatataatggcatattgtttgcaattcaaacttgtcctgggattgcttcaaaaaaaaaacttgtcctgggaaaaccagatcttcttgaaacgttgaataatatgtgcagagagagtaccttgggctcaaaaccatgatccagaagaatattggatgccttgacatcacgatgtataattttaggagaacctgaatagtataaacggactttttcgtattaaatcacagttcaacactagatacgaaactgaatataagtgtataacgcgaaatggatgggtggagtagaactaacagtcatcgtgtagataggccaaaccccttgcagatcccacagcaattttccatctttgctgccaatccagaggtggccacttgtcccctgaattaagttcaacagtaacatgatcagatcagagtaaaaaaccaagactaaaaaaacattgactaaacagtcaacggatgcatttgacagaagaaaaaacaaatatgtaaaccattattttttttattcattttagatgtagacataggttttataccgtgtaaatgcgtgtcgagcgtcttgttggggacgaactcgtaaaccagcagcctgtcgttgccggagatgcagtatccgacgagggagacgaggttcctgtggtgcacgcgtgtgatgatgtccgcctcggcgcggaactcgcggtcgccctgcttgctctccgtcttgagcttcttgatcgccacctcggtgccgtcctgcagcctccccctgtacacgcacccgaatccgccctgcccgatgacgttgtcgggggagaacccgcccgtcgcggcggccagctggtcgtacgagagcgagccgccgtcgatggagatggagtgcgggcgctcggagccggcgtcggagaacgtgccgccgctggtctgcggcgccgtcgggtggtggtgctgctgctgcatgaagacgaatggcagcggcggctggtcacctgcaagcaccaaagtgtggtggatatctccgacgacgacgacgacatggacgtacgtacgtacacgacgtcgaacgtgacaagaatcacaagatgcgcgcacctttgtagtaggggttggggttgtataacattggcggtggtagcggaagcggctgggcctgttgccgccgccgccgccgcctccatcgccggatccagagcgcgagcacgtacaagcccaaaaccagaccgacaaccccagcggccactttgacggccacggaattcaagaacgagggcgagcccgtctggggtgccgcgggtgccgggtcggacgccggggccgtcgtgatgatctcggtcacggcacggcgtgctctctgcccgtggccggaggagatgacgacgacaccatgcaccgtcgtcggtccaccggtgatggtcaccagggcggccttggcgcgatccaccacgtcatagagcctcgcgaaagctgaggctcttcagggggtacatactgaggcggtgggggtacgaacgctgccggccgtgccatctcggccggttgggaataccggaaacgcgcccacatcacccccgtctgcggttgtgcgtgtgcacggctcggtgcgcgcgaaacggaggcttttataatgggttatggcgagagatttttaggtaaaaatatgttaaatgtaattatagtataaatatagtgtaattacatactaactatgtttttaatagatcacatcgttgacttttgaagatatgtttaatcaattcgtcttattaaaaattttatgcaaatgtataagatataaataatgtttaaaatactttcaatgataaaataactcgcaacataataaattataattacgtaatttttttattaagacgaatgataaatgtatggcaaaaagtcagcggcgtcttctattaaaaaacggaaataatatatatgtaatttagcttcttagggcatccacaatatagtctaaaagtggtccataagcaatacaatatttgtttcagccacctagcaatattgtggaactagtccatagcaaagaaataacaaaaactacccataagcatataagcatatgggctaccttccatactcgtaaaggaagtcgtttaggataatgtttaagtcaaacattgggaatataaatcatgaataactctcaagttgttgagtttaaaaatgtaaaaaatatatgaatagatttgtcttaaaacatactttcataaaagtatacatatatcactttttaataaatatttttatagaaacaagaagtcaaagttgtattttggagactgtgtcgctgtccaaaacgacttcctttatgagtacagagggagtattatttgtctctgtcctatctatatggattattttgatatatacattgttgttgccattacaatataaatacacgctgatacctttttcatgaaaaatttgatgacacagaagtccgtttgtaagctctcactccttctgtctcgctgagctgggctggcggttttctcctcaactatgcggcgcgtcatgcctctgtttccgcgcgaaaacagagtgcaagttgccacgggctgcacacgaaagcggagacgaccactcggttttggaggtgggaacagcagagacccactggaggcatccaccaatctgtggtgttggtaacaccgtaagtactcctacgtaacaatgacagaaatgagcgtggcaaatccgtgggccgaacggctggagatggcagcacggaccgggacttgtgctatcatccaaagtctaggtttaatgtgttggcaagtgtgtataggaatgaacagttgtcgctgtccagaacaatgagttgacgttcacttttcaagacattaaacgtgtaatgagtaatcagggcgctctatcgtgcgagggttaagtattaacaagtcaaattcaatgatgaccttcatcaacgttaaaaactggataagttaactagctggccattgtcagcccagcagttgtgccagtagatcagatactgccaatatgtagaagcgtgtgtttatactacgtcgtacaattgctcgtatatatatatcttgagcagcccatcgttttacaatttaatatgttgatgaagtacaatactctctcaatcctaatataaatataactttgtattgatgtgactgtatgctcagatttataactatagaatataccatatttgtacaaggtaaggtttcacttgtattgagacggagggagttggagggagtagagttcaactactttagtaggtaaaactataagaataatatgtaggcctagaatgagataagttcatggggaaggattgggatcctttgcattagagtacaaaaatttgcaccatccattcacaatcaattcactaaacgaagcattttcgagacttccgcgaaagtcttcttttagcttgagttcatcggcctgttggcgtcccattttttttccgcttattactatcttctgaattaggtagagtgggagcactcgacgaggcatctacgacagtagaggctcttcctcgtttttggccggacaattctataaatagaatcaaaaaccagaagaattgtgagaaataaatcaatttattaagttgagacacatcgagggataaaacatttcatactatcataagttgattccatttacaattgaatttttttttctttttatgtgagtaaattttattttgggccatgtatttttacccatgttgcagcttgggctaggttttagctgagtttttcaccttggatcacttaatataaccatttgtttcatcctggaccatagccgctcatcttctccgagtccaacaggcgataacccatcaccaacgtgcccatccgaacaagcgttggcggcagcggcggttactgatgcgcttatttgatttgatcacaacacattagcttggttgctccatgctccacaatcccagccggccagccaagttacacctacaaccaaatgggcaatggaacatggcttccgttcactgaagcaacaaaaattgatgcaacatcattaaaattagaacaactcaaaccatgcatttgtgttgcctctgtccctaatgtaagcatcaacaaattactagttgctatttgaatcgattcccttgcctcgcctcgctgttgtcgccgatccgccatgagctcgccggcctcgccctcgtcgacggctggcgtagtgcatctcgacaacacggcagctgagagggacgtgatctagcaagccaaaatggccctcatggcctagagctaacctgccgtcggctgaacggagaagtgcgccgcagtgcgaatcagctgtgcgttgctgctaaactcccctcggataggactaggagctattggcattaatcaagcacttatccccttgtgctcaccacatcctcctcccatcgatggcccaaaatgctattcatgatgatagtgatagcaactcaagcagtactaacgcactgcccctggtccaaactgctatattttgataaagttagatggtgttaagtgaaaagattggtaaatccctggtgcattgtacaactaggctaataaaaaggggtccaagataaaccgaatcgaacaccgaagaaaaaaaaccgatatttaggttcggtcctttgattttcgttttgtttttatttggcccaccacaagtcaatcgcgcccctttcttctccccaaagaagcacaagaagaggaagagcttggcgacgatggcgagcggcagcatcgtgaagaaggaggtcggcgagaaccacgacgtgctccgcttcggcttcaacaacagcgtcaagggcgacctcgcgccgcagcacccgatccaggccaccgtccacaaggtacccgtcgctgcttcccctctcctcgccccctcgaaaaccctaacgcgctgaatccgggtgattggtggtggggcttgcccgcgcgcaggaggccaagttctgggcggataagaagaggttcggggcggaagccatctacggatccgctttcaacatccgcaaggatctcgatgcccaaatcctctccaagtaatttcactatcctatccccccatatgatttcgctgggaaaacgatttgttcgagtaaataatcactgcggttcatgttaacattagataactgtgtcggtattacatagcatatattggaattgttagggtcaatgacattttgggtggaattcctcaactcaaatggccttattgtgggacgagatatgtttctttgaatttgatgatggcatgtattccccctgtgtttgtctgttagataaccctcgcagtacataaaaaaaaacctcgcatttacataattttctgtaggcttcaattaaaaaataaactcaaggtctcgaaggatcaaattaaatatgtacaaatgaaaaaccccaaacaaccagatgttgcgtaatcattagcatgcaaatcaaacaggaaattaggggatttcgtgggttagggaaaataatctcacccgatcgctcgctggctcattgttgcttctcatgagacaccagccatcgcacttgctgtgtttgtgcgtctacccgaggacagtacaaggcaaagagacaaaccaacaaacaagttagtttcaggttgcgataacaggcatgttagctgctgttgtgtcgggtactcggatgttgtttatgggttgagcaagagagcaaataatggaccaattatgtctgagtattggtgtcaaaagacaaggttctctggtgtcacccatgagagaatagaatagagcacttggaacaggccaaagccattggtatcatgtgacaccactgctataacgttggatccacccctattttgtgtgtctagttgtaaatccgttagctctttgcatttactgcaactattttgctcttattgtcgtatgcatcaagtgtcagtgatgttatgttttgtggtcatcagcggtattctgctaactgttactccctccattctaaaatataagtcacaaccacctttaacctaaagaccaaaaaacaataatcacctcattgtttgaatcatcataataaatactaatgcatgcaccctatagaattagagatcttgagggtgaaggatttaagaaataataatttagtggagaggaggtgctagttaacagcctcatcttttggcttatgcttatgtttataagccaaaaattgaattttcaaccttaaatttggaattgattttggggttttttcatcatagtttattttccagcctttgtcttttagatcgctaaaaacacggatataaaaaatttatttgcaaattattttctgtttacaaatatgccgtttcacttattctgtcaataagcgaaacgatgggggtcctaatttcaatgcatgcatgcacaccttgtattatgaaacgtgaaaaaaagtagttgtgccgtatattttggaatggaggtagtagtttgcaagttatttctgaaatttgttctcgtggctatgtgcagtattttgagcactgtttttaaggtgtttaattaggtcctgtttcttcaagagcatttccacaaatcaaatattaggactgctaagaatgtattaatgctttgagtatgctaacatggatggaatgtctggattccttggtctggtgaatacacaatcatatcttgaggttgctcttgtttgtctctccgtctctccgatgtagtaacaactaacaactagcacatcagcgcaactgtgcaaataagggaaaacagcgtgcgcaactcatgcccaggctaacattaaagatgttttggttgatgatttatctgtttgcaggttccaaaggccccctggtgcattgccatcatctatgctaggatacgaggcgctgactggttccttggatgatttcgggtttgaagattatctcaactgtaaggcttgttgtcctttgatttcctatgaatcttcttgctggcctttcacatttacgtgcaactatttgctcaccaacttttgctgatttattagctgcatgtttgatgcttatgttcttcattggaattatggaatccagtgctatcaagttctcattacctttatattaattctagtttttttattttagtagaccaaaaccatgtagtcttatgattccttgggagtttagaagttcttgggaaaccaagggtcatgaaatgatacttgtttttcatttttcatacttctagtcggtacatcttgataaaattttgctattaggatatacttggaggaatgtataataattatcacaaagtggttattttattctgtcctcatgatatgatatattaacagcaaagtacatattttgctttgtcatccaagcttggttggccttactttgcatggcaaaacatacatctcatcaccattttcagtgatgagatgtatcaccagaaatacagcctctatagactatatatatttcagtcccacttctgccctgggaacattttttttttcttatttacactcgctgagtgttcttcctgttgttggaaatgttacttagccttgtgttaattttctttttactttggatcatgttgcagtgccccaagattctgacagcttccatgctccagacatgcaccacggaatggaggttctccttggtttgtcaaagggaccgatttgccctagtttcaattgatttcacaaaatgtatttctcgtcttgcactgttctcctcattcaatatctatgtcgctctttagactgagatttcgatgcttgttttggttcataaccacacttgtgacgagattccttatccatcatgtagacctcacatgtcattgagataaaagagtgtgacaagagtgtctcattctagctaaagtgtggctccaattttgttagccacacattaggcaagttggtcaaaacattgtgtcaaccttgcataaatagaaatactcaaccaaacagtccattacgcttatacaccgtcaaatcaaaatgggacagtttcagacttggccgtggcttccatccatcgtcaatgcttcaagtgtggggacttcttcaacagccccatccattgtcgtaccatgtggttgatctaatataaaggcattccgagttgagctatttaaacaacccaactaaaatagtactccctccatctacttttgatagacatatttccaaatctgaaaaatttacttttgatagccatatttcaattcaatcatctatcctcttaatgactttctatgatttaatgcgtgactctccattcttccacacaagattggctacatgggcatcgagaaatgtaaatattaatgaatcgcttgtttacgaggaataattagtagcatgtttaaatggatgataagtagaattatttttccttggtcattgtgtcaagataaaatatgactatcaaaagtagatggagggaatagtattggtaaatctctctctgcgagtaaagttcggcggcatgagttcttgctttctttggaccctcgttggtacatgcaaatacagagcagcgagtaatgcaattctcgttccctcattgcatgaactacgttccaaaatcatctcgatcggtgcaggtgtaggcctaacctttctgaaaaatcatttgcgtctctgaaatactccactccaggcagcacccggcaaatgctagttaggtccatcatagttttcacttgaaaagaagcctgccgaaggttccaataatttgaacaagcaaacagaacactggaattgcatgtatgtctcaaaatcgcagagtattgactcctttttcggacacgttttatttgtcagttgcgactaaaaaggacacatagaagaatggatgtgctaaaaatgatcgtccgtcatatgaaagatacatttaatgtgaagagcacttggggcacattgagttgtttagagattttgcataacacaaggaaatatttagtggaaatcatcaaataaatgaaaacccatgaaagccatacttacatattctctaaattcaagaaaaatttgctagagataggtatatgcaagaaatacattcataccagatctagaggcgatagtggaggccgcggggtgcggttgccaaatctagccccctctcgttcggatctggcttgtccggcgctggaggctgaccctcaagccaccgccagcggagaggtgacgacgcggacgtggaggtggcagggtgaggtaggaaggacgcgacgacacgccatcgatggagggcatgcccgcgcggtgccatcggtggagaagggaggaagtggggcaccggctaggagtggccagtggcggcggtaggctggcgtggtgatgctaggaggcccacccgatggtggtaggactatggaagtccaacgcggcgtggcgatgcaagaggtcgatgcaggcaggtcgatgcgggtggcaccagcggtagcagaaggctggcatggacggcatcgggaggttggcgcgacaacgacaaagaagccagcctgactgatggcgtgaaggtcgacgcacgcgccaacggcaaagaagctagcctgactgatggcatggaggtcaacacagtgatgacagggagtccaatgatggtggtgtgtgccactaggcatgctgagactgactgacggggggtgtcggtgcagcagtggccacgtgcctacgaaggatggccagtggtgaaggaatggagcatagctatggatcgataggggtgagaggtaggtgtaaaatctagcttggtcttaacggcctgggaaaaacacaagggttaacgtgctcaagtgaattaattatacttctatctctcgataattcaactgaactgttgtcttccttgtaaaatcaaacttagttatgctacttcctctatcttaaaatataaaaatctagtaccgaatgatatatttcctattgctatgaatatgtatctatagaaaatgtttcattcaaatttaggttattatattttaagacgtaggtgacatctaaataccgttagtatggatttattgcttgaagttgccaacgtgtggtacgtgtgtgccatatgcttacgtcctcgtctatttaggcgaacggaacagccaaaagaagcaaatggaagcccaaaatggaaggcagaaggaagattatacaaatccattgtgacttgggtttaatttgtgggagcgccggagtagcctgtcgatttcagtaatgccggccagggccagtgtgcactgtgcagcgatgaaactccatccatgggcgcggtcaaatccgggggggagagagagagagagggaatgggaatgcgtttacttggccgggacacgacgtgcagcctcgtccacgtacacgcgagcaaagcagtgaaatcgcccgccgcgacaacgagtggatcggaggggagccaactgtgaagtactagtactactaagtgcggtacacatgtactacctgccaggccgcgactctctccttttttttaaaaaaaaattacacaactacaacaacacacgcgcactcacctttataaacacacgcacgcaaaacctacccctatgaatatctttgaagactagaccatcaaatccttaagattgacgaagtcactacagacatctcgctattgacgggtacgtcgcctaccactaaaagcacaactccgataaatctagaaaatttgctaccatggaagttaaacccagtacctataagatatacaggttttttcgcgccgcgactctctccttggcaaaagccggcgcttgtatgcatgacacgcgtttgtgacagcttacccaagtctaagtacgtctttgtgccctctttgactagttcaatattctctccgttctaaaaaaagacaaaccctgggttttcgtgtccaacgtttgactgttcgtcttatatgaaattattttataattagtatttttattattgttagatgataaaacatgattaatactttatgcgtgacttgtttttttaattttttttcatattttttttcaaataagacggacggtcaaacgtttgatacggaaacctaagtttgtctttttttttttgacagagggagtattgaacagttctcatttccatacttgttatcgtgcaaaagaacttttcgcacttctaatcactagtttagtattcagaagtttggaataaattgaatttaagcttattaataaatatgaaaattagaattcttagacgtatgtactttgcttctaagttacacacaaaatatatcttaatgttttttattatattatattttgtggatttgatttttttggaattactcaatacaagattgtcatgtggagtcttaataactattattgttttattggctgtttttaaaatactccctctatttcaaaatacaagcatgtctaatttgtttaatagaaattaaggtttaatacaaaatactttgatgcccctcatgaatggttggggtgagagggtatttaaaggtaagctgggaagaaatttaaatgatagatgattgatggaataaatagtaatccgaacagtattagaattgtttatatttgataaatttaaaatgtgataagtgtttatatttttgaacagatgatgttagaaccaatatatacataaaaaaagtttctaggatatgattttaacaaatgattcattttaagaagtttgttttttcttggatgaaggggtagttaccatttactagagtttggattttctttttcatgttcaatatttacattactgatagtgtgagatggaatcttcatttatttttatgttgtgttcgaatgtgtcggttcggaacatatttctccaacatgaaaaatgagataggttgttagcacatgattaattgtattaaaacaacttaaatataatttttcaaaacaaatttcctaaaagatgtataaaaacacatcgtttagctggaaagtgtacagccaaaaacttgagagcagaagttgagaaaggagacatttgaacgcagccttggtctccttggacaaatggccagatttactcaattttattcgattaacgtggacgttttaggaaatataagcatggatattatgcatataatgattggaatcagtccgctggctggcaggctgatggtggaacagtgactggattcatctacagaaagaaaattcaagatttaacaatcaccaattttattctaaataacattcattttatgagacggagaagaaatatcccgcagatgcacacctgggcaccaccggaatctccgtcccccgctccggggcgcttcactcccgtgccgcactggcccagccgcctgagacgacgtgaaccgtcgcccgagttccacacgcccaccccatccacaataatatatccaatccacccatccatcctgggagaaaattggagttgggacgcgagattctcaggcgagcacacgatctcgcggcgcgctcacgtccacgccctcgcatccacaagcgccgcggttaaaaaaccacgaggcatccccctccccctcccccgcctcctccgcggccaccacccgcccccgtcgtgctcggcgccgtcgctgctccgcctgaccaggtcgtcgcggaggctacggctgcgcgccgcggcggcggcggcggaggaggccgacgtgctccccgggcctggggccgagggggagatggcggcgggcgggaggctggaggagcagcccgaggggccgatcgggggcagccaggtcgacatcggcgggctcgccttccagggcgacatgggcggaggagggttcgccggcgggagcgggggcgccggggccggcggcggggacggcaacaagatgctcgaccgcggcatcaacacggccatcgtgctcggcgccagcacctacgccctcaccaagctcctcaccgtcgaccacgactactggcatgtacgggaacctttgtcgattccccccaaatcgttttgttccattttgtcttctcttctctgtgctgttcttgatttgattcgattcgaagctaacatcgttccgggcgggctgttgttcatgattggattgggtgcagggatggacgatctttgagatcttgcggtacatgcccgagcacaactggtcggcttacgaggaggccctcaagaccaacccggtgctcctcggcgactggattgcgcaggtgtgcaaacgctttaattttcctcttatttagagtaatagcttttatgcagctgcgcttgcatatttgctgattctgttgctgttgatgcttgcagtgctacgaaggcaagccgatcttcgagttcgaccgtgctcggatgttccggtctggcctcgtcgggttcacgcttcacgggtccctttcacattactactaccatttctgcgaggtaaacatcgtggtcttccatgctctactgcctaaagctttgtgtcatgttcatatatggtgaatgatatgaagccaactgtttttcttggctcaggcactgtttccattcaaggattggtgggttgttcccgcaaaggttgtgttcgatcagacggcctggtctgcgatatggaacagtatctacttcgtggtcttggggttccttcgtttggaatcaccggccactatttccagtgagctcaaatccacgttttggcccatgcttactgaaagcactgatatttcctttgttataataatgccttaattgagttcccatattctatattcttcttttttttttaagaattgaaagtttatgaaaaagctgtagttgtgcagttgatttgttgtcttcagtgttcttgacagcaaaaccattgcctgtggtcatggtttttggtactatgatccttaatttgttgaagggattcgatgaattcattgctctgtatacaagtaaattttttaggttaatattaacattttgtcctccaattattcttgccacatctattttctcaaagttttaggtctagaagccactattattgaattaaactagtataaaattacaacaaagctatgagaagtcattcaaattttgaactttttaatgttcaaataattattcaattttcccttctaataattccatccataatctttctataatcactgaattatttcttaatttcaaaacggtttttacagtgttttactgctaacagagaccttatgctgggtttcaattattattataggccggctggaagttgtggccttttgcacacttggttacatatggcctagttcctgttgaacaaagacttctgtgggttgactgcgtggagttaatctgggttacaatactgtcaacgtaagcccaaacatgtcaatttcactttattactacggcagcctgattaaatcgcgaaagataaaaagagttcttcatttcttataacaagagttcttcatttcttgtttggcagttactccaacgagaaatctgaagcaaggaactccgaggacgcatccacatcaaatgcttccaatgtatggaacagtttaattaaaaattcattctgtcagacatgttatcgttcgttctaacacccaaaattcattgcctcttctacaggacaattcaatatagcgaacggtatagccagccaagctgccctttaccttcatcattttgggcttgtatatattgtacaatttgtagctgcagctctgcaggtgtaacctttttgcaaagatatattaaacatataagatgtgtagcaactgccaaaggcaatcagaacgaaattaccttgcactggatcaactgttgacgagattatgagctatgcaattttggtagctattcttttgatctttgaaaccccttttcagtgaaatcaaccgtcttgcattgaaccttatatgatcgacaacgcaagcaaggagcaaaacctatacaatattttggggtggttacaatttacacagtattctatagacgctagcaaacaaacagcttgctcatcatcagacagaacatcttaaaacaagttttcccttgatgcgaacaaaatgctgtctgtacattttttcgtttttgctggcatgctttctgtacaatctgatgctatgagtaatatacaactaatgctactatttcgaggaaaaaaaaactactgcatggcatgggcaggtgtgctatgcccgtatttgtaatttacaaaattgcgatacttgtaagtttgaagcatgaaaacctaccagaattcatgaggccgttcacacgcatcgtttgcgagcacacaaaaaggagcatttccaaattacatgtatgaatccaaccaaaacttttctattgtgcgcaactatctatatcaattgttagctactgttgcacgcttaaatagttaagcatcactatactgcagcagcctctgtatctttgtgaccagcaatcagatctttaagcacagcctttgatgccaactttttcgccaacttgcagggacctgattttgttgcggagtatgtagtctctccagccttcacccgagcaatgaccgatgagactccatcaacatggtttttttcgtaggttattttgaatgatctacgatcacaaaattcttgcagccctttcaccgggtcaggctcgatggtttcgggggtggcaagaggttccaatagccgcttcatgcttctccaaacaacctccttgtcacacttgctgtcgagataaattgcaccagctattgattcaatcacatccccgagaacctgtttgtttgcaagtaaagcaatagatccagcttaagctattcgatggaaaatattacagaagtgcacaaaaataggttagtccaaacatataattctcctattccagtttacagtcagactaaagacattttgtggtcgtcatgctgtgatgcactatgcatcggaacctagttaagactatctttagttctttttataaattctctagcaactctttaatccaaactagaaataatggatctgatgcctggttaaattttgatgtcatcactatatggcatagactataatgtatccgaggtaatggtagagacctaggaatactgagtaatgactaataagatttaaaataaaagacaaacaaattaactgatcaaattttaccataccagctaggtgcattttcttttgcagaaaaagagaaacaaactctgctatcagactttcagaatatatgcaatatagccacctacaccaattacaccgtagagaatacacacctttggtagaccaatgcccgcttcccagccataagatggacctgtaaatgactgcccaaggtagtagctcatcttcctatgcagttctgatgatgagtgaaggatatgcttgtttaatcctgatttaacagctgcatgcgcgtaacaattgttgttcacagaggcagatctaagatctgtcaacaattctggagtacagtcagggtatttgctgtagtaatattcagtgaaaagatgatccaaaatagcatctccaagaaactcgagcctctgcaagggacacaaacttgtcattcaactcaaaaaagatcccaaactaacaacagctacttgagaagtttgattcagataaaaaagaagctagacaaaaaggcaaaggcctcatcaaaaatcctaagccttcagagcttcaagccgatgcatgaggccatcaacggtcaccgcagtatgaggaaggttctccaaagcagcagcgcacccatggaggatgtgacgtgtaaacgccaccaccactcggcgtaagctgaagcaaggttttcacctggagatcagtatgggctaggtggaactacaccataacggcgcctccaaggaggggaacagtgcccaaaggcgacgctgtcattcaaccagccaatggctcaacaaggttttcaccagttgattctccatccagcccacacaaccaatccgcagcacaatggcagtcgccggatcaccacaccatccctctagcaaccatgcccatgcatagcccgacagctcaggcatgctcataggactaccccgtttccggccacgccatcgacatctcctgatgatagccacaacttccaccctccaatcaaagctccccatgaccaaaactacagtctccagccatagaaggggaggagctccaagaagaggaagatgcttggccggcaaaaatggaagacacgccgtcaccactacccagctgcttcttgatcatcgcagatgcccagctttggtcgttgtcgtacctcgcacctccaccctgttgccaccatccatgcaccacaaggagctccaaaacgtccaagcggttgggaggagtcctctcgctgctcggatgctagcacgccccgtggctcggatccctacccctagcgaggacgcaccagatccagtcgctcaccgcggcagggctgcggtcgccgttgatgccaacttgaatagccaggaacacagcctcaaccaccgcccacgcggcccacttttgcgactaggacgaccgccaaacgcccatgcagctgctctgccgactgcactcgagcaatcaccacagcgttccggcggatccaacccagaagccccgcatcctgcctaaccggtgccagccactgttgcagcctctcctagcgctgccggctttggctaccatccaaagccgtcccaccgctgccgtagcaaccaacgtcacgcttagatctagctgccatccatcgtccgtgcgagagcccaaggaaaggaggcccgccgccacacggtttccggcagccagctccagcggcggcaaggggtgggaaggaaggaggtggggtagggccggcggctggaagcgccgcccgagtcgctgaaggagcgaggctagtccttcagttttcaggtttcagataattctacagcaagttaaactcaaaaggaaatgaaacatatagaggattgctaacatagaaaaaaaatgttgttgcaatactgtttaatcatttgcactttgttgagtaaagatcaaaaggcataataaagccgtgacacatactaaatagagatgatagatgcttttatatcaacctgatagcatgaagtagggccagaagtctgatatgagccatgtgtcaatgcttcgagcaataataaagaatcattgaacttgtaaccaagcattccctctaagctcctcacatcaatgaactcttcagctttcattgaaattttcctttcaactggaatttcagtgtgaaattctatattcatccctaatgatttcatcaaaagaaatgctgccttttccccagcagtactgaggtaagccccaattaaggcctcaactgaatccgcaatcctcttacttttaatagacattttcctttggctgtacataccattgggtgccagaaaggaaatttttttgttaccacgctcatcatagtccaagcaagggatgatccaatctcttggattaaactcctcagcatgaatgtaaccctgccaaccaaacataaagggcaagagtatcatctagtaccagtgataaaagacagataagtcttctttgaaacatgaaaaggtgaatagaaatattttatggtacttgaaaaataacacaattcattttgtgatgaacaaatttgtatgcaaagcattattttatttcatgacatagccctagccacatagcaccagaaacaaaaattagacctttaaaattgattggctgaaaggattacaagtcggttgagcggattaaagaaagctatttactatctcactgcacacgccgaagatagaatccgtttcaaggataggcagatgctaccattcttcccgccattcttgcttgccaggcaaagtaccgctgcttcaacggtcatgaaagcagaccacgtcaagccaacctcagatctgactacaggtgccatgtgacctgagggctaggtgttggcccaacaaggagtaatatggtctgagccacagccttgtattaacttagggtcagcaccacaaggttttggtcacctacaatagtctatattggcaacttggcaaacaattcaatgcaacaatagagttcccattttcctaaaaaggaaatatgtggaacattgcctaattgtgatatagcagttgcacaaaagaattgaaataggctgacatggtatgaaagatactgggagatgtaggactattaatattgcataaaattagcaaggatgtgcatgtaatcagttctgtagtgtgtaggtgtgtgtttctaaggtccttttacccttctttaacgcaatgatatgcagctgtcctgcgtgttcgataaaaaaaatttctacatgcctagctcaataagaaaaatacagttagcaacaggatctagagtaccacaagattactgctgcaggccagctggcacagagctgcattggagatcaagtttttcttcatttttgttaatatgccttcatgttgaagcctgtattcactaaaaaggtgccgagttgtaacatatttgaggaaagaatccccaagtgtttctaatgattcctgtgaaaattcttcttggcatttctttgttgttaatgcttccaggatctgcaactcatgaaaaaaatgcagagaaatacacatgtaagaaatatgcataggggaagtaatttattcaggtaacaagtaagaaaattcagattgacatgtacattgttaacagtggggcatccaaaatattaattagaaccataaaatactccacggattcaaatattcttatatcttatttttacaatataggaccatcaatccatacatggttctatagagtacaacacaccatcaagcacctccattggagtgttaatgaataatgcagacagctttttgtatgtgcttatatagttacattacgcattaattgaaggtatttatatgcataagaagttattaagtaccactgcctcatcaattgctacaaaaataaccaacttctacatggcaacaaaaggaattatttctttgctaagtgtccccgaaatatcttgcattatacatgacttaagacctgtcatgtttgcaagtagaaggaaccaaaacttatgtttgcctcattaatagatagtcacttcgaagtgctgaacatattcttactaaggcactgttgctgcattaaacaactaaaaaaatcagaacctttagttttcactgtcaaatgtcatcactcttcctacaacacctactggtgtgcccaagaatgcacttatatccatttttattttaaattcttcaaaaaataagggaaatatgagttttcttatatgacgacatctagttgatctaggtacttcaataattcataaatag

SEQ ID NO: 66516 - DNA, 781 bp, Oryza sativa
ctagcatcctcctatcaaatgaagacaccccttactcacgcagcgatcacaaggagggaacaatagtaaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataattacatcattcatatatatgc

SEQ ID NO: 66517 - DNA, 10685 bp, Oryza sativa
ttcctgcagcccagttgcatgcgtgtattatggaggtaggtgaaattgaatgattgagagttgtggttggttgtgaaagtaggtagagaaattaaatgagagggttatgattggtagagaagttagttatattttgggataaatttgaaatgctaaagttgctatattttgggattcattatattttaggataaatttgaaagaaaaaagtccgaattacgtctaaagttttgcgacagtccaaattacctacctacactaaaaaccggatgttggagcacaaaaaaaaaataaaagaaattgtagggcttacatgtcatatctcttttttgggtgatcaaactccccctttgcagagggccctataggcagtgaccaagtgaccaacgttggagctcgagcttgctcaggaagcgcgaggggggggggggggggggtggacactggaagcaaagactagtggcgaagctcaagctcgcttatatatgttacatggtctagaccatggctccctacgacctatacaagaaaatggtctagggcacagtttaggccctaaatgagatgaaaatctgcagtcttgcgtctagacgtgatctagactgtctaaaccatggtctaggcgaacactaaatatataggacgctgacggtagaactcgagctcttctcgtcccttttctctatctaggtccctcatctcagcgactgatagcggtggtggacaccattgcttgtccagccattgtctcctcaagcttggttaggtgattgacattggccgaagcaaagcttgaggcagtggcggaccaacgtagagctcgaggagatggtggacccacatagagctcgaggctctcccgttccccaagcactgctaccccatcttaataggggaagagatggaggtagccgcgagcagatctcatgttgttgtgcctccacattagagcaaggataacttgcaggctataagccggctaaatgcttaggtggaagagagaagagaggagagagaggagaagcgggctataaacttacagccgacttggacacaataacaaaaaactctgtaagagagacaagtagaccatgtattaattgtaaagagctaactattatatgggtaggctaagagaaaactaaaaaaaccttatagccatcaggtcggttatattattagccttcctcttagtgccaagtcggtgctcagctccatggtctccaccgtcgcacctccacatctcatgttgtcgttgttttcttctgctgaggtcgagcctaggaaagaagggaagagaggaaaagtactgacaggtatatccaatcgattttaaaaatattttttggtgggaaaaaaaagcttcggattgagtaacggtataattcgtgttttgaagagttttggtgtgaaatatttggtgtgttaattcagcgaataattttaattttcacaaaaaaatgtggtggtaatttggaccatttctaatttaaatcactagcgctaagcggctattttaggatggagggagtaaaacttacccttttcattttggaaaaagtacgaattacccgcctgaacatcgcgacagtatgaattactctatttaactcgaaaaccagacatccttcaccccccaactatgcaaacctgacaaataaccctagctcaatccgcggtggttttagtcctacgtggcatatgtgtgatagtccaatcagaatttctttaaaaaaattggagggccccacctatcagtttctcattcgtctctatctctctactctatccctttccccggtcccctctctctcttctccctcccctcacctccatcagagaatgacggtgagcgaatgcagttgggtctaggcaacgaagggggagccgaggatggcggcaggcaagggcggagccaactgggggtgccgaagccagggatggcgacgcgcccctatctccgtcgtcaatgcccaagcaacctccgcctccccccatcggcacccgcgcgacctccgcttccaccgctggccgcccgagcgacctcttctgccgccagctgcccaagcaatgtgccacgcacctccgcctccgtcgctggccgcccgagcgaccttcgcctccctcgttggcaccgcggagactacgactctcctcatgtatgcgctggcgccggaggctgaggaggagctcagctcggcatggaaggtcgtctcgtgaagagatgtaggggcggccctcgtcatccgcggtgtcggcttctccagtggggtaatctccggtggtgggtgaggatgaggaggaggggatggtgggagacggggcggcatcatcgacagccgcggcgtgtggtggtggtggttgcgctggtggtgcagagaggtgggaggggagagatctaacagtggaccccaacgattgttttaatagtatttagaaccaaaatcatcgcggattaaccgtcgggaggagggggtgaggggttatttgtccgatttatatagttaggggcgaatgatgtctggttttcgggtttggggttaatccggttgactgcgatagtctaatgggtaattcgtgtttttccttttatttatttttttatgcaactttgactcctagacgtacattttattatttatcatattaaaagatcatgaaagtaccatttatgttgatgttgacgtgacatattttaattgtaaaagatatttgaagtttgttttacatttttgtacttatatttatataatcttttttgaataatgaatagtaaaccatactaggtacgttaaaacggtagcaacattgtacatttaaaattagaggtagtgccgcataaagagtttccggtcgcactcggcacacgggatgcaatgcaagacaggtggtgatcgcgcgcgggttcgtacgtccatggttttttgcacacgcatgagtgcatagtgctgtgcataaccatgtttaattagtcaactagtgctaaccgcttcagcacgtcgatggcaagcatctgactaagcatctgaaatgttaattgtaagtagttgcaagataccaaacgggtctaaatcccaagtttgattcatcaggcgcggtagtgatgatatgatggatcccaagctgctcagagccgcaggccgcggcgactgcgcggtgcttgaggctctacttctgggcgccgccgccgccgccgccgcgacgccaaaccagcaagttgccatcgacgtcggctccgggcaacaatcgccgctcctcctggacgcggcgacgacaccacagggagactccgcgctacacgtggtggcggcctccggcgacggcgaagggtccctgcgctgcgcgcgcaccatctacagccacgccgcgcgcctcctggaccgccccaacgcgaggggcgacacgacgctgcactgcgccgccagggcgggcaacgcggcgatggtcaggtgcctcctcgacatggccagggaggaggagctcgccggcagcgcgggcagggtggccgaagtgatggagaggcagaacggccggcgggagacggccctgcacgacgcggtcaggctcggcgacaagcagctcgtcgaccatctgatttcggtgcatccccggcttgcccgtcttcccggcggcgacgggatgtcgccgttgtacctggcggtctcactgggccacgaccacatcgcagaggctctgcatcagcaaggggacgagctctcgtatgcaggaccggccggccaaactgccctgcacgctgctgtcctacgcggtgcaggtacgtactcctacacttttttttttagaaaattcctcatatgccacctaaagttcacaggttttcttatatgccatcgtaaattagcagttcatgtatatgccatcaaacagaattttcgttcatctatgccatccacgtcactcaagagtagtgttagctttttttttgaaaaatgacaaaattactctggattccctttctttctatgtaaagcacaaatcagggtgagttgtagttgaaactatgactataactttaataatcattactgattcaacaaacaaccaataattggatgcaaagtttgtttctctcctatttttatagttaatttatagattatagaaagaaatagttcataatcttttaaaatgtcactaagaacaataatttaattagttataatctaattaatgtatctaactggatgtaagcattcaatttagaaaaaaaaaaacaaagcaatctctcagctagcaaactgattatatgcttaatttaatcacaaaaataggtatgcttaacttaacaagctgcgtgcttatttaatatcgccatggaagtactccccctgtcccataatattgtaacataataccggacgagacacttcatagtataacgaatccagacatgtttactgtactttaaattcgttatattatgaagtgtcacatccagtactagattgctatattataattataagacggagggagtaagtaactttaggataccgacattagtgattaacaccaaaaagatgcatcagctttgtttactcgtagtaagaatactaatacaaaattgaggagtttctaaactattgaccagcttttccctgagccatgtctagagagtggtacaccaacactaggaagataaaatggggaggctgtgcataagaaagaagggaaaatatagtttatttatttttaacctcttttttccaataaagaatatacatgtgaataattaaggaagtgaattgcgaaaaaactatagcaagttgctactccctctatcaaattgatctacatatttcataggtataccaagaccaaaaaaagctaatatctctctcatactatatttactctagcaacaaactcgatgcatgcaccattctcgctattttctagccaatagcaaatcaagatattgcatgtggattataaatacttgcgtgcatagatgcatacatcaatgtctatttattccaatgcacaaataacaaatagacttaatgaataaacacaaatatatagatcatttaggaataacaaaaaaaaaactatatgtagattagggatggcaatggggcggggtgggactgggttggacaggaacggtcctgcccctaacccccgactttatcccccgtccctggccccggtaccatcttcgtgtgaaaagcttccccgccaccgaccccgaccggggccccgcaagctgtagagaaagaggacaaaccagaactgtagcagccaagatgcggtggcttatcgaggaggccagtgtcgcggagatttggcggaggtgcagaagccggctacgcgcgacgaagacaaaggcgaagcagccgacgacatgcgacgaaggcacaacagccggcgacacgcggcggagttgcagcagccggagatgcagcgaaagtgcagcggccggtgacccgcggccgagacgaaggtgcagcagccggcctgggctgacgaggcgcagccttgcagggagctgacgaggcgcagcagccgtgcggagtcactatcgcttgcaacgactgcggtagcgccgatgcagtcgctactaattgactctatctttctttttattttcttttgaaaggtcattgactcgatctggatgggtggctccgtgactatgtatggctggggtagataagacgagataaggaaaaggagaaaattgcatatgtaccatggtataaaactggtttcgcaaaaatatcatcattcaaatgggtttcgctagaatactattctcaattgagtacacttcaccactttgccattttcattatttctttcattttaaattcattttatcatctttgcatctctttttgactgaaatacacctagtcagcaacgttgaagcacttcactcccaacttgaaatggatctgatctgcaacgtaccgaccaagtttataatttagcatataaattatcctccaacatttagcatttaattcgagaaataaattaaattaaattaatcaattacatctacaactcagattcaaatatttgaataaatcaattgcgattggacagagttgattaatttattttattttatttctcaaattatatgctaaatgttggaggagaattataggctaaattataaacttggtccgttgcagatcagatcattgcacgtaagtgcttcagcgttgatgacttaggggtatttcagtcaaaaagagatgcaaagatgataaaataaacttaaaatggaagaaatgatgaaaatggtaaagtggtgaagtgtactcagttgatgatggtattttagcgaagcccatttaagtgatggtatttttgcgaagccagttttatgcgatggtacgtatgcaattttctctaggaaaagttatttcacaacatgggcttgtttgggccacatttttaatgggccatctgcgtatgtacaatatttccgggtccccatgggtcacccgcgggtaggaatctagacccgcccccgtccccgcatatttccgggcccccgccccgatgcacctgtggggccaaatatagccccgaccccgtccttgtaggggcgggtccccgtcggggaaattgccatctctaatgtaaatcaatttggaatggagatagtactattgggattgcctatccatttgtcgggtgatttctaaaaaaatcatccagatttttctacccttagatttacatccaacggactacaaagaaaaataaaaaaaaaatacatactccctccatcccataatataagggattttgagtttttgatggcaacgtttgaccacccgtcttattcaaaaaattttgaatttattaattattttatttgtgacttactttattatctataatactttaagcacagcttttcgttttttatatttgcaaaagaaatttgaataagacgagtggtcaaacgtttcaagcaaaaactgaaaattccttatattttgggacggagggagtatttacttacacaacaattttatcaaaattacaatgcactaacatgtcatattaactgaatttacaaatgtaattgtagttatatagtattgtaattttatattttaaagaaaataacaaatagatatttacttacacaacattgttatcaaaattacaatgcacttacatattatatcaactgaatttacaaatgtaattttaattatatagaactgtaatcttatattttaaagaaaataacaaatagatattcacttacacaacattgttatcaaaattgtagtgcacttacatgtcatatcaactgaatttacaaatgtaattttagttatatagtactgtaattttgtattttatttttattttaatttcaaatgagagaggagagagagcatcatgcatgtcgatttttcagagcaaaaaataaaaataaaatagtgactctaaccatccgacgctgttacacgcgacccaactgaaccctatgcgggttcccagcccaacatatacgcacggatcttggcacatatggaacggcctaaaaacgacaaatctgagagaaaaaaaatcacatgacaaatctatagcaaaatcgagtactttttaaaaaaattgatccattctttgatatgcaagaagtaatatttctccgttgatttcggaggcccatcatatgaagcttttatggtgatccgataaatattggtgaccatatgcattccgattggtttcgttttcatatctggattttagagtattcgtttcggtttttaaataaaaagatgaaagcaaatatagtagaggtagctttcacagtatccgagccgtacgttttcattcctaatggcagtttatgaaaattcaatcaactgatgaataaacactcctttacgattgctaagatcacacttaaaaattattcttaaaacatcacagtttaaaattatgcctttttttaaaaaaaaaacagtgctgagcaatagtttgatagctaccgtgttgtatattggtttatcttaagctttgctttgtaaattataaagaaatgacagaaaagatgctgcaatggaacgatggtctctccggcgaagccgacgcatccggcagcacagcgctccatttcgcagcctcagcggagggaccagagatcgagctcgagaagagctcactcctccggcggctcgccttgcgatggccgtgctcgcgcaatggccgccgccgccgccggacatcgactcaagttctcctgaaagccgacccgtccttagcctgccggccggacagcaacggcgagtaccccatacacgtcgccgcgtccatgggaaacctcaagctcgtggccctcctcctccacaggtgcccggagtgcgccggcctccgcgacgcccgcgggaggaccttcctccacgtcgccgtcgaccgggggagggaggagatcgtgggattcgccaccgacgacaggcggaggcgggacggctctcagctggcgacgcccatcctcaacgcgcaggacgacgacggcaacaccgcgctgcacctggcggtcgcgagcggtgtcctcaacgtgttctgctacctgctgcggaatcgcagggtttgcttggatcttgccaacaacgacggcctcactccggctgacctctcaaggtgtaccattcccgctgggcttaactacaaaacggtaaatcactttcgcttgactggtaatttctaaattctaatgttacttgcctctccatttaatagagctgtctacatacgtatgtaccattgtacctacatacatacacatacacacacatgtgtgtccaatatgtatgccatgtgatcaaactcatccaatttatataaaaattagataaaaataactatacaaaaccaccttagggagtaatatgaatggttttgcaaagatctgattttaaagtttagggtgtagaagtatttctatctaaagtttagaggagtatttggatatttttttttcttttttaattgttatatagggggaattttacagttgagatatcaaaattttagtaccttacttaatacctagaagtattaaatttaccatagaaatatggtacctcttagtaccttctcagagatattaaaattacccttgttatagacatctctagtctctaaaccaactcatatataaccaatcaactgaaacatagtaagtccctttaattagagatgattttgcatctaatttagtaatttgttgatgcagaacgcacgaacgtggatactttggtccctggtggtagcgaaagccctcagcggcaacatccggcgcgatcacttccagcagcagtacgtacccaagctagacgagatcgccgagtccaagaaaatgacggagtcgacgcagatcctgggcgtcggctccgtcctcgtcgccactgtcgcgttcgcggcggctttctcgccgcccggtggctacgcggctggcgatggtaataataacaatggccgtggcaacgtcgtcgtcgtcgcgggctctccggcgctgtcggggaggtacgccttcgacgcgttcatgtacgccgtgacggtggccttcacctgctccatgctcgccacgttcagcctgatctacgccgggacggcggcggtggactggaagatccggcacaggtacttcaagcactccctgtcgtggatgcgcaagtcgacgaggagcttgctggtggccttcgcgctcggggtgtacctggtgctggccccggtgtcccgcgccacggcggtgggcgtctgcgtcttcaccaccggcacgctgctgttcaggaacagggaggtggtgcggatgctgatctgcgcgtacgtgctgcagaggaggatggggatcacggtgctcgcgaagattggggtccccatcaccgtcgacctggtgaagtccaatcttgtctacttggtcatcttcggtgggcccctttgcactccgctgtgcgttctgttctttgtttggaggctagcaccagtgattatgagatacgtccacagaaagttaatatgatgcggtgaacatctctgatgtgatatcatattagatggtgcatgacttcaagcgttagggttcaaatctgaacttcttccgtagtcaacatatatgccaatgttttcctaaaaaaacacatatgccagtgcacttttattaagaattttaataattgttacagtgcatgcatgtgtgtgtttttaaggaaaattggaaaaaaaaagtgtcgattgtcaatacaactccggctgggatatatgatatgatttggggttgggggaggaggaggagaaaggggtgaaacggggggcttcccccagacgctctgtaggcggcgaggcgctggtattgataaccggaacggtacacacggaaaatagagcaatcctttagtacattattaattaattattagctccctctatttcataatgtaaatcattctagtattggctacattcatatgaaacacacgttatgaatgacttaacatattaatatgcatccacattcatattaacttctatatgcatgttgtcggtgacatgggatcaggagtatcatgactagaggtttgaggcagacacaatcgcatacgtggcctggtacccccgagggacgtcgggcccgagggtgatgcattcgccctcctcttagtccccccgagggggtc

SEQ ID NO: 66518 - DNA, 5919 bp, Oryza sativa
aaatggtcaacaacgcatatgctaagatgataaagatattttgtttagttcagcgttcttaaggggggaggggggaataaaaaaaaagagggaaatggtcaacaacgcatatgctaagatgataaagaaattttgtttagttcagcgtatcttcaggaaaaaaaatctaactaaaaaaagagattaagctcagatgactaaccaagcaaagcaaatgatcattaaactatatctaaacagcgtaaccaagatttgagctatagctgaatttagtggaaatgccatgaatattggccacaaaatgacaacaacacttaccagacaagatgaagccagatattatgagaatctgaaaagaagaattaagcattagtgtcagcagagtcactaaaactcaaagtcatctgcatcaatgtattatagtatctactttaaaaaaccctaacaagaataatctgaggggtgttgcttgagtaattagtgataaggaaaaaaaaaggaattccttttctcctttttgtatatttttcccttaataataaaaatcttattatcgaatgcagcctacttgtcctgaagtacaatatttccctttcacacttcagattaaacttatgaccaattatagaaaaaaatattgtgtagtgctaaaaccacgacataatacagacaatgctatagtaattactcacccatcgagttgttgagatctcactccagccatgagtcacatctgatagatcctttagtgttgttccaacatataccaatgcaagagtgataggctggcaaaaacagatgtgattaaccaaaaaaaaaatgttgcaacacttggtgggttgattcagcattttagataaatggtaatacagtaagccgcaaagtagttaattacagtgggttctactgtgggtgcttttcttgtccatgtcaatatgtaaattgagaactatggaatcaaataccaacttctgaaggagaataatgtataaagcagcagattatgcaaaaggccaacattgagggcatgattccaattaacacaggtaatatagagtagcaaatgatatcagagcctggttccatgttatgcaagtaaaatgtaacatagcagatgataagagccaagttcactggccaaccagtatgtagcttggtcccataaaaattgcttaaataagaagaaattggcataccatcatccccagccaagaagccagcatgtactctccaatgccaacaggagtaacggacaacaggtagttcaacatgttgaacggaagtaaaggaacaagccttaataacaacacaatctgtaggcaaataagtaagacaaacattgttagatagttaaatacactattgtattaaagagaactttagttgcatgcaatggtaagacttgaatagaaggaacaatgaagttcaggatgaaagcaggctcaaaagtttatttttttaaaaaactatataaaaataataacaatcaagcaactatagttgctagaaaagtactttcttttcaagaacatgcaaaagatgtgtacatgattgtataaaaaagagagcaaaaaaacaaaaaatatagcaaagcaaagcaacaaaacatatagaaaatcacaaaaattgtcaaagagaaataatttaaacgaggtgaattctatatgattatacgttgggcatccaaattgttactatttgaatgcaatttcaaaggcattaaaaaacatgtggcacaaaaaaatgctattttacaaagcatttagatgttgatatatccttcatcacatcagaggctagaattccaaactccatggtgcaagaagttaccttgaagccagacctttcgatagcaatagctaccgcttgaaacttgggataatctttgcatttggagagaacatatggccttcctatctgaaaagtactaaaaccttaatcacagaagtacataaaaaatacaaatagtgaaaaccataatcaaaattatccttaccgttctgccaagcaaaaatgcagcagttgcaccaattgttgctccaatggaatcagcaacaaacccaacaggcaggccaaacagataacctcctccaagctggcaagtagaaaatgcacaccagccaattaattgatatacaccagaatattatactctcatcatcttatgtcactatgtcaggtaaacaggaaagcagagcaaacataatttccaccagaacaatacagacaatggtgcacttgtatataaactacatattttgcatatacttatcccaatatattcactaataatcctacaagtgggagtggtgagcagtagaaaatatccaggaaggaaaaggttctaaaacttcttttaaacaaaaagttgtatgcaccattgccatcccatacaacatttactgtatacagttaactgatgactacagagttgtggtacaaaacattaagcctgtggtaaatgatacatcaataaatcaattgaagattgacaagataatactagaattgacagtttattcttaaaattgattctaatgaaccaacgcagcatttctcattttgtttctcattctttcttcagttcaagcacaatgtaaactgtgaaatatatatcccaggtcaggaatcattggtctgcttgagctctatcagtctgtcttagaaaccaatattcatgaaataaacgaccgtaagaaacagaaggtgattgtgcttactgtaagtatggatgctggaacagccaataccgtcaaagggacgtaagcaagagccctgaaatgcacaacacgatagctatcaactatatatcacaagactgtttgcagctacatttatgttcttgaggaacaacactaagtacagataagtaagtctatatataaaaacttgagtcacactacctcagctctatgtcaaaacaatgaaaacccaagtaacaagtagtaaaatacttttacatccccttttcttttttgtatcatgtttgttggctaccttttagcatgagtggttcctctgaaatgcatcattatgtaatacagagagcaccccagacaggtggtgcatgtgtggaaaagggcatgcctaactgcctaatgccgaagatggagggggaacattctgttcactatatcaatcgagttaaatacaagcaaattgaatacttacaataccagaggaccccatggacccaagttatccttgatccaaaccagaaagtccttcaaaatctgtcaatgatgcattgcgattcataatgaataaaatgaaaacgacaagcatttgaagcaaaacaaaaacctccaattagttttaaatatttataatcacaacaaagaaattaaaacaattgctggcaagagagaaacagggcatgcaagaaatgtagaagaagttaacagtacatggaagattgtagacttttctaacaaagataagtctgttaggtgttaaggaactagagatctaacaagacaataaaatcttctacctccgtcccaaaatataaaggatgctagctatgcatcccccctcttcacttgacgctgttattcctgaactatagcattcaacacggatgcagaaagccaaagaaatacccttgtgatgctagaaggacatgtatttcaatgtactgaataattcacacaacaatggataggctaaatagctaaatctccaacaatcctaaaattctaaaatgacaaggtgacgtagcctttcgtacttaataaacttcggccagcttttcaagccggcccggcgacaaggtgacaaggtgacgtagcagcctacagttaactcggtgtgacaatcatcaacgggagagtgcatccaatcacggccacaaacaaagctacatttcggagttctactaagttgcacaacactaccgatattgcacattctttttgttaaataaaaaaaaagttgcgacatgatcgtatctgaaatcaccccgatatgaagcaagcaaagcaaagctatcgcgaaccttgtcaacggggagcgtgaaaagcgcgacgccgaccgcggcgaggagcacggcggcgacggcgaggcggatggccgagggccaggacagcgccatggacgcgagcagcctccgccgccagggcctgagccccctgcagtcctccccctcctcccctccctccgcgccgtccgcccagccccccgccctccccctcgcccgcagccccaccgctccgcctgccagatttgcccccagatctgccccctcctcctcctcccctccgccccccacccccgcgtcacctcctcctcctccgagcctcctacaccctcccgcaccggaaaatcatcgaacacctggcgcgcgcggcgaggcgctggatctggagcacgcgtcccgcgcgttgcgtggcgtgttggcctcgatttttctcggtggagaggaggaagggagagagggatcggggagaggaggagaggcttctcgcggcgcgctcgctggcttggcttggctcgcgcgtacgcctcggcttgcgtgcgtttgcacctaccgctccgacgtcgccgcgtgccggccaccgacaagatgcgacgcgtgtgccgcgacgatgcgacccgggggaggcgaggcgagcgagcaaactgatcgcgcgaggacggtgatttgtgtgggccgagaatattgggcctttctaaatgggcctgaagtgcaggccacgtacataactgagctatacatttattaacaaaatttctcttgaaaatttatcggatgtaaatacagtgtgaccatagtgtagttatatatcgtaaattgcatataactataaaactgtattgtatgtaacttttaaaaatctcacactaacacgctattttcgagaaacgtaggtcgcaagaggacgagactgaatcttctcacacgtgcacgcggtatgatttttttttcttcctgacttacacggatcttgaagtaaatctaacggattaaaattttatgatagttacatataagttatattgcagttatatacaaagtaaaaaaagtaattatgctataattatatattgtgtttaggtttgacaggtcctagaaagaaaaattatcaataaatatatagcaaaatcattccggaattcgtagaacattttgagaatgactaaactacaagataataaatacacacatttttcttatttatatatggcacgtggtacagaagctccagtttgcaatgcaatggttagttctccaaccccaatgcatgcacacgtacgcttgagtacacagtgttcttagaaattaaacattacaaggaactagtacacaaacttccatagctagcccaagatcagaccagcaaacacaagaacatacacaccagtattacaatatgtatatatctctctatatatactataaaaacgaagtgttaagcgactggtggtaattaattaacacacagcaaaataccataatactgctcttcttaatcacacttaccagtgctaatcctgaagaaaacacgcagcttaagctcagtaatgcatggtacattcgctagcttaattagctagtagccgccgcagtggtaggtgtacttgcagctgtcgccgaccttgacggtgtacttgtgctgcggcttcacgaggaatggcggaaggcggagcagcgcgtcgcacacgcacgccggctccacctccttcagccaccggcagcagtctctgttcgcgcggtggtcgtcgtcgtcgtcgtcgtcgtcgtcgtcgtcatcgtcatcgtcgtcgtcgtcgtcgtcgtcgtcgtcatcgtcgtcgtcgtcgtcgtcgtggtcgtcgtcgtcgtcgccgccgtggtcttcgtcgtcgccgccgctgtcgtcgtcttcgccctcacgcacgccggggtggtggcggtggcggcggcggcggcggcggctt

SEQ ID NO: 66519 - DNA, 12273 bp, Oryza sativa
gccgccagcgccgccgccgcctccgtcgtctcctccactatcgtcgccaccgccgccaccgccaccgccgcctccgcctccgccgcccccgccgtcgtcgtcgccaccaccctggtcatcctcgtcatcatcatcatcatcatcatcatcgtcgtcgtcgtcgtcgtcgtcgtcgtcgtcgtcatcatggtggtggtgatgatcctcgccgggaggcaggatggcgcacgcctggctggcgatggcgaactggctgaggcagaacttcttggtctgcgccgccgccggcgccggcacgccgacgaacgggagcacgagcaccgcggcgagtatcgcggcgcggagcacgggggagccagccattgccaccaagaaacggctagctagctagcttcccttcttggatggtagtatatatctacgagttgtacaatgcagttgcttatatagttgtggccttgtaggagagatcgatcgatcgactccatggctgcaagtttgcaacgagatctggaagagtttttctttgcatggtcgctggatatgtggcgagatagatggccggggggtaggaaagcgggcgatgagttgtaggtgcttcatgctcgtggtgtgagtgacttgggagttcggtcggtctgagaattttgagtccattgttgttcacttgtgtatttgaccttttgagaaattttactgttgttaaagttaaagaaagtacttgtagttattaaaaattttggtacttgagttacctaataatgtgtgaagatatcaaattttacgttagaaaacgtggtaccttatgataccttgttaaaattgtaaaattacccttttacttggtagcatcaagttagcagcactttgtgtgacttgattagttcatctgcacaatttgaccttattttcttggtcaggatgagagtctctctctctatctctctctctgagtccatggtcccgttcatttcctctataaaaggtggataaaattttggatattcatcgtggcacgctttttaaactgctaaacggtgcgtttcgtacgaaaactttatatatgaaagttgctctaaaatattagattaatttattttttaagtttgtaataattataacaataatctatttttcaagtttgtaataattgaaactcaattaatcatacgttaataccacctcgttttgcgtacacttaatcttcattttcaggagaaaagaacatcaccatgtattgttcacttgtgtttttactttttgagaaattttattgttgttaagaaaatacttgtagatattaaaaatatagcgtaattgttgaaactcacaatataagttctaaaatttacttttttttcttaattgagatatcttaagaatagctagtcccaaattactttgaacattcatatatcaaccttggggcaaaacaaccatgcatacatctggatcaacaatgtggaatgtcttggtgctactgacaagtggagcccacctattgaagtgttatacagtctacttctgaacttctgttttgcctataatataaaatgcttgtgatatttttcatccatggcatgttgttgtcggctaaacctgcggttgctgggacagccagccgtcgtcgatgaagctgatgtccacaaacttgtgcacctgatcatcgtccagctgcttctcccatgccactctccctgttttgttggctcctggcccttcacacccagcctctgcaaatgtgatggtcgacctgaatgaacagaaacaaaaacaaaaatttcagcttaaaacacaacaacacattaagcccagttaagaactttctcttttttaaaaaaaataaaaaaagagagaaacaacgggtgcctatgagaaaaaaacggtcaatttttttcgataagggcacgtacaacggtgtttattagtggtctctctctactgccatgcaagtaaatttggtgacatggaggaaagagaaaggagtatggttgttatgcatgacaacggctcagagtcgactcttagcatttattagagcaaattttgttgcatggtggtgaaagaaaggaaagaaaagtaagaaaaagtattttaatacataaatgattagagaccatattgtctctaactgttgtaggatgctagtctctaaataacgcagagcttatatccgactctacctttgtacatgccctaatggaatttagtgcaacctctacgttacatatatatatatatatatatatatatatatatatatatatatatataggtatccaataccttataagcatgacttaatacgaaggtttcagggttcaaaatatattctaaatttgatatgaagtctgggttttggcaaatccaaataaaaaaagaggatatatataaaactgcctttactactcctttgggtcattatgaggggaacataatgccgtttggtttaaaaaatgctccttctgagttccaaaaaataatgaatgagattttccttccctttacatccttcattatagtttatatagatgatgttttaatattttcccaagatgttgaccaacattggaaacaccttaatatattttataaaattatagttcaaaacggtttagtagtctctgctaagaaaatgaaacttttccaaactaatgttcagtttctcggttataaaattcaatatgatcaagtccaaccagtagcaagagtaatagaatttgcagaaaaatttccggatgagataaaagataaaacacagttgcaaagatttatagggtgtttaaactatgtctccgatttttataaagatcttgcaaaagacagaaagattttaaccgagaggttaaagaaaaagcctccagcttggacagctaaacatactcaagctgttaaaaagatcaaaggtaaggtcaaaaccttgccctgtctttatattctagatcaagatgccttcaaaattatcgaatcagatgcctcagatcatggttatggaggaattcttaaacaaaaaaagaattccaaagagcagctagtcaggttcacctctgggacctgaaatgaggctcaaaaaaattattcaaccatcaaaaaaaaaatattggccatagtaaaggtcatatcaaaattccaaggagaattattgaatcaaagattcttgctgcgtatagattgtaaagcagcaaaagatgtcctccaaaaggatgtggagaacttagtctccaaacaaatctttgccagatggcaagcaatattatcatgctttgactttgaaatagaatatatcaagggagaattaaactccctaccagatttcttatctcgtgaatttttacagggctatggcacctaaaagagacttatcagcccaagggagaactacagaaagttcaccaaataagcataaatataatgaactaggaaatatcattcctagaacccctacagttcaagaaaagtatgggaataattcatcttatatcctcaatatagatgaggtaattctgccattagaatttggagactctgatctcaatattatcaagattatgggaaagtatttcccacaacaccaatattttatccctgaatatccagggaaagatcaaaattattatgagaccatattatgcgagacaagaagtgcacagatattccatacaaggaatggtgatgatttgggattcacaaaattattgatccaaaaaaatataagtatcgatgattgggataaatcatcaaatccttatgtagccaggactatatattctacatcctgtacaaataaaagatataactattgggattatcagaaggcctgggaaaaagtactcctcgtacaaaattcccagatgaagcattcatggtttattcgcttcaaagaaggatgtgaggagataccgctgtggtttttcagtaattggtggctgaaagcaggggccattcctgaaatcctaccacaagaaatcatcaaagttattacacaagaatcaaaaaaggatctcaaggaatatccttttatccttatgcaattttgtgccgaaacagggatgccttggatactaaaatgggacctcaatattcaaagaatggagttcccagcaaccttaaagcgaaactattatgcaagatggtgggataagtttgcaatcacaccagtaattgaaggaagaaagtttcgagccaaaaacaagaaatctcatgtggctcaattaaaagaagatataacaagagaattattaaaggcaagacccgagttgacaaagggagaattgcaacttcaagtatatgaaactacgtttaaaagattggaagaatcactaaaatctagttctacatgcaaaagtctagatgaagatatggtacaatgcagccaaattaagccatcttcgccaatacctccttattactcaattaagcaagataatgattcagatgaaggaatatcagatttcaatccaacacacatttagccaagatatgacgacagatcttgtcaccaagataatgagtaaagatcttgtcatccccgacaaagatcactattcaagataaggaatctacactattccagataagataagtttatggtcaaaaggcgatattatgacatctttattgaaggtcaaaagcgtcatcaaagattctctccatgaagtctaaagggatatcatgaactctttgaagtcaaaaagagatataatgaagattctctaccgagcgctatataaggggctcactatcacatttcagaggcatcgcattccacacacaacacatctcactcaaccattcctctcaccgctccaccagccatcacactccactccactccatctaagtgttagtactatagtataacctaaataaaagactcatgagagtctaagtgtgagagtctatgtaagagtccttgtgagagtcctgtacctgtataattacgaacgtgttgtaccaagtccttggtgtaatcttcagaaggatctaccttcaacctatcaaggtatatgaataaacacctggaccgttctatataaacctactatgttctaaatatctaattttatatcttgtacataattcgtatttacagcttgtctttatttcctgtactgcatttatgtttgcataataatataaaaaaaattaacaacctggattgccatccaattgtcacatactaatctcacatccaagattgcatatagataagcatttctatcctcatatctggtgactagacccctagtcactgccctgggttagagctggtatcagagccaagtgctcgtaacctccccaagccatcttctccgaaaggggaggggggggaagaggggtcgggtggcgtgctgaagtcgcggtgatcccgaacggtgtggttgtgttctgaagtcgcggagttcccgaacctttgatcggttgcccgaagtcgtgttgccttgttgagccgcgaaggcgtttatcggcataattcgttgactgggcacttatcaaaggcaaaggttgaacttaattgtgggaaatattccctgccgttgactggaatacatcatatccaaataggttgatcataattgtgggagatttccccgctgttgactggtaactacctacctatcttcctatctttcatataagatgtcttggttggttagatcacgaagagccactgatcaatctgtagtctgttggcactacgtcgataaagaatgcttcatctatatcttttgaggatattgagaaaagtatttccaactggaagatccctaaggttaatattaaggaaatatatcatgtatgtactttttcgtatatatatatatatatatatatatataaatatatgctacttaaggatttatgtccaatcatttatttaaatccttcgtggagcctaattgcctaagcaaagtgatatgcatgcatgtacaagcagttatatttgagcatacataagtggtgtactatttataatagtatgagtgtaatgatatatgtgcgtggtgtaggtttaatgtgagagtgttcgtgcccaacctagacatacgaacatgtttggcggaaccaatgtgtgtctagcccataaaaaaatagataaagtttatgcatagaaaatacatataaactttatatgtggaaacttttaattaatgaaaaattatatataaaaaatcagaatcgaatatataaactgtgggtatataaacttatcagaaaacgaaacggatgccaaaaagaaaaacacagtcatttgcacatgaccaagacacgcgaacgttggcgcattagctctttcaatgaacataatcatcttaaaacaaaacaaaaaaaagtttcttacacattgggggagttccagggctgccatccttggggcacgacgatgttggtcatggacacctggtagaacaccacggtggcgaactggttccacgcgcgcccgaggtactgctgcccggagcccagcagcgagccgcccttgaacaccagcccaccggggtcggcgtcggtgacccgggcgtgcgccgtcacccaccccggctgctgcggcgacggcggcggcggcatgttggactccagcgtgcagttgtcgtagatggactgcccgtagccgaagatgaagtcgacgccgcccctgacgtagcagtggtggaagtagtggcggcccttgaggtcgcacagcgtgtcctggaggggtggtaatgggtcaggtccgtgggttctttcacaagccatcttaacttatttaagtaaaaaaactattgaatttcagtctaacctttttttatccaaccctaacattttctaggctaaaatgttaggcccattatcatccctacctggaaaccgtagaaagcgcagtcgtagaaggcgctccggtcgccgccgatgagcgccgcaaccgcctggacgggcttgctcttgtcgtacttgttataagtgttctaccatcatgtatgtatgcagtgcaatgcaagccagtgtcatactcagtaactcggagccaaatatagaagcaaggtactaacttcgtgtcaaaatgtaacagttttaaactataaatatgaacaatgtatctagacaaattgtccagtagttaaatattgttatattttagaatagagtaagtactttgtttctggtaattagtactttcctaaattcgtaacactgaaatggcatcgagtagtattgagaatactttttccttaaatattccaaatttctacgacatactaaaataatatgaactacataattattgtactagatctagtgagccgcataagagcaagtacaatagcactataagccagttgcaaatatattttaataagataaaagatgagagagaagagcagcgggctacaactctgtagccagctacagcacggactccaagacgcaatgtgtatatgacagtgggaccatatgctaatagtatagtaaacaactattgtatgaattggctgttaaattggctatagaagaattggagctagtagttggctgtactattgaccttgctctaaccaaagcctttatttttttttattttacacgaaagacacatacgtacagatatgacacaccaaactagacacgcacttctattattgataggggaaaaaacctacgggatattcctagcagcactctaccagccgagctatacgttgttctcaacacgtatattttaacatatgcatatgtaccctgaaggagatgctgcgagcgacgaagttgtcggcgaggacgatgaaggtggagctgtcgaacgtcgccgagccgccgacgtcgctgtagccgtggttcaacagctcgtcgatgctggcgtgagcgtgaccggcaaaggtgatctcggtattccaagacccatccccttccagcactatgaattgtttctgactcgggatggtaaccttctccctgcaatccatgcacacacacacgaacacaaacactcaccaacaaaaaaactctcgaaaatccaaacattcttgttgatcttttctttctttcttttgaaatgaatccaaacattccttgaaatggcatatcagattgacagtttgaaacttcttgaaggagaaaaaaggattagcagtttggatacgtactcgtagcttcctgcattgacatggattttgatccagtcgcggttgccgtcgggcacggagttcaccgccgactggacgagcgtgaagtcgccgccgccttggtgatcgacggtgatcgtcctcgacaccggcgccgccgcggagctcgtcgcgatgaacaccccgagcagcagcagcagcgggaggaggaggagctgatcatggcgagatggctgcattttggacacgaatcttgaggagaagaatctctctcgcattgagacgattggtacatgggtgcagaatttatccggtgattaggccaaagcgcgtttacacttgcctgtgctggcatctgcagggtggcgttttacagagtgacagatttggtaggtgttcaactggctgcatatattggcattaaaccaggggaggataatatggttagtttagctatattgatttaaaaccctactaaattttcgctattgttaccacttatacatagagataatttagaaaataccacaaacagtacaccgtattgaaatagaatattagcaccttttcttatcacttgtagataagactattttcataatatatgctgaagtctacaattatacggtattgaaatagaaattactaccctgtcttaaaatatactacgtaaacctagaactgaatgggacatatcgtgatactacaaatctagataagaggcatgcccagattcagtttggatggaaggtatacccaaatatggtacataagaacatacgaacagaaactccttgcacggggatagaggttgtcggagtccgacccatgaaaggcatagtcttatttgcccgtgccctacaaagactctccgagttctacttgaaaaggaagttgcttacccgtgtaaatataatgctccatgggaggtgagtacatcaaatcaagccatagccacaagccgtatcgtagattcatctaaagaaagtccattgttagtcactgactataagtaatcggatagttctcagtgagtactagatggtaagctagattagctagcttgctccaccattgtaacccgtgagagacatcccatagttatacatattaactagattaggactattaccgatctcagggcctaaaccaatataaaaatcccctgtcttcatcttctttactgcaatctcacgtatatttgcgaattaaggatctccatacttcacaaataccgtagatgagtatagtccgtcaacggtatatataaatgaacaaccacaattgacaacacaaatagacaagtgagccaaacagacacccaccacccatatttcccatcttattcttaggttgaaattgcgttgccaacaacttaaagggccattttgatttaaagctatgccaaatttttgtggtgcctatttttggacttgctttagtataattaatttttggtaggataaattgtaacgcctctatatatttgcccaaagctctcactatcttgtaccattgggagttgccaaatattccctagttccatgtcaaaatatagcaatatagtaccagattagcaccacctaaaaaataacaatctagtacgtgattagcaccacctagtactacaaagtatgaatatggagaaatctatgtctagatttgagtcctatgctagttggtatctaataagtattatattgctagtatattttacaatagaagtaataacttgaaatttggatttatttaatattttagagacttgtataagaaaattttcgcacaaaacgcgatgtttgccatccatgtcgtgaattgaacacctcatttgtgaactgctttagcaattgtattccccatcgtagcttttctttattcgtcaactgaacccctcattcgtgaattgaacacctcatttcaaaagcttactaacaaataccgtggtagaatctaaatcttaataaaaagtaatggggccttataaatttaatttttaagtttataataattaaaacttaattaatcctacgctagtgactaatccaattcgaacgggacaagtgcacactccaaccatcccctgcctctgtagaaacaaagcacctccggcttatttggcaacttgagggaaggggattgagagtttacacgagggaattgatggtgagattaagatgggaatttgatttttcatcctagtctcttgtttggtagaggtggtagaaattgatagggagtttagttgaagattagatcattaatgaaaacggatggctgagatttgtttaggcgaagtaaaggaggaattccctcccaattacctgcccctactcaggtattgaaaaggagggagtttattcctcaattacccatccccatcccaccaaaattcacatgtcccccaaccaaacaaaacagttaatagcctcatccctctaaactcccaatccctcctaaaaactccctccaaccaaatagaccgcccgatcatgacccccacggccccaccccatcacccaaaaccaccgtctacgtacaaaacagaactagttttgagaaatggcaagtactggtaggttttagctggttttgcacccgagacaaaaattagatgaacacaagaattgagacatggaaataaccgcttttttcccttatattctaagattaggcatgtcgatacaatttgtaactaagcctctatactaatcttgaaagctgtagtagtgtatgacaattcattacttgcaatgcaataagacaaccttcactacattttcctacctttccttattcctcttgaaaattttgcagtgcgttcctcttgaaaattagcactcaacaaatgaaactatcaatccaaaaattccaaacctctgttcttcgatcatgtgtaaccctaatcagttcagtttaatgtatttaaattaacatttggattacaaattgaacatttaaataccaaagacattgccaatgagacggtaaaccgctaggctaacgacataatctatgggtaactaaactgatacaggacatctcttccccacaattgaactccctcccgtttctgcatttgcagaacagtgctaagaactaagatacatatgtacagtggggccggttccatctcttttgtcaaggagatttcatggtaagcccgcacatgaacggagacattgaaggactcttcacggctcaaaaacgagaaaagaccagatcaaaattatatagcctggaaaacaatgcatgccatgagtcagatgaacataatacaaacagataaacgcaccaagcaactgaagctatgatttctgaagaaataaaataaactgtgtaccattaaatattgtcagcgattatccgagctccagtaacgaaatatattgccactctgccattatgagagtataagttgaaaattaccgcatcatcatgaaaggggaacattgggggaaaaaatatgcaaaggagattgcttaaaaggtttattatcgagaggtaccgcagctgaggctcggcaacagttctgaggtaaatgaggtggaaagctcctctgctcccagtcatctagggtgtttatcatgattgtgtcttccattcctcctccaacctgatatcacaaggatggttaacacaatcgccatgcagagttgctagaactcgaaacaaaaactggtattcttgacaggacacaacatgcagaacaaagtgttgggatcatgaagtagtggtgaaggtaaaagaaatatgacttctttaagagcacaacaaaatatgaaataccatacctccttcatggggaactggatggtccatcgagtgtctagggccaggagggtacttaaatctcctaggaggcattgaccacccagggcctggccctgttggaggattcgatggttgcctacaatgaaatggggtggacggaccatcaaaatggtctggaaatggggggcctgtataccattgacaacaaaggtttgttcaccataaaagtctaattgatgaaaaaacatgtgactgattgtatttcggcagaaatcctaatatagacacacaggcagttagtttaaaacaaccctcataaatatatgtagacagttaggcacaatacttcaacatacctggagggaagtgtgggggaaatcttcctctatcaacttca

SEQ ID NO: 66520 - DNA, 11706 bp, Oryza sativa
tcacctaaccacatttattgcggtttggctaagcgtgtcacgccgcatgtaacgcagtgcagtgcactcgtttatccggtctgtgaccagtcacagaccggtcagatcgtgggttaggtggcgacaggcgatctgatgcacgcctcgccccatcccgtcaggacgagggcttctaggcgctcgtccccagctggagctagcgtgttacctcctagagatggcacgttagtcctggtcagatatatgccaggcttcatcctaaaccattataggcaagatgttgtgtgaagaagggcgagcatgtagattgctaagctgacacgtggtggacaagaatgaccgacgtgactggtctgataccggtcatgtcgtcagtagacagccacgattccacgtcgcacctgctcccggcgaaagtggaggtagttgtgggccgtctcatcagaaggtgactcggacggcaactatacaaatctccgtccatttatggaaaggggggggggggtaagtccccacaaaaaaagagagaaatggtgcatgtggtatccccttaagatataaaaggaggaccttgcccactgagaggggggattggacttttccagattagaaacctagaacaagggagaggctggctgatactttgtagctccttcatacacagatctcccaaaacacaggagtagggtattacgcttctcagcggcccgaacctgtatacatcgcccgtgtcttgtgtgatttcactctcgcgaactttccacagaccaagagcttagaacctcacccagggcccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgtgacttcgacacccacaggaggtggagaagggcggcgagatggggagcgtcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacggagggcgcctcctcgtccggagtgtcacctcaccacggacgcggggatcagccctccgtgcccccagttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgcccggggtgacgacagggtcatggcgaatttctttcccatggccctgaaaggacaagcgcggggttggctaatgaacttgccacccgcgtttgtccactcttgggaggatttgtgccaacagttcaccatgaacttccaaggcacatatccgcgcccaggtgaggaagcggacttgcacgcagtacagcgaagggatgatgagtcacttcgcttgtacattcagcggttctgtcaagtccgcaacaccataccatgcatccctgcgcacgcggtgatttacgcgttcagggggggtgtgcggcacaaccgcatgcttgaaaagatcgcctccaaggagccccaaactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgaccttgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgacgaggacatcgatgacggcgatgatgacctaggtttccaagagcctggggccaccattgccaccgtcgatgggggagcgtgtgctcacgtttctcgccggagcttcaaggccatgaagcgagagcttctggccacggcccctactcatgaggcgacgtgtcgggcgcggtggtcggaggttgccctcaccttcgaccagaccgaccacccaccgtgcgttgcccggggagggcagatcacgatggtggtttctcccaccgtttgcaacgtgaagttggggcgtgtcctcattgatgggggagcggccctcaacatcctttcccctgcggcctttgacgccatcaaagccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgccgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcaccgtgcggccgggcgcaaggccggtccggcagaaagtgcggcggcaggccctggaacgtcaagccttcatccgcgaggaggtggcgcgacttctggaagccggattcatccgtgaggtcatccatccggagtggctggcgaacccggtggtcgttcccaaggcgaacggcaagcttcggatgtgcatcgactacaccgaccttaacaaggcatgtcctaaggattcttaccccctgcctcacatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgccccccagcaaacttagggatgtgcaatgcgtcaccggttgcatggccgccctaagtcggttcatatcgaggctgggagagaaggcgttacccttatttaagcttctcaaacgctccggaccgtttacctggatggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggagagagcagggaggagaggctcccgagccgaacggtggcccaaggcccctgacgaccggagttggccctctgcccgcttgtcagacagtgctaggagcccccgacccccaggaaggccctgaggccactgtgggaaggccgcacctatcgcccttcgaccccgaggctaaccctgtgctgacccgacccgggaaagagcaggaagaagaggcccccgagcctaacggaggcctaaggcccctgacgaccggagttggccctttgcccgcttttccgacgacgccaggagcccccgacccccaggacggccccgaagccactgtgggaaggccacccctgttatcctccgaccccgaggtcatcagcacagaagataagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcgcggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccgccgcctcctggtgttaggcgactcccagctggtcgttaaccaagtctgtaaggagtaccagtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccctgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcgacgcgcggctaatggaatcctcttgaagtgcattcctcgggaacaaggcgttgtgcttcttgccgatatccatgaaggcgaatgcggagcccactccgcctcgcgcaccttggttggtaaagcttttcgccagggtttctattagccgacagctcttaatgatgcggtcaacctggtccggcgatgtagagcgtgtcaattccacgccaagcaaatccattagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctccccgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgggagtcaggtttcgggctcgggccaaccccgcaccccccttcgggcgtgcagggttggccgggggctacaacatatgcatattcttatttctctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctagcctggtaactcgccaggacgagctccaccgctccttgggcgaggtccctcgaggatgacttaattgtcttctcgagctcctcggggagccgttggagagccccagccatcttcgagaggcgctgggcgaggcctccctggttggcggcgtactttacggtccgccctctccagaggcccacttgccgaccggcgcaatctaggcgggagacggcgtcccaaagcatgccgggccctatctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcaagctcagcggcccgttggttcaatacggccctctcggcggggcaccttccagattgcggtgcgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtgcgccgccagcgttgcttcccggatggtgacggcgccctcgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgccggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgcctcgtcctggcgaaatccggcctcctcccgagcggcttccccggcctggcgggcccgggcggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgttactggcacgcgccgccccgccccctcggggaggagatgggggaggtgttcctccctgcttcctcttcccccgggcgtcggcagggcggctgctccccgggcccctgtcgcgggaccaagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccattgaaccaatatcttgaagtcctcaggagcccagtcccatctcactccctggtgggtcctcgtgaagtcttcggacccggtgtactcccaggcgccccgagcgcgtcgctggagcggtgcaatccgacgacggaggtagtcgccgtacaccatggcccctgtgagcccctgggatcgcaggcccgccaggcggtcgaggacggcgtcatagccatcccccagatctaccggcacccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacagtgaagaaccaccggaacagccgaagagatgggcgcaccccaatgaacatctcgcacagatgcgcgaagatggccaaggtcatcaccgcgttgggggtgaggtgcgccatctggagatcgtagaactccagaacatccatgaagaaagaagaaaatggtggaaccagccctgccattgcaaaggggagaaagaagacggaccgccccgggtagtgtggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttgtactcttgccaacgctgtgcccggctcctcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggt

SEQ ID NO: 66521 - DNA, 4650 bp, Oryza sativa
aagcacgaccccctcctggggcagattgttcccctcggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggggcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggacgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggtagtacactgccgtcgagcagagcagcgccccgtgccatggcggtggaggaagagatgattgagaacgagcgcgtgtggcgaaagtagggcgtagcagagaaagagttagagctcaggcggcgaaggcaagaggaacaatggcgaaaggaagggagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttgcggcgcatgaagtggatatgcagttgtggcaatcgaaatggattgtatcgtgcgcgcgttaattacgctcgccgaccgaagcggcgttaccatatctccgggcgagacaaatctgctcacccagattcgcgcgctgctcaagtggtgtggcagtcttgaatagaccgcccattatgaacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcgtgaccagaggcttgaggcagacgcaatcgcccacgtggcctggcaccttcggggacgtcgggcccgagggtgaggtgtccgccctcctcctgatttcccccgagggggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccagtcagatcacgggttaggtggcgactggcggtctgacgcacgccttgccccatcccgtcaagacgaaagcctctaggctctcgtctcaagccggagctagcgtgttatctcttagagatggcacgttagccctggtcagatttataccaggcttcatcctaaccattacaggcaaggtgttacacgaagaagggcaaacatgcacgttgttaaactgacgcgtggtggacaagaatgaccggtctggcactggtcgcgtcagcaacgggcagccacgatctcacgttgcgcctgtctccgccgggagtggaggtaggtgtgggctgtcccatcagaagggttcccggatggaaaccgtaccgatctccgcccattaaagagaaaaagaacagtccagtttggaaagagagagggcatgtggtatccccttgagatataaaaggaggaccttgcccatttagaagggggctctttttttgacttcttcccttttggaaggctgaggggaaagggagttaatcctttgtaactcgtccatacacaaatccacaaaaacacaggagtagggtattacgcttggcagcggcccgaacctgtatacatcgccggtgtctcacgtttcttgcgaggcgggtgatctttccacatacagagggagagcgagagcttgagatttcaccctaagcccccggccggactggcaaaggggggcctgcgcggtctcccggtgaggagccacgagctccgtcatctggcgcgccaggtagggggctcagcgtgtgttttctgagctctcgtactcttccgtgtgcgccaagtttcccttgttcagcctaatggccgagcaagcaaaggcgcacgacctctctccgagtgtgagcggcgacgatggggagccgaatccacgccgacgagctcgtactcccccacctgctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcatcaaggcggagggcgcggcgagcggcggcggctgcacgtcattcggctgccactccctcgtcgacaccgtcgactcgggaggatcagcatggggagccggatgcccgcctcaacatcgagcgccggcgtaatagccggcgtactccccgtgcaacggagggcgcctcctcgtccagagtgtcacctcgacacggacgtgaagatcagccctccgtgcccccggccggtggtgttggctgtagagcctttgtggcgagccttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaactcctccggttccggagtggcagcttcggccgcccccggatccgccgctcagacagggcggcgtgacaggaggaggaagaagaggccggaccgttccggcgacgagggtcatgtcctcgccgtcgagggcgctccgcgggccactcgaaaggggaggcctgcgagcgacaaaaagaacgaggctggtacacccagcagggagcgcctcgccggtaggtggtgctctgtccacaacacctccctccacgatctcgcggactgtcgtgcggtcaaaaacctggccgagcgaacgaggaaatgggaggaggacaggaggcaggaacgccgtgagggcaagtccccggcggttccttccggcaaacggcgaagtgaggccaagcagaaggcccccgctgttgacgtcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcactttcgaccagaccgaccacccaccgtgcattgcccggggagggcaggttgcgatggtggtttcccccaccatctgcaacgtgaagttgggg

SEQ ID NO: 66522 - DNA, 1469 bp, Oryza sativa
ttcctgcagccccgaaggatgccctctatcatcaaaatgatgtgctccatcatcaaaataatgccctccgtcatcaaagtgatgccctctatgatgaaagtgatgtcggctatcatatgcatggggtcctctgtcatgctcaccgtattgatgcctctcaggataggacggattgcaattccaaggttgtgtgttttgttggggttcgggagggtatgggtactgatttggaaatggtggatgtggtggtggctgcaagtgatatgcattattaggtggcggcacagatggtggttggtgataattatttccatgatgtggtggtactgacggcccagaaaaatggggtccaggaggatgaaatggtgcaacaggaggcggcggcggcagcggtggtggtggtggaggtggcagaggcatctgatttgcatgcccagcgtacccacaattgtagggcgctggaggatgtgatgaaactacacaaggatccatgttgcttctattgtttgcaacagaatgagggtgttgctcttgaatattctgcaaagaacaattaaacacattttagattcacagtatatgaaatttcataatggccttcctgcactgacattataactacatacataggtagttcttggaggatctggttgaactcgatcagctgccaatgctccttgcacctgcgaatcttgaaaaacaggacagggtggacgtggcaaaggtggtggagatgatggcaatggaggaggagaaggtggtttgtcatcaggtaagggtggaactgaatcaacattttgcttggtcgttgcacacctagcaacagttaaatctggttggcatgaggagatagcttccccttctgcttctgaggatggggctaaatcctccatttcatggtcaccatctacttcttccaggacaagtcgatgcttcgccacatgcatttgagatgcttcttgctcattagcacctgtagcttcatgttcaggggtaacagcttcaaagctcctctcctcagaggagcttccttcctcatcttcaagtagttttgtgccaatcaaatttggaagatgaaaaccagtgttgctgtgaagaataatcattcatataaacatgaattagtactaaacatataactaagtacagaaagatgatagagacagttcagcatgcacaaatgaggttagttacccatacaaaatgagaacacacctgaaagctgaaaggcaaaccaaattggtgtctgacaaacaaattttcactttttaagttttctaaccttcagtttgttatgctattgtccatttactaattttcaccactctatgcacaactgtaatgcccttaatgagatatttcatatgcttgatattttttacattctctgccagattttgtagtattgatatccatatatgtgtaccgagttttttctgtcatctgcccaccatacattcatgctaatc

SEQ ID NO: 66523 - DNA, 7362 bp, Oryza sativa
atggaaaccgtaccgatctccgcccattaaagagaaaaagaacagtccagtttggaaagagagagggcatgtggtatccccttgagatataaaaggaggaccttgcccatttagaagggggctctttttttgacttcttcccttttggaaggctgaggggaaagggagttaatcctttgtaactcgtccatacacaaatccacaaaaacacaggagtagggtattacgcttggcagcggcccgaacctgtatacatcgccggtgtctcacgtttcttgcgaggcgggtgatctttccacatacagagggagagcgagagcttgagatttcaccctaagcccccggccggactggcaaaggggggcctgcgcggtctcccggtgaggagccacgagctccgtcaccctgtctgatcccagaagagcggagtacgacaccttcgtccatacagtgcttcaaatggtgccatctgcagactagcttggtaactgttgttgtacgagaactcagcatacggtaagcttttgtcccatgctccaccaaagtcaagcgcacatgctctcaacatatcctctagtatttgattgactcgctcagtctggccatctgtttgtggatggtaagcagtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgcctcgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccaaaacttctctttgaggtcttggtacatcttagtactaccgggatgaatggaataccgagtttgatgagcctcggttagtatcaggtcttttaattccttgttttcgggtacacacaatctttctcccatccagattgttccttgttcatcctcaacaaaacctcgggcttttccaactctcatgttctttttgagctctgctatttcaggatcacttgcttgagctatgcgaacctgctccaccagtgtgggctgtgcctctagggcagccacgaatccgtgctcaactataccaaggttcagatgttccaaatcgcgttgaacctcacaacatagttgctctacccatgcaacattgcagtagctcttcctgctcaaagcatctgcaaccacattagccttgccgggatgataatgtattcccatatcataatccttgatcagctccaaccatcttcgctgtctgagattcaaatcagcttgagtgaagatgtactttagacttttgtgatctgtatatacctcacaacggttactgatgagatagtgctgccaaatctttaaagcatgaacgactgcggccaattccagatcgtgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagatgttctcaatgaaccggcggtaataacccgcaagtcctaagaaactccgaacctgagtgactgtccttggtggggtccatttggtaactgactccacatttgctggatccacagctactccttgagcattcacgatgtgaccaagaaactgaacttccttaagccagaagtcgcacttgctgaacttggcatatagttggtgctcttttaacttttcaagtaccagctgaagatgctgctcatgttcttcctcggacttggaatagataagtatgtcatcgatgaaaaccacgacaaacttgtctagaaattccataaacaccttattcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacagatcatcaatccttggcaaaggatacttgttcttgatggtgacctcattgagtgcgcggtagtcaacgcacattctcttggttttgtctttcttctccacaaagataaccggagcaccccaaggcgacgtgctcgggcggatgtatcccttctgtaactgttcatcgacttgcttcttgacttccgccaactcgttggctcccatactgtaaggcctcttgtggatcggtgcagttccaggtaccaagtcaatccggaactcgatatccctctttggtggcattgttgtcagatcgtccggaaaaacctctggatactctctgactatgggaatatcctccagcttcttagtggttttctccactgctacctcttgttcttcaccagcagcctggtttaaactgatccctggcttccgcggcactagagactggaaggttaccacctctccttttgcatgggttaacttgatggtgcggctggcgcaatcaatcactcctctgtgccttgtcaaccaatccattccaagtatgacatctaggtccttggattcgagaagaatgaggttggctggaaaaatcaacccttgaatttcaactgtcacagatgggcagtagtgagttgtggtcatgccacctccaggagtattaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgagactgtgctgctcactgttgttgtgactgccattatggtggttcttgttgaagctacccgggtggtagggacggtgctgtcggataatcatggtggaaggtccaccgtgacgtcccatcgtgaaacgaggcttctgactcttcccctggggagtcctgaactgagctgccttcctcttacggtttattttgttaccgtgctcctcctgacggatagccttatccaccagctctctcaaagtcctcataatctctagagatccaactggttaagtcaattcatcatcaagaccagacaaaaacttctcctgcctctcggcattggtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaactgcaggttctgttgttgctgctgtgcttgctgctgcacctgttgcaacacctgatggtactgttgctgcatctgttgcatcatcattgtcatcatctgagtctgattgtccaacacctgagcaattgttgggttctcgggcggtggggacggactgttgccagatgcactgttggcacgtgctccatcgatcggctcttcgctgccacaggcgttgttcgagtcgcgtgaaccattccttatctccatctgaaggggataggtagaaatatgagaaaaggaagaaaaacagggggctcaaactaatcttgcttatgaatttaagtgcaattatcttaatcttgattaaaacactgaaaaagaggcacgcaactcctaattgaggcagtcataccactgacacatgatatcgaccgccgactagcccacaagcaacaaacctaaacatgaaaactagcaagcaaacagactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgatttttatgcatagaacatttttcatgaacccaaataaagacactaatgcaactaaacaataaattaatacatagactagttgcatggaaaatgatgcgcataacattgcccccatcgaatatagacacgacctaatgcataactcccaataaattcccaactgactgtcgaataaactccaactaaaatttttctaaagccctagactgagctaattttttttaaaaaaaatccgatccgaatgaacgaccaagatttttcccgcaaaccaaagaggcaaaactccaaattttcccaaaacaattccaggtgcaaaaaggcatatgcagatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgataattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaaacagttgaaggggaggatgaccacggccactagagcggccggccggagttgggtggaaatggagagctcaccggcgtgcgagagaagcggcgtttcggcgacgattggcggcaaccgagcggcggccgaggtagctctcgcggcggcgaagctaacggcggtggcgggttggcgcggcggcgaccctagcggcagtggcgcgcggccgaaggcgacggcaagcggcggcgctagcaacaagcggcgcgagctcggtaggaggcacgggaggggacgggaaatgggtgaaacgagagaggggactcggggaagggtttttatgggcgagggaggggcggacgtggccggggatggcccctatttggccggcgatgtggggagtggagggagagtgagagaggtggattcgaaatcgaatcccgccctctcgagcgcgcgcgcgggccgggagatgcgggggaagaggcggcgacgtgggggggacgcgggagcggcgcggcgtgggcgcgggaagagcggaggaggcggcggcgtggcggattcggcggcggttgccgtcggaggcgggtggctggaggaaggggacgacctgacaggtgggccccacctgtcagcgtcccggagagagggggaaggagaacgggccggcccacaaggggaggccgagcgcgggcgacgggtggactgggccgacggcccaagaagaggaaaaaaaggaggaaaaaggaaaaagaaaaagaagaaaggatttttcctgggattaaaattgcactttggtgatttttaattggttaaaattatttccaaggctctgaaacttccattaaaaatcttgttaatgcattggagcatggggaactcaagaaaaattccaccacgccgaattcaattattaattgcatttattaattaaggaattagctctaggttaattaagataatttcttcggacaatttatttaaccaatttttttaaagcaagcaaaaggggaaacttccgggcgtgacacagttcgagaatgtttgtaggaagtttaatggatttttaatatataatagatagatagatagatagaagatagatagactatgtgttgtagcggagacttgccttgcaaattgaaaaaatgaaatagtttaggggacctagttatcacatctaccttctcgtgccattaatccatagccgctaataagtgtatcagccacatttgtacttgagactctcatactatcatcccagcttcttaagattccatttgtgttctatattttagtcagtaatatcgtgtatttgtttgtgttctatattttagtcagtaatatcgtgtatttgtttgtgttctatattttagtcagtaatatcgtgtatttgcaggagatagctagagaatttattttgccagcgggacaataaattccctatccatgatcccacggaaacaactctggcactggtggagaaatgctttttagtcatggttcgcaacccctgtagtcccggttttcaaaccgagactaccaatccaagactaaagatcgctatctttagtcccggttcaaatacccggtactaaaaatagatctttagttccggttagtaacaccaaccgggactaaagagaggggatctttagtctcggttggtgttaccaaccgggattaaagagggttacggcagtgagatgatcccctttttctttttttttctttt

SEQ ID NO: 66524 - DNA, 24725 bp, Oryza sativa
ctaattaggcttagaagattcgtctcgtgatttccttcataactgtgtaattagtacctctctttatatagacttaaagcttcagcgacgcgtcgaaagcggccgctctggtgcttagtagatcccccttacaaggtgtcaagagcccgttattacatgcaccaaatgccttttaagtccaggggctggtgtggcatcagagcccaatcgtttgtcgtgggcaggaggccacgacctgactagttccatgtcactcgcatcgtggagctgacgatccgccccaccgccgcggacgatccagcctcaacagttcgccggtatgcacgcgaagggcggcgggaggaggccggctaggcctccttagcgcgccatccgcgtgcattccggctaactgttgaggctagattgacagcggcggtggggcagattgacagccaaacgatgagagtgacatggaacaaaaaaattcgtggcaaaatccaaaagatttctgaatggaatgcaatttatattaaaaaacctatgaattagatggcaaatagtgaaatttctcacctgatcatgacaccctgtttagaaatatgactatgtttagatgggactaaaacttttaagtccctatcatatcggatgtttggacactaattataaatattaaacgtagattattaataaaacatattcataatcttggactaatttgcgagacgaatctattgagcctaattaatccatgattagcctatgtgatgtacagtaaacattctctaattatggaataattagacttaaaaaatttatctcgcgaattagtttttatttatgtaattagttttgtatatgtaattagttttgtaagtagtctatatttaatactctaaattagtgtctaaatgtagagactaaaattaagtccctagatccaaacaccaccgtagacacgaatcaactaataccgtagcacacctagatgcagatgcacctagtcatattctctttctcaacacatatctgagcacctctgttggcgctaccctccaaaagagaattagaacgcacagcggagtgcagaagggtgcaccgaagatgatcaagtagacaatgttggagatgagcaggtcgatgccgatcggggctccaatcctgagcacgaccctgatccccatcctcctgcgcaccacgtgcgcgcagctcaccatcagcaccagctccctgttcctgaacagcatcgtgccggcggcgagggcgcagacccggcggcggtggcgcgggacaccggagccagcaccaggtacacccccagcgcgaaggccaccagcaggctcctcatcgacaagcgcatccaccacacggaattcttgaagtacctgtgccggacattcatctccaccgccgccgtgccggcgtacatcaggctgagcgtggcgagcatggagcaggtgaaggccagcgccacggcgtacatgaacgcgtcgaaggcgtaccgccccgccagcgccggcgcgccggctgcgacgtagcctcccgggggggagaaggccacggcgaaagccacggtggcgacgagcacggagccgacgcccaggacctgggccgactccgtcattttcttggactcggcgctctcgtcgagcttgggtacgtgccgctgcaggaagtgatcgcgcctgatgtttccgccgctgagggcgttggctattgttagacaccaaagtatccacgttcgcgcgttctgcagcaacacgagcaaagttttacccaattttgattagcttaacgatgtagttctctccttccggtgctaaataatatttgacgctcttttaagattcgattaaactacttttaaaactttggacatcagtttcatacaccaacaaatttataaaatctagagtataattcataaaatccctgtatatttggtctaaattgtacgaaaccgtatgagttttatactgtgttgcgcataacagcatgtattatggtgctatagtttcatacacttttttctaatctactatgcatatgaattttatgggttcgtttatccatcaaagttaattatattttattgtgctataatattaatagttaagttagttgacggtgtggttttctaagaactagtttaaattctagatttgataaaggggctcgtatttaccgctatttatttttttagtggtaggtggcgtttccatcaatagagaggacttcatcaatctcaagatataccgactcagtcctgaagatgctcacaaaaatagtgtgtgcgcgtgctatgggtgcctatgttcgttccatgtttctaacaaaaatacaatactacaagtatattcgtactatttttttttcaaaatgcagatttacatgatttgatataaaatagtttaattgttgtgaatttatttttaaaagaaaaacattattaaaaagggcctgatctaagggcacgtacaaacgtgtataatagcggtctctctttattgccatgtaagtaaatttgataacgtggaagagagagaggagagaaaaaaaaagcatggttgctatacatgacaacaggtaagagtcaactcttaacttttattaaagaaaattttgttgtatgagggtggagaaaagaaaagaagggtagtaaaaaaatattttggtacgttaatgattaagagttcttgttgtctcaactattgtaacagtatattctttaaataatatgtcttacttaaaagaccatatcggacactatttttgtacatgccctagtgaggtaaaagtgatgtaccgttctgttggagtaaagacccgctggaatggtactcctggccaggtcagccggtgtgaggccgtcgttgttggcaagatccaagcaaaccctgcgattccgaaacaagcaccagaacactctcagcaccccggccacgaccgccaggtgcagcgcggtgttgccgtcgtcgtcccgcgcgttgaggatcgccgccgccggaaaccccgtccatcgacgtcggaggcgaatcccacgacctcctgcctcctccggtcgacggcgacgtggaggaaggtcctcccgcgggcgtcgcggaggccggcgcactcggggcacttgtcgagcaagagggcgacgagcctcaggttgccggcggacgcggcgacgtggatggggtagtcgccgtcgccgtccggctggcaggccaaggacgggtcggtctccaggagaagttcggttggtgtccggcggcattggaacgggcacggcaagaggagccaccggaggagtgagctgttctcgatgtcgatctttggtccgtccgccgaggcggcgaagtggagcgctgtgctgccggacgcgtcggcttcgccggagagcccggcgttccattgcattatcttttctgtcatttcttcaatttatggagaaaagcgtgagaaaaactattactccctccgtcccaaaataagtgcagttttatactattcacattcaatgtttgatcgttcgtcttatttcaaaattttttatgattagtatttttattgctattagatgataaaatatgaatagtactttatatgtgactaaatatttttaatttttcataaattttttaaataagacgaacggtcaaacgttagacacgaatatccatggctgcacttattttgggacggatgtagtattaaggtactactgctaccgtgctctctatgagatgatatgatgttaaaattaattacaggagcagttaatttactactagtctctaacccgtacattgcacaagttacgtttggatatttctttaagtgggaaatctaaatggagagcattcttgattttgtcttatggcacgacgctccgccagccatccatccgcgtcttcatgttgtcggagagataggcttgcttccattgcaatggcatcaaagcgaggaaccttcgtggcgtcaggtatcgctatacaccaccaaccatcgaaactaaatattggttacacgagtctattctttttctaatgatgacttatatattttaaatcatatattattttcatttttgtttgtaccatcgtgctctactcaaaatatacgataaaacaaatttaatatttaatatattcaaacatttaaagtaatttacttaatttcaaaagtaatttagtaaaatcgtagaagtaacttagctctgcaatagaggtaactatctaagcattgaaagttgttatattgatcaatcaattgatgttgactgagacacggacacgtaaatattatattgacgaagagtcaaagaaatgagaccacttgacaggaaaagaggacaacatactatctgctagttatcatgtcgattcacgtgcatgctactgaggctaacatgtcattacactagtataatgtttttttatagaatctttgatgacctatatatttttagaccttatattacttttaagatccattttgctcaaaatatgtgataaaatgagtctaatattgagtatatttaaattatttatttattttcttaactcctttagaagtgtgttacttccaataatgtgcactatgtagtcgtgtccttttcaaatgtattgctagattttaagctcttgaaaatacaaatttccagtcacctaaaattcaagccctctacaaatcgagcgtctgatttcctaaaaaaaaaaaatcagacggtctaacgtttcaattgaccgatgactgaaatgttgagtagtacatggtgaaacatttaagaatttgtgaagcatagtaagaacacatgttgaaataggtcgctattacgtatgaaacaatgtgttttattggtttgaaacatattttttattaaaatataatcatgcgatatcttgttataaagatttaattataatgaatattatattatgtttggattatatattggataagtaatttagttgaaaaatatttcaaagattgctacaagcctatatgcatgaatggaatgaagagagagcaagtatatggtagaagagagagtaggggtagttatgtccgatactttaccagccacatctgaaacgtcatgctatacaaggtgaaaaaaaagacattgaaatatttatttttcatgtgtaatacattaaaaatatatgttgaaacatgtcgcattacgtatgaaacatttagtattaacggttataaacatatgattatattttagcaaaataatcatgtgatctcttattataaaaaaaattaattgtaacaaatataatagtacgatcggatcgaaaatccgataagtaatttaggaggaaaaaaattttgaagatagccacatgtatacatatatggataaagtggtgaaaaagcaaagtagtatactaatatggcagccatatagtagcttagttgcgcccgattttctttcctccaatcgggttaccgataggaatcattctcatctaaaattgcatatactcttaagcctaaaattatggtggcacgtgcggaacattatttctttttaactatagttttattgttatattttttttcctattttcttgtctaagtttgaatgttttttttaaaaaattgtatttttttgaaattgtaagttcatgtaatgcaattttgtaatttttggagtatgccttgtttaagtaagtaatagtggagtgatgagaagaattacatcgaaaactcactttgattattcgaaagagtgtaggtcaattttttatgctacaaggcaagaccacctatctaaatataaggctaaagccaaattatttttcgtcatttattgatctcttcgacggaagagggtgtcctaaggcgcactaacgtgtgctttgccctgtcataccagaacttctgaatcacttaccaagacttctggtattcctgtagtggcacgtcattaggtatcgttgagggttgcaaacgtagtgctagatgtgttttgggatggacacatttttatgtcaacaatagggaaacacatggagtcatggttgtataatttgacttatcatggagccgaccacctatattagaacgcctatagaaatacaatatttatagaaactgttgtcttaacttggctgcacgtaaaacaggggcctgcatatgagccccccccccccccccccaaccaaaagtatagaagcagattttataatgcactatatcaagtaaaatgagagagtgtcttctaaaatcgttttatatagtgtaaatcatgttaatcacacttcacacgtgcacatacgtttttaatatgactttagtgaagccaagaggcacgccaaagtcaacctcttggcttgagcttatgccaagaggtgcatttgtcgatgtgcttctgtttctttgatcgtgcctcatcagagtgtatttgtcgatgtatacgtgtgggtctttcatatgatctaaattgatcgtgcggagaaaatgttttcatccctaaatagttataaaaaacaataagatagccaagtatgaaatatattactttacaaatatgtaaataaaaaaatcaacttttgaaaattataaagaaacaaatataaccaggaatgtgtgttaactatttaagttgaatttgtttcttttggtattagttgtaagagtccaatttgatattacgagtgacatagttcatatcaatctatgttaatatatgctgttaatttttttaagaaaaataataactatttagatgatatataagaaatatatcccatcgagaaatgaaaaaaaaatcaatcttcacttgtaggcacgtacctgcgccgcgtaggacagcagcgtgcagggcagtttggccggccggtccagaatacgagagctcgtcgcccccttgctgatgcaggagctccgcgatgcggtcgtgccccagtgagatcgcctggtacaacggcgacatcccgtcgccgccggggagacgggcgagccgcggatgcacggccatcaggtggccgacgaggcgctcgtcgccgagcctgacggcgtcgtgcagggccgtctcacgccggccgttctgcttctccagcacgtcggccaccctgaacctcgcgccgccgcgctcctcgtcctcctccatcgccatgtcgaggaggcacctgaccatcgccgcgttccccgccctggcggcgcagtgcagcggcgtgtcgcccctcgcgttggcgcgatccaggagggccatggcgctgcggtagatggtgcgcgcgcagctcaggaacgcttcgctgtcgccggaggccgccacgacgtgcagcgcggagtctccctgcggcgtcgtcgccacgtccaggagcagcgccgccgcggtgggtggctgtggctccccggccgcggcgacgtggacggtgacgtggtttggcgccggagcggcccccagaagtacagcctccagccactcgcggtggccgccgcgtgcggctctgagcagcctgcgatccatcgatacggggtctgaatcaaatgatgattaggatagaacattatattgcagagtggctgtgatctagacccgtttggtatgttgcgattacttataattaacatgtcagagatacttagtcagatgctttaaacaacatacgagacttgctggaagcggctagcactagcacacggtcatgcgtgcaaaaaccatggacgtacgaaccagcggatcagatcaccttgtcttgcattgcatcccgtgtgccgggtgtgaccggccggtggcagagccagcatcgccatcaagtctgtgtgactgtgtgtgtacgactataaccttcttctcttttagatatattaacatgttatttatagtaataagtttgaatttataatgataattacaatgtaaataagtgtgtgtacgacatcattaatttcacaagaagtgtagctataaagtgctatatatctaagccgtaatatatggtaatgatattatacttcaaatttatttatttatgtttttttgtaaaatcataggaccctaaaccctgcacatacatttaaattaggggaacgaaagatctaaatgaggattatgctgaaagagacttggaaatgggcatgagcctaaattaaccaaacaactcgtatgaggagcaaataaaaaattaaggcgtgactcaaggagagatggtacactgaaaagaaattttttgatgcaaacaaaaggtaaattagaaagcttaaggtattgcgttcttcattgatggaaatattacagatttcatggatgccaaactcaataagttttgtattttgatcgtgatgcgaagccaggaaagaactcaagaacgttcagctgataatgcaaagttcttctgttgaacactgccactactacagatttgattttttcgtacgatcaaaatagattttctcatacggagatcccacccgtttatattcagatgtttgcgaaaatcaacatttgcccctcggaggggtgagggggaaccgcaacgcggcaaagccacggtctccacaacgcggccacggcgttctcccgcatgccgcacgccctcaagttgtcagagagctattaggccatttacaatgcaaagacgtggagttcagcctccacatgctagctcggagattcctctccacctaggcacttttcactccctcactaggaacggggagccaaagtaagcattagaataactaacagccacgattcatcaccgttattagatcagcataaaccaaacaaaacaagcagatgtgatgcgaccgaggcagctttattcaacttgtccagaaccacttctctaccgactatcacttttgcatgggtaaaattaactaggtaccacgggttgattgtacagtatttctcaatgggacagacatgccgaaacatcaactatttcccccactctcactactctccatctcaccgtctttcagaaccttggcaaaatctggcgttggagctgtcaaacatgttagccgtcaggtcccgtctcctccatgtctacagccacaagcatccatgccctctcctactcactgcacatcaataacagtttaagaatagtaatattgtggtgaaaaggatgctcactgctcaggcgatcagtgtacaaaccttgtttagagctcatccttgagaggctcggctggggccgactctgccttctccttcgcctgaccagcggtttccttgttcttcttaatgaagtcgacgatctcgtcggctgtcctgccgctttcatagggaaccatctttccactgggggtgacgaagtacagggtggggtaaccttgcacatcgaactcgcttggcacatcgttcgcagttgcatcctgcatacaaggtagcaaaatagtagttagatgaactgtacttgtgataggaaagaatggatgaataatgcactcaaaactaatggcaccacccagatagaaaggaaattaccatcttagcgatgacaacatccttgtcgcttttaagcgtcgtagctgcctcatccaagattggagccagcttcttgcagtgtccgcaccatggtgcatagaattcaacaaggactgaaacagaaaacagcaaataaatgagagctgcaaatcaaatagaggctttgccagcactgataattgaagaagctacaaaaaaatagcaaacttgcttttgaccagggaggaatcagtcgctcacaatactaatataagaactaaaaatcatctcactgaaaagattacgggggacaacagtatgtaccgtttttgccagacttgaagacaaaatcatggacgttatcagcgaccacaaccttaacaggctcgtcgttgacctcaggaataggttcagacttcctgaatggagacaatttaccatcctaaaaatagaggttttgtgagcattgtgcaggtaaacaaatatcctaaaattacataaatagtaacaaataatcacaattatattttacaagtataaaagactacttacaaagtattccttcaaccaagaaacaatttggtcaggctcaacgtgtgccttcaaaaatttcttggactcaccatcctggatgatgatgagtggtacctgatcctccctcagcccaaagtactgtacagtgacagatttaaagttagcatcaagtacattaataattgtttgaaaaaaattataagaaagtgaggtaacaaacctggaaggcaccttgactggcctcaatgtcaccaatgaggaacttaatttccttgtccttgaactcctcagcagcaccataataaactgacttgaaagactcaaacggtccagtggagaagttcaaaaatagcatagcctgcataaaatttggtacagtttagtgtcagtcatcaacaactgcaaattactggcctaatgatatacggagtattaaagaacaatatttgaatccctgcgtttaatagtgagacctgccaaatatataaatggagaagggtatcagatattacagtctaagcaaagtctatttgaaacacgagaaataaacatttaaattgactattaatatacagtatcaatcaactactgccagctgttattaaaagaatggagcttttcagagagcaaggaatgccaagcgcttaccttggcagctgagctttggaaaaatttcagaaggtaaggatggttgtcagggttcttgtcaaaagtaacaactttaggggtgctgctagcatcaatgaacttctccaaagcagtaacatcaaaatcctgaagagatatgcaaacaacacattattgacaattaaccaaaataatgccagccaataaaggctgtgacaagttgtaggaaacatagtggccaaatgaatagttaaaacaatgaagtttgatatttgaggagttatataccttgctgtcaacaacaagctcatcaaagggcttgaatagcctaaccaatggtctctcaactgcagcatcaccgcgtggaaggtggttggcatgcaaggtgtggccaaagtcataatcagatctcagcttctcagcaacctctatgaagtttgtatactcagtgccacttaattctgagaagattccaacctatttcaattgctcattcaagtcagcagtcaattttaaagcatgaacagtcggaacagaaaatataagttggagaatgtgtcatattgaatcgaggtcttacaatgtagattttcttgtcatcaataaggttggttgcgtcttctggtgacttgatctccttggaagcaggaccaacctgcttcttcaagtattcaacaatgccctcagcctccctcgggcccttgtattcctgaatgttcttgccctggttcctgaatatcttgagtgtcgggaaaccctggatctcatacttggtagcaagaggcttgttcttctcgtcgttggcatcaaccttggcaagaacaatcggtggatcgtgcttgcttagctcttgtgcagctttctcatactgaaacagatcaagcaaagaaaattaatacatgggatcaaaccatttaatccaaaatgtgaaaatgtgctgttaaggaagtgatccaactgtacagaagcatacctctggagcgagcttcttgcagtgtccacacctgcgaatagggtttatccaattagacacatttagaacaagcattggttaaattttgattcagataacacaatagcacgatgcacaagcataatttcataaagaatcaacattgaagtacaaaaacaaaataatagtgaataattgaaccaagactacaaagctatctggatttaaaacctgtgtaagtgaaagaacacccgaaattctcagttgcaaccctgatacagacaccttataactcgaaaaaccaagtaaccaactcactcaatctaaaccactgaaatctgactaggagaccaggcatacacatcacaaacaaggtaaatctactacaatttacagaatcggctcatccgcagtcacaggtccacgcacaatcgaatcggcgaatcctatccgaatctaagactggatcaccaagatcgagaccaacaaacgcatcaattcggcaaacaccgagcctcacacgcatcgccagcttccccaattcccgcatctgaactgaagtcctaaaccctccccaaacctcgcgatctaaatcccccccccccccaaaaacccacctcgcgagatctaacccaacacgcacagctcatcaacaggggggccgtagcagagcagagcagagcacactcaccacggggcgtagaactcgacgaccatgaacgggtgcttggcgacggcctcatcgaagccgtccgcgtcaagcgtcagcacggcctccgccgccgcatcgcccccctcctccgcagccgccgcctcctccgccctcgccgccggcgccgacagcaccacggcgagcgcgagcagcagcgagatccaagccttcgagatcgccatgaggaggagacggagagtgtgggtggctttcggaatttttccctgagacgacacgcttctcacacgggttttaatagggcggagtacgcgaggggggggtttaccggatcacgtggaccaagtccacatcgaccctgaaactgcccaccgggccccaccccgcggactccctcgtggacgcggcgcaccggagtcacgagatatttacaggtaacatttgcgatgaaccccctgtacttatcatcgtcaaatcatccctccacgaggctgagatgtgctaaaactagaggtaataaattactaatatgcccctgatgaggagtgatgtgtaattaagtggaattaggggggcgaaagtggggtggtcccgagggataaatccaatcctgtgacttcaaaaaaggcaggggaattaacgacggccaacgccacgtcaccgcgcgccccgactacgtacacgtacctgtacagccctcggccaatgggagggcgccacgtcagctctatgacatgtcccggagccctgatttgctccgcgcccccaccagcgccacgcaacgcacacgcttccaaaatccggatccgggtaaattaggcggcgtttttactgctctcggatacgataaaagctgtgtagtaaaataattctaatattggcctcgtgtcgcgcgtgattgctgacgcggcgctggatcgagctcgtttgcgttgcggcagtggtgacgtggcactgttgaactccgccacgtttcaccgggtggtcccgatcggatggctactgtttttctttttctttttttcaaatcgatgactgttttttttgctgcgacttattttaaacttgtcgatcacgagaatgtgttcacgttcacggtcatatagataagagacacattttattgtttcgagagacatttatagtcacagatggcagatccggcgatgggcgaatttatttcgcatcccacctcaaaattttacaccatatcacatcaaacgtttaaacacatatgtccacgagtgatactcgtagaccgaatatagagggtattggggtacgttggtacaaggatctacgtaatacgacatcaagcaaacagagaacgaggattatactggttcagaccccttgatagataatagccctaatccagttgatatgggattatatgatggaaaagacaggttataaagggaacgatggaactcgatgaaaccgacgggatcgtaatcgagttggttcgactagatctcccggcgatttggctcctgcaggctccgacttcgtaggctgtgggggttgtgttggctccgagattcgatgccttaggtcctccagggggtcccttttatatcgcaggtcaggcggtttccaagtagaactcggagacatcggaccctacacgatacattgacgacccagtctgtccgagtaggattctttccatctgtaaactccgtgaaggatttacttagttatgcgcagaatgtccatatacgcgcagacatgccatatcgatatgtgacgtatatcgaagggtaaagggtatacctaacccgtaaccttgacagtagcccccgacttctgcttaaatgaactcgtgtaaccaatcgcgacttctggtgtcgaggctgttgttgttctcggtgtgagaactgtggagacaggacatagccgagaacaccatgtgaagcccaacggtcatgagcgaatttaaactgaagtgagaaagactgccgcgcgtaacggaccaagaaatttccggcggtcatctctctcctttccttgaaatttgcaccgtcggaagtgcgtttatttaagagagttttggggatccattttgaagtctgcctgttgtgaagaaaccctccaacctccaagcgcttctcgtcttttccgctcccgcaaaaccctagctcatcaatctcagtcctttctccggcgatctccagtcagcgatggatctcggcaagtcctcctccaccagcgcgtcgctgaataagctacaggaggatggcgcccctcccggtcgtgggaccatggagagagaagaaggaggtactgaaccccagcttgtcctaggtcgcatggttgcgatcgaggactacattctctgcggttttctccctccgccttctgaatttcttctcttggttttgaacttctacggtctttctttgctccatttgaaccccaattctattgccttccttagtatttttttgcatctttgtgaggcctacattggggtagagccttttcttgatctctttcgcttctactacgagttgcgttggatgtagtccaacagggtatctggatgcgtcggattccgactccgggatggcctgaagtcgcgttatatccccttccagtgcccttcctctcatagcaaatggcggacgaggtggttctatcttcagatagaaaattcggatcctgtctttgttgttcctgaggaacaaccagacaagatttcgtcttggaccgcaaagcccaccttgaccccttcccttcagtccttcatcgatgttatcgacgatctccgagtacgaggtttgtcggggtatgaagtcgctgctgacttcgttggtagacggatccagtcgctccaggctcgagcccatctagcctttgactattctggaccggaggacacgacccaggtttctcctcggggtatctttcttgcatttaccctgacttgcttgtgtgcgcgttcctcctgacttatcgaactttggttctcgattcacaggtctgagcagcgaagccgtgggacgtcgtgtcggccaggtgatgatcagtggcccaacgatggcgagcaatgtccccgttctcctttgcgagaagggggcggccgaacgcgacgctgccatcaatgtaagtgtactcagtaggccttctgtgtttttcttccgggatcgccttatgacttcataaagcgtaggctctccctctgactgatatcatcgggccgctcatggaccatcaggtggcggtgtcactaaaagagaaggtcgccaaggaggcgtccgatgctgctgctgtcgctgccacaacaagtggtggcgacgttccaaaaaaggggaggaaattctcctctgtaatcggacatcgtcgaaaggcacctaccccctcggtaagttctcctgtcatttgatcacgtagtcagaatacttccaccccacatcatatcgattgtactccaagccttggacgcgtctcccctgcctccacgacggcagcggcttgtgacactcggcgagaagtgagtgaatgaatttgaggtttcgtgatttcgtcgaactttgtctgaaccacagccttcttgtagggcggcgcgggcgaaggcggcgcaggacgggtctggagggacttccagcgcgtctcctgctgtagcctcgacggatgtcgtggtcgtgcccgggagccacgaggcgacaccaagcggcccagccagcgatctcgtggctggtcatggttcgccggctgccgtcctcacctgggaggagctccaggttgagatgtggcgcctcctcgaggctggtgctcgcggcattggccgcgagatcatggaggtgagagcggcggcggcgtcgtcgtcggcgaacgagcgcgccgaccggctggcacacgacttggcggaggctcgtgaggacctcaagaagatgaggaaactggtggccgggaatgagcgacaacggcaggggctcgagcaccgtatgtcggagctcgagaacaacttatcggaaatccgtggctcgttgcgggtcacctatactggtctgcaccagctcgccggggaatgcggtatcaagtctaccatccccgcgaatcccaatgagttctcgctgacgtcttctcttgcggagctggcggcggcgatggaggagattccctccaagcatgcggccaggatcggagaggagacgtccaacgggaactacaccggggcatgccacgtccttgcgtgtgtgaggctggcgcaccctgaactcgatctgcgggagatcttggaatagggggcggctagcgacgcgcataaggatgtgatggaagaagtcggtgatctgggggagtctgttctccccctttttgaagagtaggattttgactctcttgtactccttagacatgctgtataaaactccaattggctccaaccgcctttgtgcgtgcagtcatcaccttagtttgctttagcattttgatcttgagtactttttttgtcccttgtagagatgttgatgtcgaggatgtccagcagcgtgggcagcctgagtcgccagcgatcattccggctcttgcgtttgagccacacgcgtcgccggacgatgtagatcagattttacccgcgagaatggggatggcgatgacttccttaggttagtggtctcttcatccctttttgctcctccgacttgatcaaccgtgttctcgaaagaggagtgcagcttgacttagtcgtttccatattgaacagatctcgagagtgcgcttgctggccaagatcgtcgtatccaatattggaagatgaaatttgaagtagcggagctcgagagaactatgctggaagtaaagaaagagcaagctgtggaaacgctctgaggttgtgaggtatggttcaacttgtacttgaagagttgctgcacgtccatggccaaggtttgtagagagctccgagtaccccgtggagatcctgaggagtcggcggccggatacatctcgtggctgaatggggcctgtactcagctcgaaggcgtcggcaaacgcattgacgaagccttgaagcaggaatgtcgtcgatcgagccgatatgccggagggcacgtgttggcttgcctacgagatcatcgtccgcgacaggacctcgagtttctccatgaaggttttgctcgttctcggagaactacggcggagatagaccacctggcaaagtcgatggcgccgttggcggagaaggtcttctagtctatggactggagttggccttcttggtagtctttgtaccctgtgatggatatcttagggaaaagtgtaatatagctttgaacttgtgtaaaattgtaaggggtattttgtgaaatagaaaagaaatctatcttaacaaatccttcttactctggatatcgtgtgtaagggtgtgttctcagttcacgactttagttagtcgtttgagtcgtacactctctctagcccccagccttgtcatcggaggatttttctcggaggataagcctcttggacctttgacctgccttggttgaataagcactgatcctagcccccagccgtgaagttggaaagtgaatttccgattacgcggcttggttaatacgcacggcgagaactcttacacgaccaggtcttacatggtctttcgtctctacaggatctgacaaggccttatcggctctgggcgtccccagtagaagatcccttaggttcatcggaggccttctcaagatgacgtaaagggacatggggataggtttcaacgctaggtgtcatcttgttaacaaccaaatttggtaacatcggcatcaggaaagaagattagatcgaagcaaagtcggaggcagagattgagttcggaaacaaagcaggaatcggctggagtccaaatcggatgcgattggcatcggctaggtctgagtcggactaggtaagccgatacagccgattccgacaatgcagcttgatgtatgatatcgggttggattgaggtgcttcaaggtgattgccgcacatggatagagtcctgagaagtcaattgtatctattaattagggtgttttatgtaatctccttagagatacgattgggcaaaagtctgccgcaaagacttgtggtatcctagagtttgataagatagtagtcgtgtctgttatggacatatcttgtgattctcgggtataaatagacccgagccctatgtaacttttaacacacacacacgttcaatacaatttcggcgcatcgccacccttttgctttagttttgtttcgatgagttcttgctttcaggttgagctgcatcggtttcgatcttcaacgagaggtaaaacttgttatgacggcttgtattctcgggattagtgcttccatctttatgacactctgatctcgtttatgtaattcatcgagttatcatatatcttacataatctccggcaataccgctatctaatctacaatcggctaacatctgtctgtagagggtagccgattaggttagatatcgatgttgacttagattatataaggtatccaccactctatgaaacttccagcgacttgattgtctagatattgttcttcttttcatacttaatgttgcatcagtcgagtttgatctattaagtcgtgcttagaatatcaatctctaacatgccttctggttgccaattagggtagcatcggagtttcagccgatcttatctgatctaactatatttgctctatatgcttcattgacatattaaatctgtcctttatgtcaagatattgctgtatctaagtatattagtcctttgtttaatatattatgtctgttttaatatcctgatatagagtagtattggagtattagccgatacatgctagatctatctgatcggctatgctataaacatatatagccctgttattaatatatatttcgatctaagtgatttatactgtctcggcatggcgaccgatctatcccaatcactcgatttaagtatatatcgatataagaactatatattggaaatatctacagccgatcgaatagatttagttctttattgtctatttacaactgccgatcgattcacatatgacatcggctcaaagataaatgttatgtcatcggcacctagccgatcggctatcatttatagatttaaccacggtttctttgcctttatttcttgttgattacgggatcaaatcaactggcacgctagtacacccgaaggcgagctttggacctacactggagttaagcagatctcccaggcctcgtgttttctgtcaacacatctgggtaagggatcatcgggtaggaacactttgattgtaatatgcgcctaaaaataggctccattgatactgtaaggtgtcttacaggtgtggatgacattgactcatacatagaatttacgtagttggtcaatattccaagagtttgccaactcgcgaccatcaccgtctgcaatttttaatgcgcctggccgcaaaacttgtgtgatcgtgtaaggtccttcccatttgggtgagagcttgtttcgccctacttggcattgaacccgtcggaggacatagtcgccgattgaaagtatgcgtgctcggatgcgctcctcgtggtagcggcggagagcctgttggtaactggctactcggacggcaactcgttcgcgatgttcctcgagtagattcacatcgacgtttcgctattcctcctgatcctcgtcggaatacttctgtactcgtgtactctgatgtcgtagctcgctggggagcatggcctcggagccgtacatgaggaagaagggtgtttccttgttagacgttgtcggtgtggtgcgtacggcccatagtactgatgggagttcttcgacccattttttgtcatgtgacatgaatctgtcgtagacgcgggtcttgatcccttgtagtactatgtcgtttgccctctcgacttgtccgttgctttgagggtgagagaccgaggcgaagcatatctagactcccagtccgatgcagtaatcatggaaatcggcgctgatgaactgggagccgttgtcagttatgatgcggtgcggtagtccgtatctgcaaaatatccccttgatgaatttgatggcgttgtcggccttgatttcccccgtgggtactgcttcgatccatttagtgaatttgtcgatcgccacgaataggaacctgtagccgccctgtcctcgtgggaatggcccgagtatatctagcccccagcacgagaacggccaagtaagagggatagtctagagcgcttgcgcgggtagctttgtgtgtttactgtggaattgacaggcttcacaccgctggaccatgtcgcatgcatctttgatggcggttggccagaaaaacccttgccgaaatgctttcccgaccaatgtccgaccagcggcgtgtgacccacagatgccttcatgtatatcaaggaggaggtgtctgccgtcgtcggacgagacgcatttgagaagtaccccgtttggcgctttcttgtatagatcgttgccaatcatgcagcagatttttgctttacgggttattttctcggcctctgcgtcgtcctcgggcaactcttcgctgttgatgaatttgatcagtggggtgcgccagtcgtctgtggtctcgatatcggcgacggcgtgttctgcctctgtggcctccgagctaatgttgggggcggctgggctgacttcgccgctaacctctttcactgatggctttgtcaggatgtccagaaaagtgccaggctcgagtggttctcgtctggacgcacatcatgctaggtcatctggctcgatgttgtccttgcagtatacgtgtcggacctcgatcccatcgaaccttttctccagcttcctgacttctgcgagatacttggataactcggggttagagcatttataatctttgtgcacctggttcgcgactagctcggagtcccctttcacgatcagtcgcttgaccccaagtgcggctgcagctcttatcccggcgagtagtccttcatattcggctgtgttattggtcgctctgaagttgaggtggattgcgtgcttgaattggtctccggaaggagatgtcaagatgaatcctgcccctgctccttggctgttgagtgcaccatcgaacgccattgtccacgtttcgttgtcgatttggttgtctgatttgttatcaggcatagtccaatcagctgcgaagtcggcgagtacctgggacttgatggctgttcgtggcacaaagtggacatcaaactggcttagctcgactacccatttcgcaatgcggccgacaacgtctttgtttctcacaacttcaccgagatggaaggaggagacaactgtgactctgtgggcttgaaagtagtggcgtagctttcttgatgtcatgattaccgcgtaaagcagcttttggatatgtggatatcttgtctttacgtcatggagagctttactaacgtagtagactggtcgttgtactttctctctctcgacaacaatgacggtgctaacggaatatggcgtggtggcaatatagaggaataattcttcattaggttggggagcaacaagtacagggggtttgataggtagcgcttgagtgcaacgaatgcctcttcggcttcttgtgtccatacaaatttgtcttgcttcttcagcagagcgaagaagggttgtcctcgttctcccatcctagcgacgaacctgcttagtgctaccatgcatccggttagcttttgtacttccttgagtcttgtgggcgacttcttgttctcgattgccttgatcttctcgggatttgcttctattcctctgccagagacgaggaaaccgagtagcttgcccgacggtactccgaacgtgcacttctctggattgagcatgaggcgatatcgtcggaggttgtcgaacgtttcccgcagatcgtcaatcaatgagtcgcttgtcttggtcttgacaacaatgtcgtcgacgtatgcctcgacattgttgccgagttggtcgctaagtgcgccctggaccgtgcgctagaaagtattccctgcggttatcagtctgaatggcatcttaacatagcaaaacaccccgaacggcgtgatgaatgctgtcttctctccgtcctctttcgccatgctgattcggtggtagccagagtaagcgtcgaggaagctcaacagctcacagccggctgttgagtccaccagttgatctattcgaggaagagggaagtgatctttgggacacgccttgttgaggtcggtgaaatcgacgcacattctccatttctcgttggccttccgcaccatgactggattggctagccactctggatgaagtacctctctgatgaagccagctttgagaagtttgtcgagctcttctcgtatggcttgtttttggtctggtgcaaatcttcgcagtttttgctttactggcttggcatcgggtcgcaccatgagtttgtgctcaatcacctccctggggaccctcggcatgtcggacggttgccaagcgaacacgtcagcattgtcgcggaggaaggtgatgagcacgaattcctatttctcgcttagtgttgccccgatcttgacggtcttgtcagggttggcactagagagtggaacggtcttgatcgcgccgtccggtttcggcgtcttgtttgtcttgctcactttcttgggtggctcagttgtggcgggtgggctgggcatttgctcgaccatgtcgaggctccacttgtcgcattgtaccgccagctttgtgttcccttgaatagtgattgttcccttcggtcccggcatcttgagcacttgatacgcgtagtgggatgtggccatgaacttcgcaagtgcagttctcccgatgatggcattatacgctgtatcgaattcagcgacatcaaaggtgatctgctccattcggaagttgtttgcttggccgaaagtcacaggcaacgtaattttgcccaatggtttggacgaggattggggagtaattccatggaaggattgatcggtgggtgtcaactcgcttcgcgaaattcccatcgcgtccaaagcactggcgaagagaaggttgattgagctaccaccgtcgatgagaacccacgcaaccttgatgttccgaatagtgggttcgaccacgatcggatagcgtcctgggatgacggcagtcttgggatggtcttcttctgaaaattctatcttctgttcagaccacttcatcttgtgtgcagccccctgccatgtcgaacagacttcacgttccactttcttgtattctcgctttgaggagtacgctgtggaacctccgaaaatgtgtgaaacgtggaggttagagtctggatatgctgtgtccgattcctgaggagccacctccgcatccttctcgaccacgcgtactcgcttgcctttttcaaatgccatgtgcttctcgagcgactttttgaaaacaaggcaatcttccaaagaatgtctgtctatcttgtgtatggggcaccatgctttcttcgtgtcgctaccttgtgggtctgggcgcttgggagggttcgcgtattctgctgcgagaacttccgcttgagctttcattttcccacttttgcgatttttcttcttgcttgactcaggtgcgtccgtggctggtttcttctctcccccggtcttcggcttatcgttcttgcgtctcagtgcatcatctgcgtgggcgcatcgctcaacaatctcgaacaatctccgagtagttgtgatgcgtcttgtcaccaactcctgggtagtatagcgatctctgacaccagacttgaaggcgcaaattacagaagcatcggtgatttcggggattgtatttctgcactcgttgaagcgccgaacatattccctcaaggattcacccgagttctgtgtcaacgcatgtaggtcgtcttcgatcgcgtggcgcttgtaagttccttggaagttggcaatgaactgctggcacaggtctgcacacgaagagatcgagtagggcgggagatgcatcagccatgaacgtgcagagccttttaacgcagttggtaaataattcgccaatgcattgtcgtctgctctggcggcgtagagtactgtggagtagacttgaaggaactcttctgggtcggtgctcccatcgtacttctctattgctccgggtcggaatctctcaggccattggacatcacgcagggaacgactgaaagctctacacccagcgctgggggcggtgggttgtcggcgatcgtgtgtccttcatggatgtctgtctgatgatgaggatgaagaagaagacgacgatgacgatggatcgcttggttccggtgtaggattacgaggacgtcggctaggttctcgagaatcctttcgccgccctcggttgttgtcccggcgtcgatctccgtcgtcctcgtcattatggcggtgtccttgaccagtgtcaccctgcgtccgcctctcgcaatcatcgtgatcgtggcgatcgtggcgattaacacggtctcggtcttcgctcgagcggccctcccgtctttcattatcgcga

SEQ ID NO: 66525 - DNA, 734 bp, Oryza sativa
ccgcggcagttcatcagccgcacttgagcatattggaaatgtatcccaaattgaatccccttgggatagaaaaagaagaaccaaaagggaaaagagagagaagtttttaatcggtttacctggtgtcaattcatatttgttgtgtgttgttaattgttatgaattaaagtatctgcgagaattggagtattttttttagtttgaataagtggtggacgtaggattttataaatgggggtacgataaactaatttatttataaaactgtttgatgaaaacaaaaccacaaacacatggaaaatagggaaaccttatattttattaatcatgattcattaacatgaatgtttatagatacatgggggctcccgtaggaattcgccttttgccttcgtgaggaatgcttaataaaaaggtatgctgactggagattgcttgtagtccgttgattcccagcgcctagtaatgaggctaccggttaatttcatccatagaacgagcctatggaacacctccgattaagctgtgcttgtgatcgtcgtcttcagaattatttgctcaccgagggttgaggttggtgcaaatttaatggtgaatatagtgaatgtggaacgggtggctttgtttcgccaaaacctggtcacggtacactaccatcacgtcggcgtgaagagggaatttggtgaagcggggtgacctttgcctcatcggtgcccagtcatgaaccctgcctt

SEQ ID NO: 66526 - DNA, 689 bp, Oryza sativa
ccattggagcagagaaaactgtctatgaaagaacttgaatgcgagaatcttcgagtatgagcagcagcaattagttctttcataggcatcatgtctggagatagactcttaccctttgggtacattctgtggttgtgttctttcagtgcgattgctgaagaaccgtgcctgaaataacgaagctattattaagtatgccagcatgattaacatgaaacttgagaagacaaaaacaaagaaaagttttaaaggacaatgaagaaaaaatgattttataatatggccaatcatatgacttatggtccacaacaggactaaaggaagagtttttatatcccttgacagtagtgtctttaccatgtggccatgttcccttgaaaattttaatacttggaaaagaattaattactcacatgttcctaatcccagtacaattgaatatgtccatccagattacataagtagatagcattgctacgtgatataagcagataatttaactacaaagatagaaaatgtatgtttggttggtggcaaaaatcaccccttgccaaaattggcaatgccaaattttgttcagaaagattagccaggttttggtttgagatatagaagaactgaaagacaatgactaccttaggacttattggcaaaaaaaaaaaatggaaaccagattagtccaagttttc

SEQ ID NO: 66527 - DNA, 5029 bp, Oryza sativa
ataagctgttgaatgtggggaccacatccacagaaatgatagtatgcgttcatgaaataatataagtagacctcccaccacctggatctactttagtatgcctatgttataatgcttaataaaaaaattctaatgcacatagcactgcctaattactagaacgagtatttgattagattagcgcatagatattccaaactgcatattaaattactaatgaacaggcatctgattagtcagatcatagctatcacaatagcagacaatcgaatgcctggggtatacaataagatcatggttccctcaagtgatcactgtgacaagaaatatctgacatacctacataaattatggtgaatcacataaaaaaaatgcaaatagaagacactaacactagatgctatttgtgctcgtgataagagaaggtaacatgatgcatgcagcaaaaagaacgcatcaagccatccataaaacaatgtaaatgcaatacagttaaattcaaataaatactcacatctgtttagttccataaaagtagaccagcagcttctttttagctgaagaaaggccccatttctctggctcacttatctgtaacagtgtggatattcatgaattgaagtgctcatgattgaaacaactaacacatgctctgaagaaaccgcaaatccttgtaaacaaaccagacataggaatgctaaaaatagaaatggaaagcataaaagttatagagcagcttcatgctacagaccctagcttaatggcaaaagtcaaaagtgaaataccaccaaaaagaatagacgaattactctctgaaataagaatagttgaatgcaaggatatgattcataaagtatcatgtggagacaccatcacaaaagctaaaacaggggacaggtgttgtctaacagttttaggacttgctaacagcaagttcaccaattttacaccatggaactttctccgagaaaggaggtacatgaaaagtaacggttgcacaataaataagcaaacgcctcacaactgaagagcaggagaaactcaagttgttttctataaagcatggcacacaaacatcttgaagcaaaatttaggacaacagatgaacatcaggaattagcaacaggcaagaacgatatgttggacatactaatccaaactaataagtaggtaccctcagaattttaacgaggcccatcatgaaaaaacattacgcaaccaagcttagtcattgatcctcaaggagcctaatctagataaaaaaacgaacttatcataagtctcttgtccttctgtcccacagagagaagatcaatggcaccaactacacctaaccagccaggatgttcatgtacaaaccacaatgctgaatgaacttaatattcaatgcatcaattgatcaaagataagtgcaacttacagtagaaagtattcagagtttccaaatcctatggatgtatccatggagcacaagaaagccctacagaacttcagtaacccactacgataccgaaggctcaaaataccaggaagctaaactgtgttctgagaaactttaacacaaatgtcaacaactcaacaacagcgaaaggttattacacctcaaagcataatgatggcctagcgatcacacagttgtttctaaactatgttgtcatcaacgcagacaggaacatcataagtcgctggcataactcacacatgcataaccattacaaggatgcaactgttgaggagtataatttatggagacatcccaatatggaatccagagctatatatacacacaggttatggaagcaatcaaaagatatctggtattacagttaagggatatgaatcgatttggatccatatttcatatttgagggagccaaactggatccatatctgaatgaggctcgcaccacattcgggcgtgatacaagtggaagacatttgtatctgcgccaaggcccactaccaacatttccttcttctgagctaacagcttaagttccttgcacatataccatgtgatgtacaggcaagggagtaagataaggagtacaagaggcaggaattcataaggagagagtagtgaatgactagaattaaacaagagattatatttatttaggtatagttttttttatatttcacaccacagtatcagtaccaatgaccagagctaaggtgcccgaatctgacccagtccaaaagtctatggagccccaatagcataaagggtgaatctaaactgcattaatgattgacttacatgacaaacacatgaaattgcagtaagaaatcataatatgagcacgggattatcgcgaacttaagaaaagatcaaacatatttacatcacgagctacctatcaccaaactcatcgtacccagaaccctaaacacgctcctcactaagagccacagattaaaattgggggagctaaatcagatcaagcaggcacctaaacctcagttttttttagcacgaatcaacgaggtgtggtaagttcactcacagcataaatctccgaatccgaaattacataaagccattacagagagccctagatcagagaccaagcaatcagtcccactcaccatggccggccacgccgggaagcccttcatcttggcgagcacgaggtcgcccaccttccactgcgccgcagcggccgccgcggccgctgccgcggccgccccgcgcttcttccgagccggcggcatcgccgacgcccccaccaccggcggtcggagggcgcccccctgctgcggctagcgcccgaggcggcagagccgccgcacgacggggtttgcggcgcgggtaggggcgcgtacgggctccgaggtggctgcgtcggcggcggtggcgggggcggcggaggagggaggcatcgagcgccggagcggcggatggggacaggagggaggcggcttaggcttcgagatttttctcttttaattcggttttcttgtcctttttcttttcttttccatttcggtgcattttgatcagaagaggagtagtaggaggactgtaggagagggttgtttgggctaactggggttaatatgggcctacttgggcttagtgcgaaagagtggttaccgctaatgacaacgccaattattgattcgttattgaaaaaaccggtgaaattcagattaatttctctatctattagtactttactaatttctcttcctctagttatgtaaacctagcccgttgcacagcacggacatattagcagttgtcaaaatgtcagtttgaacttttattttttcttttacatagccagtttactaagcagtttttccatatgaatcagcttaataacgccgataaccacaattatttcacggttatcatcgcattttgaaaccttgacttcatcgtaccaatccctccggaaattaaactgtacgggcctcgcaaatgtacagatggtcagatactcagatgcaatgctgttatcaagtttggatccaaacttcagtccttttccattacatcaacctatcatacacacacaacttttcagtcacatcatctccaatttcaaccaaaatccaaactttgcgctgaactaaacataacctaagaaagcaaatcttttgcgaaataaatgcagtgacgttagatcaaaggacagataacaaattgaaagaatcaactcctgacaatttgacatcactttgttcacgcaaagcgtccagtggtctttaaaacatgcagggaaagaaaagctttttttaccaggggcaaaagggcaccaccacaaactgtggtaatgcatgcaactagcttgtcctaagaaaaaaaacatcacacgttgttaagcagggtttacttcctaaaatcagtaaatgtcacattctcggaccaccgttgccatgcactacaaactgattacagatgataagcaagagaaccaatgaaaaaaacagtaaaaggccgcgaggggtaattcgatggtgtcttgtaacttctgtgtcctcagagaatgtgacattgacaacactaccgggaattcacaaaatgcacatgtcgttgcatggaaggctcaaactttgtcagaggcatcctgtgatgtgccctcagaacttttgaccgcagccagcttctcagctaatctttgctccagtgccctttgacccctttctctacagtgagataaacaacagtcaagtgagatctaggatacaaggacagcatacacgcagaaaacataacaccaaatagagccactaattattgccacagaagactgaacactaagaacatccagtcgagtgcagttgatgtcctgactcaatttcttttacattttgttgttggctgtgtgcaccatgtccaaaggctggaaatttaacaagtatccaatatctaaaaaagcatccaattgccaattccactttggttctaatgtttaatgacatcagaaagtgcatccatggagtataagcaatccttatgaaggatacattatggggaaacacaaatataaaattgattgatattattccagggatacaaattaacaaatcaaatggcagataaaggtaccaaaggctcaaatattgattattcattagatggcacaagtgtggatgaaattatgctctaatcaagacagagagagagtgagaaagaaaaccaaccttcttctgttcgcctcaatagaatctgaaccaggcaaaggtgtggtatccaatgtctgacctctagcatcagccctttcagatcttccacaaagaagcctgtggaatattgaagctatcggatccagcacaggtctgcatgttcaattaattggtcaggatattcttccaaactacaaatcaatcaaagttatataaagagggagatttggactaccttagaaattcagggaagaaacttgagaaagagaactcttcgcttgggtctcctttcaagcctgtctctaatctcctttggaagtaccgcaggtaaatccaactcatataaatgccaaacaatataactgggaggtaagagaccagctcctttacgaag

SEQ ID NO: 66528 - DNA, 20044 bp, Oryza sativa
gagtactgggcgtttgagctactggtactgatcgccggattgctcccgaatccgacagtgagcacctcgctgatcgccatgtggtaagttcgtcgttgcgctgtcccttccatgaatcgatcgcaaaggaagaaactgatctgattaatgcatgattgtgttcagctcgagcacggaggccatcgcctacatgatcacgtacgggttcagcgccgctgtgaggtacgttacttacatacgcacgctacctgttcgatcgccggccattgttcgtcgccgtcgtttctgaccgaacgttgcacgcgccacgcgcgacgcgacacgcgcagcacgcgggtgtcgaacgagatcggggccgggaacgtggagggggcgaagaacgcggtggcggtgacgctgaagctgtcggtgttcctggcggcggcgttcgtgctgctcctcggcttcggccacggcctctgggcggggctcttcagcggcagcgccatcatcgcggcggagttcgccgccgtggcgccgctgatgatggcctccatcctgctcgactccgcgcagggggtcctctccggcgtcgccaggggctgcggctggcagcacctcgccgccgtgaccaacctcgtcgccttctacgtcatcggcatgccgctctccatcttcttcgccttcaagctcaagtggtacaccaaggtagtacattacttatacttacaatctcacattaatccttttcatttctgcttcacaaagattacatgcatgtgacatttgatttgggttgcattgcttgtagggattatggatgggtttgatctgcgggctgacatgccagacctgcacgctgatggtgatcaccgcacgaaccaaatggtccaagatcgtggacgcgatgcaggagaagaaggccagctacgtcgcgtagtttaactagtctttggctatactgtagattatcgatcggattggatatgtgtatgtatacacgatgagcatttgaagcaacatctgcggttagcatgtctgcaacacgcgcgacgccggctgttgcgttcgtgcagtgcgtgcgcctgcgacgtttcgcggggttttggacgcgacgacaatgcgcgcgaactgcttgttcaaatacagtttcttcagccatctggaagctggaagcctggaatagacaaacaccttagagcaagtataatagtaggctataagccaactataagcttaaggagaatttgaaaaatggagagagttggctctcatgcaagagctagctattcacatattttaagatagatacataggtgagagatagagagaggaggagaaaaaaaagaggtaaccttatagcccatttactatatatgttaactctaagataagctataaactcattgttggctctattattaaacttgctcttacagtactattttcaaatggtgagcaccatatattaattgtgaaaacacacacacacaccgatgtacacgatgatggaaatttactcctctcaagtttgattgaatcttgtctgaagttttatataaaccaaactaactttagataaaagccctcccactaccataaaacctacttccttcgttctacaatgtaaaactttctaggatgaggacatatcatgtgaaaacaatgtaagtgttgaaaaattatgaaaatcatatataaaagttccgtaaattcatgaaaaatattaaagataggtgtagtgaaatacattctcaccaaatctcaactccaaactcaattttgtttaagaggaaaaaaaagagacaaattttgggtgaatagtgtcatattactattctcctaaaatttgtcttttgtcctaaataaaattaagtttggacttaagatttggtaataatgtatttcatgtttacacttatctctagtattttttttatgaatttataaaacttttaggtatgatttttacgagtttctaacacttagcttgttttcaccagatatgtccccttctaggattacccaaattaatatagatgttaatgaatctagacacatatagaaaacatatacattgatcaatggatgaatctaggtaagtctaaaaagtattacgatatgaaacgaagggagtatcaaatataccatcttactagtgctggttagggaaaaaactagcactggtagcggtttttggtccctcaaacccacacgacactcggaggataagaaaaaccacacatgagaccatatcgataccagttcattaaataaaccaataaaatgtgtgggacgttgatgttggaacatgtataaaaaagagctgatattgatgggtgattaagctgagctgatcgagcaagctctagattggtttcgatatatttaagtctagacactctctcttgtgtgcgctcagaatcgatcccttcgtctcccttcccctttctctcatggccacctcccttttcctctctcacttcctctccctctttgtcccgccaccgcgagattgattacagtggctgatcggtaggcagcggcaacttccgtcatctttcccaacgcggctgtcctatagagctcggaagccgctggatctgcccatcatgagctcgggtatggctggatccgatcagtgtggctcaatggaaacttccctccccctctcccagccaccttgagctttcgaatgcgacgacaaaatagaacaacagctatggtctattctcaaatataagcatttatatgatttattttttccatgatataaatatttctgagcactaattctaatatgtaggaatttaggcatttttcagccaattagatacttagaaaatgaatctagctatctaagaaactcaagattttttaatatgaccattgatgaggttatcgaaagggaattattaccttaacataatatttactaaataacctaaaaatgcttatatttaaaaataggtggagtggtacattttgcggttaagcttttctttttactagtaatcgtgcacgtgcatcaatgcacgtttttcataaaatatattataggagtacattggaagtttggaaactatatctaccaaaaataatttattcaaccaaaatttataaaatatatctcatgtgtaactgtaaaaaaaatataaccaacattatcggtacttgtaaacatgggcatgactgtttgttttgtacaaattttgataggagggaacaaaatagaaccgaagccaaaggctatacagtagccgcctttttctctacagctagctgctccactgcttgatctcgtaaaaaaaagaatttgtcgacaattcgctaaattgaccatccctctttcttgaagtttctattgtttcgttccgtccaaattccccaacagacaagcaagaagagggtcctgagccctttgctttgcatcttttctgataaagtcttgtgacaccaccattccaatactgaacaggctgaaggagggctagctgaagaaacttcagtcaagcacaggctaataaatatagatgtgtaagacatgcttcagacaaacttcagtcaaggaggtaatgcatcactgcaagttgaattaaattaaaaatcaaatatgatagtttcactcactagatgttacaactcacgagaatacaagatttcggaaaacaaaacaactaataaatatagatgtgtaagacatactcccttcgttccaaaaagaatcaacctagaaggggccacatacatcaacctaggaggagtcttaagttgaattttaggaagtaggaagtaaaatctagatatttttcccgagcgtgcaacaaaataacttaaatatggaggctctctattaccctcgatagaaaggcgaagttataaaactcgttggagatgctctcttggctggattttttttcttagaaagacagatttgtcaattttcccagtcagacaaatgtagcagcgtcaactaattaaggagctgatgaaccttcttccagagaatggagtgtcacgggctgttatgtttctcttgtcactgtaatctgagtaccagctactatgcgtctgtgcgttgttctcgaacgaactagtggtcttatcggtaaagttaaaatttatattttcaagttgattttaaaatatttttaacatagtagttttattttcagaattggcttttaagtcccttaaaacatgcatatacaagttttatctataaattaatttttattttctaataaactgttttggtttataagggaatatgagtaaccgacgaggacataaacagcttatcccgatctcaaaattttagcagaataatgatcaacaagcagaaataattcagatagatagcgacgtgtaaagatgcaccaaccacatagaaatctctgtttcgttgcgtttgcctcggcgtaggttagggagcagaattggctgtcagctggtgccttatcgttgattggaaaagatatggaagttggaacaagccaacaaactgtatatgtcatcattttagggcaagcccaaaagcattttctagccgcaccatcgagaaagcattctagccgctcgatttcgagctggcattttctcttctggtcgtacaaattttcttccctaaattttacttgttttcagtcttttttaacaaaaagaaaatattttaagcctactgtttgagagcgtactatgcagcaacaaatattacaaaaaaattataactagagatagtattctatgatgtaattttcagaaattcacaccgactttcaagtaagttcaacaaaacatacttgaaatatatgttgctccgtgatttggatccccgtggactacgggagagaaccagggaattggaatctaatttcttaaacaggttgtttgggtgccattggagttggaatcatctaaacaatatcggcttccaagacgaaaatagtacatatccacattttatattagagtaaatttcacaaaactatacgtctatacgttttgtggtctatgttacagaaaactacacacactttgatacttggcacttaagtacatatatttcgatatttcggtagtgtagttttacaaaaccacactatcaataaataaattcaccgtgagatgatgtggctgttccacctaaacgaggacgtggcatcctatgctattaattttgcatgacctcctatgcttgtcagcgccggcgcggacggccgttccatatttccgcccatcgacgaccaccgagcaatatcgtgtagttctcaccgccttcggcttgcatctcgtcgtcatgtcagccacaagccagcgcctttcctctcactgctatcccctcgccgccgcgccacgaggctcctcgctaggcctcatcatctctcccggcggcccctcaccatcctctggtcatctctctccaatacatgctatgctcgagatgtggagttagcaggcaactcgctggctacatgcctctttgagtactgcggctgtgcggccccttgtgtctcattccagtactatggtggctctgccattctgctactaacaggtatggtttggttctttttttttttgtccaaggaatcaatcaggtgcccattttatagtgagttttaatgagcaagttccaactgaaatttcacataggtatgtagttttttgcctcactgttgattgattttgttaaaaaaaacagttaattcatcaaatatggaggtttctaatgcctctgaaatgaaagtagtacaaaacatgggagctataaggggaggacagggaattagtattctcagtcagtccactattgtacttaatttcaagtagataaattacgcttcagtggaaaggatcactcagtctgaagtttgtggctataaccccttgagttaattgattgttccattcagcttgtagtactggaacttgacaagagaagcacaatagtttggcgtagtactggaacttgacaagagaagcacaatagtttggctgtagacagtagtaggtggcttctttcatgtctgtaggaaagtgctcctaaaccaagcacaaccttcagttgtggtaagcacaatacagaccttaactcatggaactttgaaatgaaataaaaatggtataatgctccattagacatgttcacacatctagtttgatcaacaagtattcttaataaccagctcaacaaatagtgcaagaacaatagactcaaaacaaccatatagaaaggtgatcactgaccagaaaacaagtcacataataaaatccttggtaacatatcgcgctgggattggaaggcacatatgtgcgtatatttagttgcagcagttttagtgggccatgcgcatagaagtccagcttgtcccacgatgccacgtcctcgttataggtggaacaaccacatcatctcacgtgtgaattcattcattgatagtgtagttttgtgaagctacactatcaaaatatatatatttaagtgccaaatgtcaaagtgtgtgtagttttctacaacttggaccacaaaacgtgtagttttgtgaaatttactctttatattaaaaaaggatgtctttttttttcacgtactcttgtgacttaggccctgtttagttaccacgcaaaaactttccaccccgtcacatcgaatgtttggacacatgcatggagtattaaatatagacaaacataactaattacacagattgcgtgtaaattgcgagacaaatctgttacgaccaaatttggtaagatatgaaccaggttcggcattagaatcaaagcggattcggcaaagagttaggctcgaaaaacatagtttgcatcggctgcgaagacatcggctgagatggatcggacagagtacagccgatacggtcgattctgatgaagacagttgtaaaactgcttctagaatcaatcaacatgctacacaaagattgccacgacggagataagctcttagataggcaattgtatctattagttagttaggatatttcgaatagtttccttagagatatgtttggacaaaagtctgtcgtaaagacctatgtgtatcttagagtttgttagagataagagtcgtgtccggcgaggacatattatgtatctcgggtataaatatgacccgaacccaatgtaaacaacaacacacaattcaataacactttcgcgcatcgccaccctttttacttttgttctatttcgacgagttattgttttcgggttgagctgcatcgtttcgattttcaactagaggtaaacttgtcatgacggtttgcgttctcgagattagtacttccatctttatggtattctaatcttgtttatgtaattcgtcgagttatcgtatatactttataatctctgttaattgtgcttgttggtgacatgggaccgggggtatcttgactagaggtttggggcagctgcagtcacccacgtggcctgaccccctcgggggggggggggggtcgggcccgagggtgatgtggccgcccctccctctgtcttcccgaggggtcgggccgctcccgtttcggccccgagggctggggcgccccgaccccctgtgggtttggcgccacgtgtgtgggttaggtgagcacagcggcgctcacctaaccgcgttaattgcgggttggacgagcgccccacgccgcatttaatgcagcgcagcacactcgttcggtccgtgacaggtcacagtgtgtgaccggtcacagaccggtcagatcgcgggttaggtggcaacaggcggcctgacacacgtctcgccctgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctgaactgacacgtggtggacaagaatgaccggtctgtgactggtctgacgccggtcgcgtcatcggcagacaaccgtgctcccacgatgcatctgcctccggtggagtggaggtaggtatgacccatctcgtcggatggtcatttggaaagcagccatggtaaatctccgcccattaatgagggagtaacagggagatccccggtgtcaggcgagagacggcgctgagcctcactcaaggacaagttgtgatttagcttccaggcgaaggtgcaagccaagttttggtcaagagagggtaggtccccacccagaagaaaagtaggtagaagtggtgcatgtagtatccccttgagatataaaaggaggaccttgcccaccaaagagaaagaaaaaaaaagaaaaaaaaggaggcgagaggggttctggagcctgaactctctggctctccggctctctgtaaatccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcatctggcgcgccaggtagggggcgcgtatgtttttctaagccctcgtcctctttcgtgtgcgccaagcttctcccgctcagcccattggccgaacgggcagtggcgcacaatctctctccgagcactagcggtgaagacggggagcagaacccgcgccgtcgagctcgtactccactgtccccctctcgccgaagtcttgggcgggaggaggcgctcgaggaggtcgaaagatccgcgacttcgccgcacgcgggcgatggagaaggacggcgagacggggagcgtcgtctcctcgtctacggagatggcagcacgccccagggcgcgctccaggctgcgggcgcactcctgcgtcacccgcccgtcatccctgatccagagactccaacccgacgttggctagatgacgtggccaatttggtcatgacggcgcagcagcgcttaggcgccggctggcggtcctccgccaccaaggccactggcgttgctactgctggctccgtgtcgtcgaggcggagggcgcggcgagcggcggccgctacccgccgttcgtccgccattccctcgtcaacgcctccaacccaagaagatgtgcgtagggggccagatgcccgcttcaatatcgagcgccggcgcaatgatcgccgtgctgcccatgcatcggagggcgcttcctcgtccggagcgccacttcggtccgggcacgggggccagccccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgactaggatcgaggccgccgggggtgacgacagggtcatggcgaatttcttccccatggccctgaaaggacaggcgcggggttggctaatgaacttgccacccgcgtcggtccactcttgggaggatttgtgccagcagttcaccatgaacttccaaggcacatatccgcgcccaggtgaagaagcggacttgcacgcggtacagcgaggggacgatgagtctcttcgctcgtacattcagcggttttgtcaagtccgcaacaccataccgtgcatcccagcacacgcggtgatctacgcgttcaggggggcgtgcgccacaaccgcatgctcgagaagatcgcctccaaggagccccagaccaccgcggagctttttcagctcgcggaccgtgtggctcgcaaggaggaggcctggacctggaactcctcctgttccggtgtggcagcttcggccgcccccggatccgccgctcggtcagggcgacgggacaggaggaggaagaagaggtcggcccattccgacgacgagggtcacgtcctcgccgtcgagggcgctttgcgggccacccgaaaggggaggcctgcgagcgacaaaaagaaggaggccggcgctcctagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaataccccggcggctcccgccggcaaccggcgaggtgaggccaagcagaaggcccccgccgaggacatcaacgatggcgacgatgacctagggttccaggagcctgaggccactgtcgccaccgttgatgggggagcgtgtgctcacgcttctcgccggagcctcaaggccatgaagcgagagcttctggccgtggcccctacccatgaggtgacgcggcgggcgcggtggtcggaggttgccctcaccttcgaccagaccgaccacccaccgtgcgttgcccggggaggacagatcgcgatggtggtttcccccaccgtttgcaatgtgaagttggggcgtgtcctcgttgacgggggtgcagccctcaacatcctttcccccgctgcctttgacgccatcaaggccccggggatggtgctccggccgtcccagccgatcatcggtgtgacgccggggcacacttggccgctaggccatatcaacctcccggtcaccttcggtggttccgccaacttccgcacggagcgggtgaacttcgatgtggcggacctcagtctgccctacaacgcggtcctggggaggcccgcgttggtgaagttcatggtggcggtccactacgcctatctccagatgaagatgccgggccccggtggccccatcaccgtccatggcgacctcaaagtcgcgcttgcttgcatggagcagcgcgcggaccacctcgccgcggcatccaagcccgcgggtggtgacgagaggctcagcacctccgtcccagccgccccgaggcagcggatgatcacgtgcgacgaggtcccgatcaagcaggttgccctgggcgatggcccgtccaagaccacacgaatcggtggtcttctggacgacaaataggaagacgcgctcgtctccttcctacgggcaaacgccgacgtcttcgcctggagaccggcggacatgcccggggtccccagggaggtgattgagcaccgtctcgccgtacggccgggcgcaaggccggtccggcagaaagtgcggcggcaggccccggaacgtcaagccttcatccgcgaggaggtggcgcgacttctggaggccggattcatccgagaagtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctagttatcatcagattcgcatggctagggaggatgaggaaaaaactgcattcattacccgcataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaggagaccttactctcggatctagcggaaactttcgaaagtctccgcaccgcccgcataaagctgaaccccgacaagtgcgtgttcggcgtgcctgcgggcaagcttctcgggttcttgatctctgcccgaggcattgaggccaaccccgagaagatacgagctatagagcggatgcgcccccccagcaagcttagggatgtgcaatgcgtcactggctgtatggccgccctaagtcggttcatatcgaggctgggagagaaggcgctacccctatttaagctcctcaaacgctccgggccgtttatctagacggaggaggctgaacgggccctcactcagttgaaggcgtacctcagttctcccccagtcctggtcgccccggagccagatgagccgttgctactctacctggcggcaactccgcaggtggtcagcgcggcgttggtcgtggagcgcgacgaggacgaccctcgctccgcgcatccccaccctgtgtcgactcgacccgggagagagcagggaggagaggcccccgagccgaatggtggcccgaggcccccaacgaccggaactggccctctgcccgcttgtccgacggtgccaggcgcccctgatccccaggatggccccggggccactgcgggaaggccgcgcctgtcgccctctgaccccgaggtcgtcggcacagaagccgagtgcgccccgtgcggcctctcggacgaagagcaccctgtatcgactcgacccgggagagagcagggaggagaggcccccgagccgaacggcggcccgaggcccccgacgaccggagctggccctctgcccgcttgtccgacggtgccaggagcccccgacccccaggatggccccggggccactgcgggaaggccgcgcctgtcgccttccgaccccgaggtcgtcgacacagaagccgagtgcgccccgcgcggcctctcggacgaaaagcgccctggagatgcggcccctggcgaagaggatcggccccgacaaaaggtgcaacggcccgtctactttgttagtgaggccctccgggacgccaagacccgataccctcaggcccagaagatgctttacgctattctgatggcttcgaggaagttgcgccattatttccaggcgcatcgggtcacggtggttacgtcctaccccctcggccaaatcttgcataaccgagagggtactggacgggtggtgaaatgggcaatcgaactctctgagttcgatttgcactttgaaccacgccacgcgatcaagagccaggccctcgccgactttgtggcagagtggacaccggctcccgagcccgtctccatccccgaggccagctcgggcccttcgcagctgcctcacaccgcctattgggtgatgcagttcgacggctccctgtctcttcagggcgccggtgcgggggtcacgttgacctcgccgagcggagatgtccttaaatacctggtccgcctcgactttcgggcaaccaacaatatggcagagtacgagggactccttgcgggactcagagtggcggctggactggggatccgccgcctcctggtgttaggcgactctcagttggtcgttaaccaggtctccaaggagtaccagtgctctgacccgcagatggatgcttacgtgcgccaggtgcggcgtatggagcgccattttgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggggcgctcccagctcccttagattgattgcttagatcgctgagatccaggcgtacctcgcagataagactctacctgaggaccacgaagggagtgaacgcgtacagtgcatctccaagcgctacgtgctggtggaagggaccctctatcggcacgcggctaacggagtcctcctgaagtgcattcttcgggaacaaggcgtcgagcttcttgccgatatccatgaaggcgagtgcggagcccactctgcctcacgcaccttggttggcaaggcctttcgccagggtttctattggccgacgactctcaacgatgcggtcgacctggtccggcggtgcagggcgtgccagttccacgccaagcaaacccatcagccggcccaggccctgcagaccatacctctttcatggccgtttgctgtctgggggctcgatatcctgggtccgtttagacgggccccgggcgggttcgagtatctgtatgtcgctatcgacaagttcactaagtggcccgaggcttatccggtcatcaagatcgataagcactccgcacttaaattcatcaggggtatcactgctcggtttggggtgcctaaccgtatcattacggataacggcacccagttcactagtgagctcttcggtgactactgcgaagacatgggcattaagctctgcttcgcctctcccgcccaccccagaagcaatggccaagtggagcgcgccaacgcagaaatcctcaagggcctcaaaaccaagaccttcaacatcctcaagaagcacggcgactcgtggattgaggagctgccagcggtgctctgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagaacgaaggcggcgcgcggcccttcgagccgcgcactaccagcagagcctgcggcgctaccatcagcgtcacgtccgggcccgatcactctgcgtcgacgacctcgtcctacgccgtgtccaaacgcgtgctggactgagcaagctctcaccaatgtgggagggtccgtatcgagtgatcggcgtcccccggccgggctccgttcggctggccacgggcgacggcacagagctgtctaacccgtggaacatcgaacaccttcgtcacttctacccctagtgggggtcaggtgttaggtctcgggctcgggccaaccccgcaccccccctcgggcgtgcagggttggccgggggctaccacatatgcatatacttatcttttttctcttccgtatttcaataaaagctttttcgatttcctaaggactgtgtctgtgccattgtttccttttgaagagttttggcttgaattagcacgctcgtgctcgaccctgccctcggtggctcgggccagcggaaatcgccaaacggggcccagaaccgagccgtgccccggggcgtggtgaactccgggggggaatcggcaaaggcccacaatcgggtccccataaccctcggtcaccacgctcccagcctggccagtctcgacacgtgcatctccccaggcactagccccgacccgcgccgtttgaggctgggacctgggcacgagcccttgttcaagccaagacacagaaggaccgcggcacagaccatcctcgtctcatacacacaacaaataaaattgacacagaaatttcttctttatttgattgcagattaaattagtttatacaagaagggggcccgaaggcctcggaagaagaaaggaaaaactatttaagattggcgggggcctgggggctcatttcgaggctcccgggtcgccggcctcgtggtcgctgtcgtccacaccaccgtcgccgccctcctcgtcggagtcgagggcgaacgcgagccgaggggccgtaccctcgaagctgtggacgatgtggtcggcggcgtcccggacctgcgcgcgcgcgtcgtcctcggttccgggagggaactcgtccaacgctgcccacggggagaagtccgggtccctggcctggtagcttgccagtacaagctccactgcccccccgggcgaggtctctcgaggatgacttgatcgtctcctcgagctcctcggggagccgctggagagtcccggccatctctgagaggcgctgggcgaggcccccctggttggcggcgtacttcgcggtccgctcgccccagaggcccgcttgccgcccgacgcggtctagacgggagacggcgtcccgaagcatgccgggccctacctcgcccgccaagcggagggcctcgacctccccggcggacgagtccagtgcgccctgcagatcagcgatggtgtgttcggcagctgcgaggcgggcggctagatcgccgtcgcccgcggccgcctcgccgctgcgcgccctcgcgtccagctccttcgcccgcgcctcgagctcagcggcccgctgatccagtgcggccctcttggcgcgggcgccttccagattacggcgcgcctgctcctcccgcgctgcctcgcggagggacaggctgtccgccagccgctgcgccgcggcctcggcctcctcgagagatcgctcccgctcggtgagcgcatcctcgcggaggcggagtgcggactcctcttcggcgcaggcggcctcgtgcgccgccagcgttgcctcctggatagcgacggcggtctcgcggtccgccaggtccttctccctcgcgcgggcacgctcttccagcgccgtggcgcgagcctcaagggtcacttcgcgccgccgggacgccgcctcgttctccgtcgcccgccgttcccgagcagtggtggcgtcaaggactccccgggcggcgtcgagtttcttctctagctccgccacccggctcccgtattgaaggcggagatcgtcccgcgcctcgttgagcacggcggtggcgatgagggcaatctcccgctcctcctccacctccctggcgatctccgccagctccctccgacgggcctcgagctctgaggcgtgccggcggtatgccttgcggcccgcctccaccatggcctccaccgagcgccgcccctcttcgacgcgcgcccacgccgcgtcgagctccgcccgctctgcttgcaggacctccatctgggcacctaacccgtccagcaccatcgtgttcgcggcggccagggcctgcaggaggggctctgtgttcagtggagcggcgtaaggcagaggggagagccgcctcggtgtgggcgctatgcggctcggcccgccaatcgacgtgccggactcaggggcgtcccccgaggctggctcgtcctgaacgtcgcccgaagggtcgggtccgagcggtgcgcccgcggcctcgtcgtgggtggactcggaagtcgtcgtcgcctcgggcggagtcgggtcgggggcttggcaggccgcctggcgtgcgcgcgtcgcctctgcctcccgggctgacttcccggcccggtggagtctggcctcctcccgagtggcctcctcagcctggcgaacccggacggcttcctgggcagcctcctcagcttcccggaggcggtccgcggcttctcgccggacagcttcccgcctccgggcctccgcggtcgctgtctcctcggcctcagaccggccggacttggaatggcgaggggggcgcgacggaatctcgctgaaagcggaagaaaaaccagaagacaaaaagaaacgggtaagtgaaaactcgccttgggagaatgaatacggccgcagtgggcgcggggacgaacctgcgaggaggtcggctaaacgaccaccttgggggggagatgaggtttccccggcatggttcggtcacccccatcttgcggagccgcttcttttttcgctccccctcgggctgcgacgtcggcacagcaccctccgggcgcctgctgctggcacgcaccgccccgccccctcggggaggagatggggagggggtatcctcctgtttcctcttcccccgggcgtcggcagggcggctgccccccgggcccccgtcacggggcccagacgcacgaccccctcccggggtagattgttcccccctgcggctcccgcccgcgccatcgtggcctcgaggagcccgctcccctgacgccccgaccggctgcatgatggtcaggatgttggcgcgctctggatcgctgcagagggggaggacaccttgggggatgagggatgcctccacggagctgagattcagcacccgttggaccaccatctcgaaatcctcaggggcccagtcccatctgcccccctggtgggtcctcatgtagtcctcggacccggtgtactcccaggcgccccgggcgcgccgctggagtggcgcgatccggcgacgaaggtagtcgccgaacaccatggcccccgtgagcccctgggatcgcagacccgccaggcggtcaagaacggcgtcgtagccatctcccagatctaccggcgcccgccagctggaggcctgcgccgggggctggctcggaagtcggaggcgcgctttgtcggcgagaggggtgtagaaccagtcgctcttccagtcgtcccacttcttgcgaaggacgcaggaaatgtagcggttcagcaccggcccccgcggctggaagtagcaaccactgactaccgacggtggcgacaccggctgtacggtgaagaaccaccggaacagccggagagatgggcgcaccccgatgaacatctcgcataggtgcgcgaagatggccaacgtcattaccgcgttgggggtgaggtgcgccatctggagatcataaagctccagaacatccatgaagaaagaagagaatggcgggaccagccctgccattgcgaaagagaggaagaagacggaccgccccgggtaatgcggcgccgggcgtccctcgcccagcgcgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgccggaaacggagagtcagagcacaagtggcaaaggcaaagggaagagtgacgagaggaaggaaacaagtcccttccttgatgtcttagtacccttgccaacgctatgcccggctcctcgatccccgcgcccactacctcgccccctcgtctctcgcgcccacgcctccactaatcccgctcgcccgtttgcggcgcacgaggcggatgtgcggccgtggcagtcgagatgggacatatcgtgcgcgcgttaactacgctcgccgaccgatgcaccgtcatcacatctccagacgaaacgaaccggctcgtcccggttcgcgcgctacttaagtaatgtagtggtcttgaaggaagccgctcattattgtcggtcggttttttccttgacgatgtgcgcgatttgcgaccgctgggtttctgccacctgtggagaccggccccacctgtcaccaggtctaaggagtggcgtcatgcccgagcgcttccctcgggggggggggcgatcgccctggcgtaacgccgggggctactgtcggtgacatgggaccgggggtatcttgactagaggtttggggcagctgcagtcacccacgtggcctgaccccctcgggaggggtcgggcccgagggtgatgtggccgcccctccctctgtcttcccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcgccccacgccacatttaatgcagcgcagcacactcgttcggtccgtgacaggtcacagtgtgtgaccggtcacagaccggtcagatcgcgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctgaactgacacgtggtggacaagaatgaccggtctgtgactggtctgacgccggtcgcgtcatcggcagacaaccgtgctcccacgatgcattttgctccggtggagtggaagtaggtatgacccatctcgtgggatggtcatttggaaagcagccatggtaaatctcc

SEQ ID NO: 66529 - DNA, 78482 bp, Oryza sativa
ttcgagagcttcaatgaggagtagcttggtctcactttcatcggcatcacgcctcaccttgtctaactgctcttggaacttgttgatgcgctcctggatgaagccctccaggtcggtcatcttcttatatttgtccagctgtggcaaggtcttgaagcgctcgagaactctcatcacctccgactccgacggccaaaccaccgttgcttgcgcctcaccctcaccatacaccatgaggcatgtgtccacattgcatagtgttgccagctcgcttgccttcttcatcaagcccttgagccgcttcttgaatgttgcccgccgcttcgcatcattgatgatccgctgcagcttcaccttgttgcgagccatggccttcacgattcaccactttcttgcaagaatgcacctgtagattgatgagaaatggttagattgatatgagatcaaagaaagaggaatatggtgcttttatagtggaagatcagatcgcaacaatcagcaagttgtggaaagaaattatttacagatccaagaatatcaaatgaatcaatgcgagttaatgttttcctgataaaaatgcctggttaatatgcagctggctagcatacttgtcgacctttaatcgtgtctgtctttggaaacttcattgcaaggatgagctagcaacagccaataggcattactcgctagatgataacgtgttcacaccaaagatgttaatctaataaggtgcttaatatgggtccagttcaacagatatttataagctcatcctatttcatacacataataggattgaagtataatagtcaagatttttaaaatttgcttagaattaagtacatggtgtgttggaggtaggccatgaggcccttcagccgacacgccgaagcagatggtaacgaagaacggtggagcacgacaaagcatagtgaaacactatggagttgggaaaacccgcggagtccaaggccgacaacctaatagtggacacctgtggagaggacaataaaagctacctaaaaagacccctgagaaagggccagcccaatagttgacccgtatccgctcagtaggttgagaaggtgggctaaagacaagaatatccctataaacatccatatcaatgggacaggaatgtaaaagcctatctaagccaaaccccagggtttgttgttaggcttgtaaatctataaatagcccgtaagaggaatttttctttgataaataggaaacttaagattaagatgctctaaaatggaaacgagagaatgaattcgagggattttgtagttcattaatcaaggcttggcagaagagcttgagaagtttccaacaattaaagatccagatcacggaatggatacgaaatctagtggcggcaagtaagatagggaaacagaaactattgtttttggtgaattattagtgtgcagatgaatttcatccactactattgaagaagcttttaactgtaagacgaattccaaaaaaaatgatacatacctcattgttttcgtactttccattaggacaagtgttcgtctttggacaacagctagcgccgtcgtcgggaaccgagcaaaagtcaatgccacccaagagaaggttgactaggaggaaaacggttccacagagcatcgcaggaactaccgaaggtgacgccgaagatggtgccaaagctgaagtccaaggggttcccgtcgaagctcagcctgagagtctttaggctcaggcatgtaggcttcagggggcgacgaagttgaggaccagtgagtgatgcctagcacggtttaaacaacatcggtcccaaggctggagtatgaggcagtgaagcaaaaacatggctaggctgtaggaaattcttcgccagatgcagcaacaacacacaacaacaacaacaacaacaacaagaagcggccatgcaggcaagagttggtgttgtgacgtgcgtggccgtgctgaatgtgttctatccaccctccggccccaccgcacgcctaagattgttccaagtctcggtggccccgacccttctaggaggtttgggtgctacttcagtaacacaagcttcgacatcgcactgacgattggacgtcgggtcgacactccatgcacaattccaagtcttcctccagcaaatgaatgttagtcttccatagaatactcaagtaccaccacaagcagcaacacctatgtttatgccaattgttggaggagcaactcaatggctggtggcatggcaattgacggtcattaagtataaactttaaccatcaattcctgcataaaagatatcaaatgtactagcaaaacttagtggtaggagtttactactaacaacttccactagttttggtaaatatatgtatgcatgttatttaaggagaaaatacaccagacatacaaggattggagggcccacaagtcattcataaccgacttaaagtttgaccaaaccatcctcaactgcaataggggcccacctatcagagactttagaaaggtggtggctaggggaggcttgctgtcatgcccagaaatttagcccaaatttctagactattttgtgtattaaatccttgtccaggaccagccagggtacacaaaacaacaagtaatatacagttccaacgtaaataaaagcgtaaaatacttacagaagaggcgcttagtcctcacaccgaaagagaacgacagcagcggaaaaaggcgatcctagcggggcttcagctccactccacaggcaaaactcaactggggtctgagccttggccttctaacttcgtcttcagctcagaagcactacacttctgaaaaagggaaataatagcaaggcagagtacaaccaccgtactcagcaagccacaccaatgatgcagacgtgcaaggggatacaaggacggtttgtggctatttgcataaaggcggttgtaaaatattttattgagcaaaacagtaaaagtgttgagtaattaaagtaacattaaatctccactgatcaacgctacaccacgttgaacaggcccaaccaacccacatgaactacagtgcattgagtcgatttattaaggtgggactaatcacggtgaatctggtcgaccgcccataaccgtgggcacggctattcaaatagttttactctggccagaggtgtacaactgtacccacaagacacagccccacgacacgtttccgtgtgccgacatgccaccatgacatatcggaaagaggccgtgacaggacccttcgcataaccccctctaaccaagcacaccacacctcaggtttcacccccactcctcgcaaggcagcgggcaatcccctctcgtacctaggtgaatccggaagccgcataggccgtcgcagggcccatccaaactccatcacgcccacccttgcttggatgcgtcagctagaggaaagctacactacaagcccagccgttgcccacgctggcttgtggaaagtacgaggaaatcttccagggtttcccgcgaaccggtccttaactgccatgggtgcgactagcaaaaccatgcacccacagcccacaattcagtcgcattttagttggataattacgaccactgaaacatggccgggtgtctcgagcacgcagctcgttctgatgctaaaaaggtctaatactgcaattatcccatcaactgagctagtggtaattaagcatggctaagcatatagttctagctaggtcatcaaagtaacacaagctagtcgatttatcacccaaggttgacaaaggacatatatcaaataaacatggcacacacgagcagataggtaaaccctattcccatgtaattagcgaaacgatgcatatttatttgcaaacaataaaacatttataaattgggatcaacatgctcaaggggaatgtgtgacttgccttgcttcttcaaacaatcttctgaactcttttcctcgcaaccgcggacttccgaaacgacagattctacacgctggcatgcaaaatgaggaaaaactctaataaacaccaagcaaacattacataaaaagtaaacaaacaagtagagatcaattttagatgaattttgcaagttgaacggctcaattcagagttcgaatgaattagttatgaattttcgaagttttgagccatttaaatgaatttctagaattaaatacgatttatgacgcaattgttaattattctttcaaaggaaaaaggccgtcgctgacgtcatcaaagaggtcggcgccgacaggagggccccatgagtcagcggcgcaagaggagcggcccacggtggactcggtccaccgtggcacaggcgcgggcgcaccacgtggacggccatgtggcggccacggtggacaggcggcaaaggtggtgtcgacgtggcgccacgagggcaccgatgcggggcggcgccgaacggccatgtggacgacccagattcacccggggtgaatcaggcggccacaggcaggcgggagccggctcgccgaccggccggccgggaagcggcggcgtgcggcccgatggtcaccggcggcttccaccggcacggcggcatgtgcgagagagcggcgggaaaggggagggggagtagcacacggcggaaggaggtggccgtcggcgagatggcaacgggaggcggcgacggcggagctcggggcggacgaagacgacgatgctccggtgacgggcggcgctcgggaagaggcggacgagcagcagctgcatcctaggatgggaggggaggtgttagggaggacggggcggcgacatggcctgccggagcggaaaggaagggaggaagggctcaccggcacacgggaaaacggacgtccagtgagtttccggcgatgggaagaggtggccgaggttctcctcgtccttgtggagcagagggaggtgacggcgtgggtcggcatggaccgaagcggcgttgcgacgcggctggaggtggcaatggcgacggagagaggtggtgcacgtggcggcggcgttccggaggtggaatgggaaaatggagtaggggtcagggtggagatcgacacggcgatgccgatggtggtgtcgacgcggcttggtggtggctagtgcggcgggagacggcggctggagcacgccggtgagtggtggggagagggagcgccgtggggaggtggtttcggtgacacaatggggaagcggaggggatgctggggtatggcacgacgcggcgaagccgctggtggcggtcgcgcggagcggcggcggcaggagcagcggtggcggcaggctggaggatcgccggcgagcggcggcgagaggtgcgacggtggcgttgtggttttcgtgcatgggagggctcgggagagaggggaaaatggagagggaggtgcggggaatgtttttataggggagggtaggtcggaccgagcccgggagaggcggagtcggggcggcaaccgccggcggcgtgggcggcatcgtggggtgtgggtggcggttttggaggggagagatgggcgatgaggaggacgtggggcggcggggtcccacggccagtggactcgcgcgcggggtggagaaggagggcggaaacggcggcgtcgtggggaggctcgggtggccatggcggcggttggagccggaggaaggggatgacaggtggggccgccggtcccacctgtcggcgaagggagagaggaagggatgcaaagcagactttttgcgagggaggataggagggaggccgagcgggccgagggaggggaaagagaggctggcctggccgggaaagaggagggagggagttgggccgagcctaaaaagggaggaaagggatttaatttggtttttctttttctttaaatgagtttaatgaactttgtgactttaaaattacttcttgagctccgaaacttcacgggaaaatttcagagaatatttagggcccaaagaatattacaaaatattttcggccaatgattttttttaagggaaaattttaattctcccattatttcacttgattaagttactttaacttttatttaatttctagaaaatgcattattaattgatttttaatcccgaccgaaaattggggcgttacacttgcctggttcggtcgaaccagccttggagcccccggctcccaccttgcacgtggcagttccccattggtcctcaatgacgattaaggggtgttaccgacttttccaaccgcctacagccgtcattgacacactataaaaggaggtcctcactcacttggaagaacacacaactttgggctcaagtagagtactattcacttgtagtttcatatttagtctgtgaagggatgctccagaaggagtgccccgcaatttcgtagttcctcagagaattttacggaggagtgccagagtgtcgacattctcccaacggagttccggagaaagccaagattgtcaaccttcctctctcacttgtacctcagcggatgcttcctttatcaaagtaagtgttcaagtttctttatgttatttaattagtttatttaagtaagatatattctcatcggtgtgggttcgtcacttagtgtgcaactaaatgctctagtactaggactctggatgaagaaggaagtttctgcgcaagactagagtagtaattaataacttaggcttggtgtctaggttagaaattacctttgtttattgtgtgctccacggaaagtgaggtaggtggcaggtggtgacagccctatcaggccttcgtatttctccacattcgggtacatcatagagctaaagggtggactcagcttggcagtcctaggggggctgatgcccaaagcattcgatagagttttacattttacttaattaactaactaaaagacatacgaatcctctctagccaatttatcctaggctgttgttcttggattgaatcctgatcgtagataatacacacacgttcctcgtgttcaatacccttggaatactctaagggtaagtgttacaacagtatttcgtgtgcctgcagatttatttgttattgtaagaaatacgaaaattggccactggtggcagtggtgatcgcttcgccccatcttcaccgtgcatacgttgtgctctagccagccaccccagcggtgtaagtagctttggccgaaatcacccccacacacaaccacaatccatgatgccaccgccagcggttgcctttgtccaagctcaagtacaagcacaagtaccgacataaccgttcgtgccgcctgatgccctaggctttcgctcaagcatagacaacaaaaagatgttacctctgagttggagattacacaacaaccccataccaccttaattcatagaacccaacgattgccatgtacactggcaactttgactcaagtaaattcttgtcattttatgagttgacgtttgaagcaacacacggtgatgagaacaccaaggcgaaggtgattcacctggttctagacggttttgctaggtcatggtagctcaaccttcccccaagcagcatttactcatgggaacaatcgaggggcgttcccatcaccaactttagaggaactaataaaggataaaaaaaatgtaaaaagagctcttcggcatctggcagaagccaagctagtcagcttgtgaatttgtccgaaggttctcatatgcaaggtgcaagttcaaaacaccatcgtaacttcggtcatcaacgcggattcgacaaggcttcgcacaaggccgatcactgagaaaatcatgaggaaggagaagaaaatgcttgactacctctttcgcattactgaggattatgcatgagggaaagaagatacaaagcacagaagtgaaattcaagccaagtatgaccgagccacaaggcaggacggaagcctgagtcactaaaatagtcgcaccagttaacccaccacgataaactctgccacaactgtcatggaagaaatttcagaatgacaaggggaagcaagtgatgacggtcaaggaggtccaagcctcgcgcatgaactttcatgcaaggaaatgaagcgaacaggctcccgccaagaagaaaaagtgcagcatagataaatattgcttgtagcacgataaattcacacactcaatggataagtgccgaaatttgcagcagctgagccaaggatagtctcctcccctgaaccgccaatgggctgaagagggtgatcaaccgagagagcccgaaggccaatacaaattgaaggaaccgcagatggccacaaataatcatagcagtcatcacgagcggatatgccgaaggattcacaccaacgaggcaaaaagacgtacatgaccaggcgatgattcatattgctgcaaaccccaaaaccaaggtgccgcaatactgtaacaccccaatttcttttgaccccgaggatgcgaaggggatctttgttgctcaccaagacccatgcgttatcacgacgggtatttttgggtgtgaagttccgtgagtgctggttgaaggagggagttccatggacataacattttttgatatgtactgcaagatgggccctattggtattccttacattcatagttaaatccgcaagtgcacagatagcgttgtatcatttcacccttgagtattcccaagggtattatatttatatttccgcagggaaggcaacggtgtaaagatatagtttatacatcattaatcaatccataattaaattatcatagtctaaacaggggttaagatgaatatgatcaaggggtagtgtgacacacacaggagattcgcctttgattaattactatagtggaaagggcataagagaactagaatacaactgtgcttctatattaatcatgttttgtatatacttaatacatacatgttcaggctaggacttagttctagacacccaatactaccgagagatcactctctactggtctaccagcgtgcttatggcatttatgcactcttacgtcatatctaaacatggaggaatacaaaggacatacatggctatcagcacccgccgcctacctcacttttcgtgaggctaggccacccgcatccaacaacatttatctaacctaagcagcatgcttatgccaataaataatattactaactcccaaggggctcccacccttcggatggacaagttagagctagcaacttatcaaggcccttggagcgttaccgtagcatagatcgactaacctaatcaagtgaagcatataaatgaagtacatcatattcataaagcatataaatactaaaacaatatatcaattatgaacacaagaaggtaaagaagataattctattaattcgactatagtcttacaagaagagcaaaatagtaaaacataccagaatctccgagaagactataggaccgaagatactctaagcctactttcactaatattatagaagatacaatagagtacagagaatagctccttgaggtgtgacttgtgaagtgagagggctcctccttttatagctggtaatgatggttgcaatgttggttaaacacccatatcatcattaggagccaatggagagttgaaacgtgtaaggagatggcgaggtgggcttggcctgattcagccgaactagtggcaccgcctcttgctactgaccatctcccataggcttgcacggtgcatggtggattagcctccaattaagtcagtttgagctgacttctgggcccattaatccgtgtgcttgcacgtgattcaccacaggtgtgtttctttgcatgtttattctctgcatctatgttaattctccaagtatagtggaactacattatttattattgaactacgtgtaagaagtgctagttctccctttatttattatgataattggtggtcaaaattggtacttaacggtcatcaacaatagcctcaagctgaactttgctcctcctgagtaaagataaaacttaggttgttgatcatgtgttgctatcatgttttatttctcattagtacaatgcatacaacgtatccttctacctagaatttgaataagttggcaataatacttttacctttattacctatgggacttgtagcttctcctcatcttgggtggttgagagatagagcgaatcgtagagcatcaatcacttactcttttgttcaacttttctttctggaggttttcaagaacttttgcaattaaagccaaagttcctcaaatgatactctcgatcattcaatgtgtatgatactcctcaccaaggcatggtgttgcctctttatcatcctacttctaaaggtttctatgtggagctcaaagtagagacaaaagatgttggtaatacgtatcacatatattgcaaaatcaaagagaggatccaagctaggagaaagcaaatcatacaatcttgatcaagtgtgcaaagtgtgtagctatatggtggaagcccaaccttgctgcatggtggtgttgatgttcgctaattggtcgttgatgtgctactgtcatgtgtgggtctcctggacatgctggtttagcatgttgtgcatctcgctggtccggagattcaactctcccagttgccgagtgacatctgcacctcaacccgaagtcacgaaaattttgggacatgaaaaagtcacgtgcattggactgtgggggcattccactggagctggtggactggtcttcattgggaatatttccctagagtctgttgatgggatgttcccactgaccactactcgcacttgcccacgccgagctccctactccatatgttggcagcggttggttccagccaagtgtatacccaggctggctccaatctaagagcgggtattgcaactgttgttgctgctacttcgcgacggcattcctagacatgtttcgagttgtcctgccagaaacattgctccttcaagccccctcttgtggtacgagaggaatggttagcgcctggcacttatacaaatgaaattttgggttagttaacgaaatctcatttgtgtatctagggaaggaaaacaacatagaggcatttggaccatgtttcaatgcctgcccttgcacaagataatcctcgttaatgatggagtgaggttggggaatgtctatgattgcaccattctccaaagcttcgactttaacaacaatacgagtgattaaagaattgcaatctattggtcctatcatcttgagttgttctaaccattgttttatcatggctttgacaggagagattttaatctttttagtcatggcataaaagattctcaactcatcattgcagattagcctaacatttttccgaggaaagatggtaaaggccaatgtgtcttgagactggtaccagcatcgcgtaccacctcaccaatggctcatatgacatatgaggaatgacgactggtaacgctgcagttgaccctagagcatataaggtatgaaataatattgtacatttctaaatcttgtcctacaaataatggcatacttagtccatttgatcttaaatgtcctgttatatgccatccaagtgcttgataaacaaaagaaatcgtgtacgagtcatgctgcaccactgcatagggtctcggagctacttagtccattggaatgtgctgataggaaacttaacaaactatgtttaacaggactagttccaaaactgttaccattttataaataacggtaccacctctttacacctcaatttagaagcaagagaaatacaaagatgcttagttcactgccattgatttgttgaagacatgccacagcaacagaaaaaatggtttgagcgtacccatcaaggatgctattataaatcattacgctactttcttcatttttatataggtataattgaaaaccaacttttaagtagtaatccttattgacttaggttgtcattgaggttatactccgtaaacaagtatcggatagataggaaacatcgatggatacttagactgtatgtgagattgtactttctcacatttcactactgcagaaacaaccattggtgccgttttctagctgacaccaatttgtcggcacctattcccgagattataggtgtcggttttagggattacaggtgctggttcaccactaacaactgacacctatgaggtatatgcgaaacaaaaaaaaagcctcgacggctcaattaatccagtgcatatgaggtgttccggttgcctcaaatccaaatccaaatctcacaactcacagtccaagtcaaggatgatttctgtacgagcaacaattaatgtaaaataaagaatacaatccgctacttatccaagacaaacttcaatgaacctgatttgtttacatcttcaaacaacacaagaccaaacgattgccaatttttccagtgacacacaagcacacaaccatcctacaattggtagtaaattattgcagattggcaatcccggaaccgtccaacttgtaacaacttcagttcggctcgatcagtgtaataggtgggaggagaagggaaggcaagctagcagtagctagttgggttgttcatgtcggggcagtcaaagtggtggtagccgatgtggacggcggtgtggataaggccgcagatggcggaggattccatccgccacatccccagccccaccgtcgacatctcgtgcctgctactcagtgttggtattttttaacgacattactagaaatatgaattcccagcaatggcgacagaaatggtcctagtatatatatggttacagaaggaatccgcaaacgcatggatataccattgtagcatttcacccgaaagtattccaaggtatggtatttatttaatccaaatcccaatggaagattgtaagagagaattatgctaatatatatatatatatatatatatatatatatatatatatatatatatatatatatatatatatatatatatatatatatgccacttgtatgatcagagtctaagcaggggttaatgtattcataaagagtagagtgacacaaagaaaataactcatatctctcattaatcaattctacgccatgtgtaagaagaaatagaaaagcaatcaatccctatacttctagtatacactcaatcttagtttacatctgctagtatacaattatgtggcctataccccctaacagtgccctcctggtgtttcgagagaccaccccgggttgtcatgttccttataacaacctgtcatggccgtccaactagggctacatatggaggagtacccgtactgagttgtcaccatcagcagtacacctcgaccgtcccgcaacatatatgcccaaataatgatacttaataatcgagacaccacgtctacaatattaaatactacgctatatcccccgagataacatagagcaaccgaatagtcggatattaaaccaacaccattgcacctctctggtaagctagctacacaactatatcgatacatgtataaagtaaagccgatactgagataaactaaagtaccgagagtatataaagaataatatcccattaattccgaaagtcttacaaaagaataaagaaaagctactagagccataccctaattcctccgaagactccaaggactccgagagttattctattctactccacttagcactagaatactaaactaaagtatagagagaaatgttgagcttgcttgagtgtgccttgaagtgaatgaggcctcctccttttataggtaggtaatgacggttacactatgtgaattgtccaaattgccctgtaaccgccattgaagaggagcgtccacgtggaaggccgggatgagaggagctcgctagggttcggctgaacccctggttcggccgaacctgggccggcccaacaagcctccaaacttcccaaggtcactgacaggtgggtccttaaggcggttatggcagttatggcggtttctgggacggttacacctgacatgtgggcccatcttatccttaaacttacttaggttgtgttcgtttccccttgttcccaactcctcattttcgtttttcacgcgcacgcttttcaaactactaaacggtgtgttttttaaaaaaagtttctatatgaaagtttcttaaaaaataatattgatccatttttgaaaaaaatagctaatacttaattaatcacacgctaatgaactgctccgtttgccatggggaggagtttggttcccaaccatccaaaacgaacacagccttaggagtgaagtttcatcatttcttctccatttatgtattaatctccacaaataaataatactccaggtacaagtggaactatattattctgaaaaatatatgcattgcaagcatagctagttctcctttattttatttagagtaaagtccatgtcacgcctagaaattcacaagtaatttccaaactaatttgtgcattaaatccttgtccagaaatcagccgaggtacacaaactgacaatataatatacagattcatcaaaataataactttacatacttacaaaagaaaagaaaacagcagcggaattacggtctagcgaagctccggctccactcccacaggcaactcaactggggtataagccaaacgtcttctcatttgcaacttgtcttcaactgaggtttaattgattattgcaaggtgagtacatggaatactccacaagccacacagcaaatatgcaagtgcacaaggataccaaagaatggcataatatagggctcatttgcaaaagcagcatttagtaaacatttgagaattgcaaaacagtagagtaattaatcatcaatattaatcaacactaaacagcacacccatgctgcacaggcctaaccatcctgaacaaccatacccggctgtacagatctatctccaaaccaggaatgtaccattccaaaccaggagctaatcaaattattaccagttatagcatcatttattatggtgagaagtgtgagactaatcacgaaagacattgttagacccgcccataatcgcgggcacggctattcgaatagttttactctggccagaggtgtaccactgtacctacaagacacagccccacgacatgtcaccatgcgcctcaataccaccacggtacctcgaaaaggagctgtgacagtacccctcgcataacacaatccaccacaacgcattgttcctggatcataatcaccctcttataaacaaggcatggactccccagcgacccccgtgggcttatctccgccacttctcagtctggtgccccgcaatgaaccatgttatacaaaaggtaaagccgttgcccatgctggcttatggttggcacggttaatgtttcacaactgaaactcgtgaaccggtccttaattgtcatgagcacgaccatcaaaaccatgtgctcacaacccaccattatcaagttttagttgaccaattattaattaaccaatcacgattgcccatcgtgagctaccattgaatatctatcattaggtaatagtgaaacattagttatcccaattgagtgctaatgtttctaagcatggctaagcaattatctctaatacatctagttgaaccattatataagtacaactagtcaaattgtaacccaaggtatcaaaggatagagtaatcaatgcaaagtggccataacaaaggaatagtttcacaccaccctgtgacattcgaaaataaatgtacaatagaaataaatagagaatttaaatataggatcaaaatgctcaaaagaattgtgtttgggatatgtgtgacttgtcttgcaataatcggtcttcaataagtctctggaatacttccgacgcacgcgcgaactttcgaaacgacatgaacgacaagctaacacgcaaaacgaggaaaaagactaagaaactccaaataaacacatataaagtaagcaaacatatagatcatgatttttgatgaatttagagactcgaacggcctcattccgacttcatatgaattatttacgaattttacaagatttaattccaattaaacctattaaagaaaagactattccaaattaattaaacaatttacaaatgatttataacggagataaaagattaaaacaacctccggaaaagattagatcatatttggtagatgacatatattaaaaagaaataatatgccactgaaaagagatagcacgacttatattaagattaattttgaccgagtcgactaagatcgaatggcttagattgatctgaaccggaggaaagagcacgacgaggggagctcaccgatgacttgaacgacagcaaacgacgacggatgacgacggcggcgaggttggagtggcgacggggtactgatcgacggtggcgatgactttccggcgatctttggcggagaagaggtggtggacggtcttctgcttgcagttgcgaatccaacggaggtggcggtgaagcttggcgatgacggaaggagcagcagggcctcgccggagatcaaaacgcgacggcaaacttcgggttgacggcgacgatggagctccagtggatttcagcttcggggaagtggaggacgatcttctcctcctcctcgcaaacccaacgacggcagcggcgaccgaaggcgacgaccacagcgacggcgctgggctgctagagacacggcggcgtcggcggctcacgggcttgcgcggaggcggctctaggtagaggacggctagggggtcctttatataggcacgggagctcgggtccgggcccaaatcgacgagtgaaactccgggaaagtttaggatattcgccggaaaaaggaaagattgatccgcgaaattggaaaggatttccatataaagttttggggatttcttggggaaattgaagaggagattgagaggattccattcccgtaactactttggaaagaggagcaacggggaggtcggatttggaaggaggaggcggcggcaacaggacacgagcactgctggctcggctctgcctgagctggaagatgaacagtggcgcagggagaaaaacagacttttggttgggcttctattgcacagcccgatagaaggagagatacaaactagacttcgggaagggataaggccggccgaatagaaggaagaatgggccgagaactaaaggtgaacttttcctgtttcggcccgaaaaggaaaaggggattttaattacttttcccaattaaattaatcactgaaatgatctttcagttgttaaaaatacttccaatgctcaaataattccaagaaaattcttgaacatacttggacactctaagtatttaaaaaaattaaaaccagctcatttaatgattaatttaatatgtgaataattactgaaatattctttgtattattaaaattaataattgagctctgaaaaatccaagaaaatttcagggagtataattaatcatggataatttaataaaaattaaatccaaccatgatttatatttaggaaattttatttcccacatttaacttcgcttgtaaattaatgaatatttaatataaattctattaataatttattaaataatttataaatcctgaaatgaaattcaggctgtgatagtccatcaccggtccctaaacttgtaccgatgtgttataccggtccttaaactcgcaaatcgaccgttcaggttctcaaacttgttcgactgtatcatttcggtccctaaactttcctaaacaggacggtctaaaaactttatatcaaaaaataattcataacttttttatgtgaactttaatgaagacaaactttatatcaaaattgtagccctcgacgcgacctacaactttgtagttgaaaagtttttgaattaaatctatttagggtcccaaaatattgttgcatctttataaattttgaaattttaattttaaaattacattttgggacaaaaaatgacttaaaataaaaaagaatttcaactacaaagttgtatatcgcgtcgagggctacaagtttgatataaagtttgtcttcattagagttcacatggaaaagttatgaattatttttaaatataaagtttttagaccgtcctatttgacctagatgatattcaaatccaagtttagggaccggggtaacacaactgaacaagttggagaacctaaacgagtgatctacaagtttagggaccgggatgatacagtcgaacaagtttgaggacctaaacggtcaatttgcgagtttagggaccgggatgacacaacgatacaagtttagggatcggtgatggactttactcttttatttatattgaattggtctataacgaccatcaacactcagtgccaccgccgctagcaccgcgctcccctgtgccgttgtgccaccgtttccgatggcccccacctccatgccaactagatccggtggccaccgacctccacactgctggatccgccggcggccaccgaagacaagtggaggggagaggagagggcggtcgtagctaccgccgaaggaggagctgctgccgcgcgtggtggctggatccggcgcgacacggctcggagacggcgaggaggaggggcggcgtggctcctatatttatattataagtgtcggttctagggaaaaaacgggtacctcggttcttttaaaaattgacacctagagtattagaatcgatttttctttacaaccgatacctataatatttaaaagtgttggttgtatgttttttcattacggcggacatgggaaaaggtttataaatgccggttttaaataaaccgggacctatgagctgacatctatgaagagtttagtagtagtgctttattcagcatctaggatcgaagaacatctctgaaacttcgccaccacgtttggagtgccctaaacgacgtactgtacctaatttgcaaaaagccattgggatttgggaatatggcctcggtaggagcatcatgaccagttcagtcggatgagagccaaactatgaataaatgaaaatgctagcatgcacatggatgcatatgcaaattaacagggtccggccggggagctataaatggggacaactgcattggtagcgagttttaaaggcttgagttgctgctgtccaactccccatggaatcatgcatggcgctcatttatcttttcacagtgtagcagctagctggactccgggtagagtacagtcggacactcccctaagaggccacgaaaaataaatctaaattagatgtgacatattttaatataataaatctaaatagagataattatagatttataatactaaaatgtgtcacatatattcagtattaggttgatttttaaggcaggaggagtacactgcaccagctgcatttacctacaaatcattgcctacctcggatctgcacaacgtactgacaacaattgctagctgtaccggctgttaattaaccgccctatgatcgcaaagtatagaagcataaagtatggcctcgatcggatttgaaaaaagaaatactatctagtaaactaatgcatgcagttgactcacctcacaatgacttttttgatttaatgcgtgactctttattcttccacacaagattggctacatggtcatcgagaaatgtaaatattaatgaatcgcttgtttacgaggaatgactagtagcatgtttaaatggatgataagtagaatcacttatccttggtctgtacgccaagatgaaatatgactataaaaaatagattagatggagagagagtataatataagatatggtaaaagttacacggtctccaaaactaatctttaacttataatttttcatatgctataaggtttgtagcaacaaaattataatcatataaaagtaaatttaaatgtcaatctaatgatataatttttaacaaataaaattcatttcatattacattaaatgttggtcaaatgttttaaaagttgaatcttgaatacgtgcacgccttgtattatgagatggagggagtactatggacctgtttagttgatgaaatgaaaatttttgggtgtcacattggacgtttgaccggatgtcgaaaatagttttcagacacgaatgaaaaaactaatttcataacttgtctggaaaccacgagacgaatcttttgagcctaattaatccgtcattagcacatgtgggttactctagcacttatggctaattattgactaattaggctcaaaagatttgtctcgcgatttacatgtaaactgtgcaattagtttttcgttttatctatatttaatgctccatacatatgtctaaagattcgatgtgatgtttttggaaaagtttttggaactaaacaggccctatctctatctcaatgtaacaacaggtataataatagactaaccaactataaatatatttcgataagataaaagagtatagagaagagcagtgggctacagatttgtagctagatgtagcacagactacaagatccaatgtgtgtatgataggtaggaccaggtattaacagtgtagtatatgtttataggtaactattgtatgaattaactaatttttaaattgattagagatgatttggagttagtagttggctatattattaaacttgttctaagtgcagttgtatgtttcggtgtccaacgtttgaccgtctgtcctatttaaaaaaatttactcccaccatttcattacaagacttacgcgatatttttctaacttaaagtttaaagtttagttaaatttatagaaacatagcaataacatcaaacatgcataatatcaaaatatattaaacgttaaatttagtggaactaatttggttccataggagttgctatattttctttaaatttagttaaatttataaaagtttgacttaaaataaagtcaaaacgtcatacaatataaaacggaaacgaaaggagtagctctttctagcttggggacttgtccagattattagtcacctgactaaagttatagccaaaaacaaatcaaaaagtttcagtgaaggcggaacttcgattgattcgaaaatgcacccgataataattggatttttcatgtaatctatatagtagaaataaaaacttgtccacatcatttagaaaacaatagcctttggacccgatacttgatctcaccattacattcaggttataacaaccatgcaagcatcaagcatatatacttgtacatacctacatggtttcatgctagaacaaccgatgtagaagtaaaacgaaaaccacaaatttgctggtcgctaaaatatatgtcacactttagtagaaatgtagaaacttttctctgaatccttcagtaccctccaatccaacttactccatttttcagtagctgatcaaaatacccatttttttaagttacttgagtctttagatcgcgctaagattcgtgaaagtagagcaaccccctaccccacccgtagcgccttccccggtacaccacatgtgtgaggcgaggtgctagttcacctcctccagtgccactctcctctcactgctcggcctcgctagtgccagaaggaaccaacagctttggtgaggacccccggttgtccctcctctcctacattccttcctaagtcatacacacagtggcgagtacccttaccatgttgttctctccatacgtttccctcagggtagatcccaccgtcatctatgcctcctaaccactccagatctaacgccccactgtcaatttcgcctaacgcctaaccctccctttcaaccccacaactccattagtggctccaccatcttgtcgcatgcctatgtcctctgcccattgctagttcgaccaccgtctgccggccatccctctaagtcttgggaaacccctcttcacccaacttaaatcctctccaaattgactcccatccaagtttctctgtcggagttttaacatcgtcaccaccagcaggatgtcactgctgccaccaccaataggaagtcactactgctctcgctatcgtggctggtgagtcttctacctctcctttggtcagagattaaagacgattccctagccgttggattctagggagcaatgtgatatgactaagaatttggtcacctgagaactattaattctctctctccaatatgaagatggttagaaaacaatagagggattgctttttttatttaaagtactactaggccttgccggcttgcccaatagtaatatattaatataaaagagtattatttccaacacaaaacaggaattataaaagttgtaaccagctatgcacagaagagctgagggcctaattcatcctacaaacataaagaaaaatctcattcctaaaggcagcgaaccaatgatcttcatcacacaataaactatcaaaaactttctcatttcgttgttttcaaatttgccaacatgcaaaaagacatgatctcaagaaaaccttttctaaactgaagtcttatcaacaccaacatatggcgcatttccaaattagtattccacctaattccaagacgatcccaacaactcttgctaaagggacacatgaagaacaaatgtatcaaagtttattcttggacctttacaccaagcacaatgtagatacgcatcgtcaggggcacaatgccttttgtctaacaaatctctaatattcaatctgtcctatagaagtagccacataaacactttgattttttttacatatttagttttcttcattcaaatgaaaggccttgggaccgaaatacccataaagttagacatgtaagggttacgtattacttgtaagggttagttcttctcagcttatacactcggccacttgctcgtttatcgtgagcacacttactgaactgctaaatgatgtgtttcgtaaaaaaataatatgaaagtttcattcaaaaatcaaataaatatattttacatatttgacagaaaagcccacaaaagatcttgaaatttttctactgtcagattgctttagtgcacacccacttaaacctaacccacccttcctcttcctctcagcacagccatgatgaaggctcgagcactcgatgccaaaattgccaccacgccaccgctcagcctcgccggttggctggaagacatcaatggcaccggcgagccccctctcccctggtttggcttctccacccttcactccctcctcctcctcaagctggcgccacgggaggtgccctcggtctgccatcggatacgccaccaacagccgcggcctcctaaccacaaactcgttttgcccccatcaccaacgccggtccaccacccttctcgaccccatggctccggtgtctcaccgtctctgatggccatccctctaagtccggtattcttacccaaaccctcaccccttgccccacacccatcccaacccgagaccctaaatcctaactgcattgtcttcgtcgaggtcacgatgatgttgaagtggtcgttggagctggtgggagaaggatagtgggttaccggaacacaaattgcgaaacaaatcctaagataatatatttgcaagactctaaccctaaatttccgtcgaatgacatttagcaatttcaatatatttttaagtctataataattaatacttaattaatcgtgtgttaacccaacttcatttaacgtgccacaaaaatttcacatcattcgctgattcgaacgcagccatagtcactctttcactctcactctttcacttaacgacttagggtgtgtttagatcccaaaaaattttagtaaaaaatatcacatcaaatatttggacgcatacatagagcaataaatgtgaaaaaaaaacaattacacagtttgtatgtaaattgcaaaacgaatcttttaagcctaattgcgctatgatttgacaatgtgatggtacagtaaacatttgctaataacgaattaagtaggtttaataaatttgtctcgcaatttataggcggaatctgtaatttattttattattagtctatgtttaacactttaaatgtgtatccttatactttaaaaagtccatatactaacaaatttttggccgaactaaacacagccttaacgtacaaaaacctagttcgtctatggccatcggtcgctcatcaggccatggtgacaaacgcactacgcttacgctccacagtagcagtagatggcagtagtaatggcagctccagctacttggagttagagcagtgatggcgccagctcgggctcaaattgacccgattttaatgagcacgccaccattcgctgtcgatctctgcgtgcgtctttgagaaatgaaaacgagcctagacgtactactcgatccgtaccataataatttttagttttttttacaatgtattcaattttttttaaaatataaaaaacgaaaagttatacttaaagtattataaataataaagtaagtcacaaataaaataaataataattttaaaaaaatttaaataagacgagtggtcaaatgttataagtaaaaactcaaaatatggaactaaggagtatattccaggcaggcagccagcagcagttgaccctagcgatttattggcatccatgttccgatccctccacctcacgcagctcatgcattctcgctgaccatccttcccgccggtgcgcgccactgcactctcgccgtcgagcgataatggggagctgcgtgagcaagaaggccgcctccgcacgcgccggcgccgtggccgataaggaggcggcggcgccgctcccgcctgagaaggaggtcgtcgctctgccgccgcccgtggtggtggaggaggaggaggtgaaagaggtgctgtccgagacggccgtgcccgtgtcgcggcccaggccgccgccggagccggagaaggaggtggtgaagcggaaggaggaggaggaggaggaagtttcggagagcgcgtcggtggcgtcggccacggcggagaaggccaaggcgaagggagggggtgagggtgagcaggaggtggagaagaaggcgattggcgggatggagaaggggagggcgaggaggaggacgccggagcagaggaggcccaaggaggctgcaggcaacgggagggcgaggtcgccgtcgcccgcgtcggcgcagaggaggtatggcggcggcgaacacctggcgccgccgacgcggccacggcgggagcagcccgcggtggtgtccggcatcgggtgccgaagcggcaggttctctccgtccgcggcgaggagggccgccgagagcgccgtcaggcgaaccaactccgccagggaggccgacatgatgctgccgcattcttcccggacgccggcagccgccaagcggtccctcaacggcaatggcggcgcctacggaggaggcgcagccaaacgggaccccggcgagcgatccgggcggcggccggactccccaacatccaagcacatcccgcccgcctcgccggcagcgaacggcgccatctcccggcagcagagcctcaacggcggcgccacgcgcaagaccgcgaaggacgacaccaccctcgagcaaaccaagccgcaatgccacggcggcggcggcggtggccggtcaccggaagagggaagagacggctccgacgagtcggcattggaggaggaagggcacgagcaagagaagcagacggcggagggcggcgcgctgggaccgatcaacccctcggtggccatggagtgcttcatcttcctgtagccgcccaccatttccgatgtccaatgttctcttgctctctcagttagcgtctcgctaaccttgctctgtaattcgtggcaattattgccgtaccatagattggatgattggaatggaaggtagccattgtgtgtcactttgtttaacattcatccccctctgaatcacgtgtgttctgttcttgttttacctgcgacctgtgatatggagatgcgcggcggttggccggtcgggcggccggcaggcgtcgagccaggatcggtggagcccgatgttacagttttcacggtggtcggtcggcatcccattgcggtgccatactgccatactatacgttgatatataatttttgagggaacagggagtttctcttgcaattcattatcattatagaagaagagaattgatccaatttataaaggaaatcggacctaaaaaccttaaacggcacggttaatttgtgaaaaactggcgaaaaccctggtatcgacagattgaacctaataactaagtacagccgtccatcaagggaaaacttataaaacgatgccttcaagaaggacacgtcgactgaacagcgacatcgcccgatcctacaaatctaggttttcacccggagaacctcttgatatggagttgaatgaaagctccaatagcaactcctttaagaaggtgaacggcgcctgagagcgtcgccgttgcgcatcggtaaagccgagcaaaggttttcacctcgaagtcccatccaaacaaagcaaccgcaaacggaagctaccaaatgccacctgcacactgaatgtacatgttctatgcacacaaccacctgcacaccgttgatgacctgcatagccaccacgacggaccagctgagctcgctggcgccacctggactccaacgtcgttggtccgcactggcgtcacgccaggacgcggggagccgccggatctaggcctacgtgaccagatccagccatccccgtaaaaacttcgccgctgggctgggatgaggctgctggcgccggtccgaggacggagtccgccggcgccgggacgccccagatctggagataagaagggaaggagagaagagaggaggaagaaagggagaaaagagaggaggaagaaggggagggagggagacactgccatagctggcaccaccgtcgccggcggcctcgtcggcggctgcgacgcaagtggaacgcggccgaggccccgcgcgctcaggctatcgcctcccgtgtcacctagagcgagcggcacgggagtcaatcacccggtccctcccaaaaatgaagaggtcaccatcatccatgatccattgtcgtctcgtcgatgtaggttgctgacaaattaaggaacattgacagatatgtcattgctcgacccattggttcagggaaccggaggatgtattccctgttcaaagttcaaacaataaaatccaaacattcttctcttttaagttacttgttaattttatttaaagtcaaatatttctaactttataaccattagtttctaaaataattactacatagtttaacatcctaagatttttggtttccgattcaccataagaaatgttttcataatatataatttacatgttgttgcactacataatttatagaaaatgatagtaaaagttaggaatgtttgatttagaaaaaaaaataaatgataagcaatttgaaatgaagggagtagttagaaaaaaattaacaacatccatacagcataaatgtatcactctacaaaatattagaaaacgatttacctcgcacatccagtgcacgacaaaatatcagacgctccatttagtagatcccacctaacccttctcccccacttttttctccccaatgatcaatactacccactcatttttccctcttcttcccatagccaccagagcggctaagagacgaattgttgagaccatacctgatgaccagcaggacgcaacgcatcacatcatgaaactcgaagtggttgagggtgtcactataaggccttgtccttccaatcatactacttttgtgtcaacccttttacacgaagtgaggataaatgtgtaaatggggtgctttgtgtaagtaggtccgcttgtcttgaatggcagggttgcatggttctggagggcgggctgttatattcttcacaccttgcatgtaagcggaattgtagactactaccagagagcatgaagaaataaagaaatagatctattccgcctttttttttaatttagatgtttcagctcagcaaattaggatgtttcattagttagaacaaaatgatgtagtgggctttttaatggtgtttttttgcctattcaaagcattatgtgatgtttcaatacgtcataatgtttcatattaatctatgttgtcaagttttttttaattttttataactatttaaatgacatataaccaatgagaaaacatcccctcgagggataaaaatacatatcccgctcacatgtgacatgtcacagccttatctctttctcctgtctcttatctctttcttctctttcccacgaccacacataagcttctccctcgatctctcctacaagccacacatgagcaacgcagcggcctcggcccctacgagcaaccacaagccgacaacgatggtggcggcaaccccgtccgacgagcaacgacctcaggctcatcgagtagtgagagaagcaacggcctcggcccaacggcaagcagtggccttggcgagtaacgatctcggtctcattgagcagcaggagaggcgacaacctcggcaccgataagcaacggccccagtgagtagcgactttggcattgttgtgcggcaggagaggcaacggcctcggcacaggcagtggcgaccccagtgagttcaggcctcggcctcggcaggtagcaggagtggtggcgtcctcgtcctcagcctcgagcaagcaactaggtacggcggcattggtgacctcagcatgttggtgattttaatttctttggttgtcactgagacctgaatggttcacatattttcttttttatttagttttaaatgtttttttttatttaggtatgcatctgggcatgctgtgggtattgatttgggtatcaatatgtgatttggacagagccgactcgaattgagcttctttctgttttgtgatataaatcgaggcttaggagacactggcaatgtgatcctattaaggttggctggacttttggatttgtgtgattttttttctttccttgttttcccttttctaagtaactatagagcgtgcacgtgcaaggcacgttgatacatagaatgacagctcactgaaaattcagttcatccttagaccattctgtaaaggagaagcttagcaaaccgtttcttcagctatgaaatgataaatcaaaataaacagagtgatgtaagtttagattgatggacctagaagatttagaacagtgcatatttcgaattttaggaaaatatgaatatgaacacttttcttagaatgacagtaagtgaacatattgatttgataaaatattatagttacaccgtcaccatcatgctcaaaatgaagcaacaggggttgtgccagcaacaacccttccctaagcacatatccctgtgtcatcggtgtgccgattacaactggaaaaaaacaatgagcagctgcaatgctcgcgccacttgatctaaccttttttatgcagtctactccatataagttgacgtaaaagcagggtttcataaaccacttgaatttacctaaattactccccataatgaaaaacagtacccaaatgtatccaaacaattgatgtatttgataagctgcctatgggatcaacctttatgtagatggtttgcatctttacggttcatgtcctacaaggggaatcagactgataagttatcaattcaaggaacatgatcaacccaacgcaatccataaagtacactttcaagaaccccaatccatataaaagagccctttaagagaaacaagcaatccaacaacttcaatagtgccaaatctaaattcttgaggacagtggtggagccaggatctatactcgaggggagggggcaaattaagctaagtaccaggattgtgaaaaaaaatacatcaaatttcaagtaaaatcgaagcattttacgtgaataatcaatcatataaatatacctatattttttgaccatacagaagaatattttcatacatattatttattattcgttacatacatattttttttattattttagtgcttttatattaaagtggagcggtaaattaaaaattagagcttacgaggtaaaagacattagcagtcaacaacgatacgtgaccattggaagagctgacctttctaactgtccttgcattctaacatgttaaattgttgcctgcttgatttgctctaaagttctagcattgcagagaccatggaatgccgagccaactaccatgacaaaagacatgtagggttatacctccagcttgttttggactgcaaatctagcccaacacaccaaagtgcttaacataatcacctaatttaaggattacttagtagtaggtcctacaacagacacacattgaggccaggcccccctgtcttcgccgttgctcgagggagattagatagaaacacataataacacattcaaaaggttgttagattagaatagtgcttaatcaaacagaaattaattattgaatgcatgcatcttagagcaaaacaaggaaacataggtaattcttattattgaacaagatgtagtgaactcatgttggacaaggtacaacgtattggtactacggggaaactacatggtactacagggtatgcaacgcccataagcaatattaaacaaaatatgttgtgtaaccaagatcgtaggactaaagggataatttctgaaataagagcaaacatagcaagttcagaattccattccatttgtttcttcaatcagtttagccttttatgataacagtagctggacaatagcttagaagattgaagcttttttttaatccttccatcaatcttgaagatcacttgtccacatcacatattcacatatatatctaacttcctggcacaatcagattaaagtaagagaatagtacaagaaaagtagaaaaacatttaggaatttaatttccacttcagaaaacaaaaatatcatctaacagcaacactgacttcaacacctatgttcttatgtttgtcaagtaccgtatcaagaagcaatggaagtcattaggcccatacataacatgacatttaatgtatatatacaataaccatgcacatgcagtgcatgttataatctagtatataatttaaaccaaacatttccttatttataacccatcaaaagttttgacatttataaggagaagatagaacccatgtcaattataggatctgaaaatggtgagtaccaagcacaagatccttacaaagccatatccattggtgtaatatcatccaaagctatttgacctgttgtttcttttccaaccatctttttgtttgatgaaagccctgtaaaaaaaaataattttagcattctagaagtgagatcgaaatttctttgtcactcaagcagtctgctgctatatggctaaaacatatatgagcaatgaaaacaatttcagatgagaatttctcgtagcagaagcataaaaagctaagcatacggaagtcctccaaccatacttttcaggactggaccggtaattgaaccagcgggggcatcaattcattggttcaaccattatgaatcagtaacaaacttacttaacagcatatacacattacacaattacagtctcattctccagacaaaagcacatagctactaccaaactcatctcaatctcaaaaaacacaagacaacaatgttaaattttaatttttggcagtattctgagagggcaagacgtacgtcacctgagagatatttggaattgatcttgcaaacatatacagtcaagaaacttggtatagccccagtaaatccaagccaatttcttgcagctagattcggaccgcaagctgcaaaagcaaaaatattttatgaaacattttttttgaaggcagcagtgtagttagaatctatattgatttatcttgtctgtctaatcttttcattactgaccaagaagctaaaaaccaattaccaacaaggttaggcgagcacttgaagaataatgttcaagtatgcctttgcacagacagcgtgggcgatggttgttgaaccaaaataccaaatacagccaagctctacagttttttgaaccaaaataccaaatactgtaaaactcgttcattgagcacctttggcaggtgcctgaccggccctgctcacttgtacagccggccgtgccagccgctcgcttgtagaacagctattgccgccactgctgcaggttcaacttgaaatcagcaaatcaggacccttcacctcaagttttgatgccaatttttttctacatatctgatatttcctacaatatactaatgtgagtatctcgattaaaaaatcaaacacacgcccaacgattttgcaatttcctctagaaatttcgattgccatttgggatttgtggagataagcaacaaatactgacctgtatccgtagtcggagttgtaggggaggttggagagcagcgtctcatccatgccgtcgtccccgacacgtgtgacccgcgcgtaggcggtcgctttctgcgcaaggacctcgaacaataggccaggccggtgaggaactcccgcacatagtcggcgaatcctcagacatggatttatatggtgctaggttgttcacctcacccgcctggctccaattaacgaaccacacatccgccaacacctcgccctcctccaccgttggtcgatgacgagcagccgcggtaggaactgcacctcctcagccgcctccacccctcggcccccaccatcgtgacgacaacggagaggagcgtggccaggaagaggagactgcacgatggagattacggaagtggcggttcagacgaagagagaagatctaggttcagcgcgccggcggtaggggaggcgcgagctggatggagagggcaggcgcgggaggtgaggaggcaagggcgcaggcgggcgccagcggcggggatgtgcgggcggggtggagggcgagtgcctgcggcggagaggcgcgggcggtgtggtgggcgggcgcggtctgtggtgggcgacgtttttttttttcgctgctattggttctttttcgctaactgctgattactccaggtgggatcgctaattgcaggggttgatctaacttttaatatgagccgttggatgaatagatctaagggtcaggagagagaggtatttgataaactagtgctttttatattgaatatagatgattatccgattggattttgtatcggtttccgattttgttcttttgtccgtcgtacacctaaaagaagttgagtgtactctcctctaaatattatagcataattgtcctgcttcagttattaatggacgaaatttatttatgaacaaggtaatattgaatctttcttcagtggcctgtttgcttttggtatgaccagcaaacattggttttgggttttgcacattgtttaccatggtgatccttctgaacttatggtctgaattgtaggttattttgtggagggtgagcttctttgcctctcaaggatctgatgttgcacgagataatgtgcttaggttgtacaagcaaactgtcgatgctgtcatgtgcattcttttgcacacgaaatatcatccttcgcaatctcatgttcatctaattcatctaatggtcgaatgaagcaaatgtgcagcagcatttcatgtggcttgcgatgatttgtttcagttgtgctgctacattgctgagtggaattcacttcagctgtcctgaacctggtgggcggtggcgtccgttttcctcgccacagtttttacagtgactacatgctgtccttgggaaagactgaactgagctgcagcaggaagagcttctcgctagccgacctacgtaaattcgccaagccgcaggtaacacttcaaacaagtagatcagtcataaccatctgtacttcaaagaaatggacaagttcagaattgagaggactaattcagagagaacagatatgttcagacttcagaacttagatgtgataactgagcagagttatgtttttgctaggctgattatgtgctgagatattaggccctattgatttaaaaaagtccacagacttttagaaacaagataaatggaatggctttttccattaacgtgtggcacattacaagggaaattcaaaatatgctcttcaaacatattactcttgaaaatattgacaaccagacctgttacactgctatgaaaatggaattttttgcattgtcaatagtctcctacaagttcttctggttgggtgattatttctagagtgcttctatatagtttattcagcaccttagtgaaagtacctgttgtctcttatggtggataatgtgcgaaaacacatttttcgggaatacgctagaagcgtatttttgcattaagaggagtaaaacagacatttacaaccaaaggcaaaaactgcaggggacaggggaaccggacaagagaaaacataccccgccacgtgcctacacaccaccacaccgagaggaacacacggccacctccaaaacgatgccttcaagaaggtcacgacattcaaaacgccgccatcgcccatcccgaaaggatgaggttttcacctagaggatccttgaagagggggagggaagcacctcaacaacgccctcaagagggttggaatgcccaaagacgtcgccgttgctgtccaagaattgggccggctttcgcctagcacctgccaatgcccctcttgccgctacctcaccgactcccaggcaatgtcaacacgtggcctctacagcaacaatgcccctccgtcggctggactccaagcgacctaacctgctgccagcgcgacccccatagctacacgttggaacgagcacgaccaaaccaccgctgcacttcggcgaccagctagccttcctcccatgccgtcacctccaaagagagtgcccgccaccgcccatcactatcgataacaacctggggcaaccttgctgccaccttcaccgtctcgcaaaggagctccccacgaccaggcggtcaagaaggggaggagctccaaggagatgagaaggcacccacatggcgtcttgtcacaccccgaagttctttcccaagcctaaattgaagttataaatggtctcaagaaaataccagtgtaaagcaagagtaaaccttaataaattaatgcaaataataatcggaattggcatgtggaatttttcttgagttctacacgtcgaaattcgctaacaagatttttagtggaattttcagagccctcgaaataattttaaccaattaaaattgagcacatgcaattttaaatcccagggaaaatcttttcctccttttctttttcttttccctccttttcctcttcttgggccgtcggcccagtccaccccgccgccgtgcgcgccctcctccttgtgggccggcccaagccgcccctccctctctccccgggacgccgacaggtgggccccacttgtcagggtcgtccccttcctccggtcgcccgccctacgtcgccaccaccgccgaaaccgccgccgcgcccacgtccccgcctcctccgggccacgtcggccacgcccgtgcatgtgccgcgtctcccgcacccactcccccctctctcccgctcgcgcccgcgcccgagatggccgggattcgaattccgaatcccgcctctctcgcctcccctactccccacgtcggccggcgattcccgcccctaccggccacgtccgagttccccctcccctatttaagctccaccgccaccccctctctctttttccccatctcgccgaactctcccgagctctccatcgctcccgcaccgtgcatccacccgccgccgcctttcccgccactccggccgcctctagccgccgctaggctcgccgccacaccgcgccgtcgccgacgttgggttcgagtggccgagatccaccccgttcacccctcctccgtcgaggttcgccgccggagcgccattcccgccgagcgatggtgagagccgccatgtccaccgccttcggccggcattcccgccttctatggcccctctctccctctctaatcttttccttttcgttctttaggtcgtcccggaccccgtccaccgcttgtcgacctccctccgtcgctcctcgtcgccggtcgtcgccgccccctccggtgaggactccctcccctttcctttccttccccgtttccccgtgcgcctccgccacccgcgctcgccatcgccttcggtcgtcgccgccgccggggtgccgtccgctgccgccgcccgcgccgccgcttgccgtcgccggtggacgcacgcgtgccgccgcccttgccatggctggccggtcggctttgtgccgagcagagccgagccaggtcgccgctgcaccgtccgatcggccccgggccaatctgggccgtcgatcccgtggaccggctgtggaccacccgcgtggttccggtccacggtagaccggccaccccgtgcgccactgacatgcgggccccgcctgtcggcgccacccccttgatgacgtcagccctgggatttattgcgcaataaatgatttaagggctttttgttatagtaataaacatagtgaatcttctaaaattcataactaattcatccgagctccgtttaagcccgttcaagtctcagtaaatcaagaaaaatgtgtagaatccattaaaaatggttttgttctctgtttcagtagtcttatagcctgtttgtattgtttgctttgtatgtcgcttagattccggttcttccgacgctccggtgtacttcgagatagtcgctgaggttcttccagtagtagagcaaggcaagtcatgcttgtcacttgaacatgttgatcctatattacaaatgctctattgtttttctttaaatactgcattgttttataatgttactatgggatgtttacctactgtcatagtcgtactattttgtaccatgttcctttgttagcttgggatataacatgactagagattggactagggattgcttagccatgcttagttcaactagcacacaatgagggagatcctattaatgtttagactgtaggttctaatggtaatgttggattagtgacaccgcttcggtgttggttaattaaaataaatcacatggtgggctgtgggtgcatggttttgttggtcgcacccatggcagttaaggactggttcgcgggatgccctggaagaacttatcgtacttaccacaagccagcgtgggcaacggctgggcttgtagtgtagctttcctctagctgacgcatccaggcaagggtgggcgtgatggagcgaggcgggccctacgacggcctctgtcgcttccggattcacctaggcacgagaggggactgcccgctgccttgcgaggagtgggggtgaaatctgaggtgtggtgtgcttggttagagggggttatgcgaagggtcctgtcacgacctctttccggtatgtcgtggtggcatgtcggcgcacggaaacgtgtcgtggggctgtgtcttgtgggtacagttgtacacctctgatctgagtaaaactattcgaatagccgtgcccgcggttatgggcggtcaaccagattcaccgtgattagtctcaccctagtttagtctaatgaaattggatagtttaggtggatggttgggcctgttgcaacgtgggatagcgttggacagcggatgattaatattgattaattattacaactgtttacttctttcaacttctgtttataaatgctcgctttaggcaaatgaactactctagctctcctttgataaatccctgcatcatacccctattccagtatgacttgctgagtacagtgggtagtactcagtcttgctctattttccccaaccccagagtacgagtatgtgtcagatggtggtttctccgaggagtaggcttcgtccgtgccgtcgaggatgcctgtggagtggtgttcccactgcagatcaagtcaaggcttagctccagttatctttcgtttttccgctgcatttatgtaagacttttatgatgtttgtaagacgtggatctgaatgtcaacaccccggccggtcctggacggggattttaatgcacattctacttggaattctatttgggaatttctgggcgtgacacgtcccctcgtcatcgccggtcgtgatggcagtgctgtgcggctgaatccgagctcgaccctagatccggcggcatctccaccggccaacacctgcagcgctgccacacgggcgacgcgcaacgaccccgccgccgccatgcaagccggcgtcccagtcgggtcccccacaacgcagccatccatctggcagcagcccccaccggtggtcatccatgaggtccggcggcaagcatcgccggtgccagccactgccacgtcagcccgctgcacggcgccgcacgcatcgacctcgacgtcggcgtcctctcgtcgcgcatgcgccgtccttccgcacgcgccgtcctcctgtcgccggcgacgccggccatcacgaccctggccatccgggagtcggatccggccgcggggacgccggatccgagcggggcgcctccggagccgccgccgccttgccaggtgctgctcccagccaccgggccgccgccgctgcccccagccgcattgcgccgccgggccaccgtcgccacccccagccgcgcaccaccgcgggctgcgctgccgcgccagatccggccatgggggtgccggatccaccgccaccccacaccgccccaccgcctccacttctcccagcggtggggtacctcatcggcgtcgccccgtccacgtcgcgccgggagggagctgccaagaggaagaaggacctcgccgccgccttccatgctcgctgctggctttgccgccggcgagctccggcggcggcgaggcgggggagagggggaggaggcacgggcggctagggttttcgccccccgagccgcccacgcgagaggacgcggggtagtcttctgtgtgcgaaaacacattcacttcttttctatatatcgttgctcaaaattcttgctaattattgaaatacacaattgttcagctaatatatatttccagatatcggtaaaaacacatgttctttacttcttttcccaagttgtgactcctcatactacaatatctatatacttgaagttgcacgctgtccagctttgcacgagtaaatgccatctttgaatgtctgagcagtaaatttttattgtgtggaattgtttttttatatgtatcatgccttccatctgtccattactctttttgcagggaaagcaaaatcaaggccccatgaaatatgcatcaatttataatcttgcttaggtctgtcaatttataagcatcaatgaaatatgcatcaatttataagcaaaaacagctccagcacgggcttaggtctgtgttacatggttaacccgattaaagagaaggacctaaactgtttgcaaggtggtcaagaaccaactaacccaacccagcctagctagcagtctaacacaatgcaaacccagcaccgatgagacgcatcctccaaacttcccaaagccttgttcggattgaagggattaaagagggaataaattccacaccacaaatctacgataggtgtagaatagattcccttcaatagggccccaagggagaagagagagatcctagcgcggtggtggtgtcggtgccggtgccaggcagctttgtgggaatcaatggcagtgagggcttcctggactaccctgactcgactgcaaatgcaacttccttagcacaggaggtggcaatggtgacttgtgattacctgccacctggatgaatttggctcacttggcactttggcagtcaaccaattttattgattttattaaaacagaaataaagatgttgtgtgagatccagtcaacaacctaggccgtgtttagttccaaaataattcttcaaacttccaacttttctatcacattaaaacttttctacaaacacaggcttccaacttttccatcacattgttccaaattcaaccaaacttccaattttagtgtgaaataaacacagccctacaaaagtgatgatagtaagtattaccgcttcatcacaaagcaattgacttttgggatcaaaatatagctcttttcccaagcggcccgtttggttggagggagtttttaggagggattgggagtttagaaggatgaggctattaagagttttgtttagttgaaagacatgggaattttggtgggatgaggatggggaattgaggaaggaactccctccttttcaatacctgggtaggggcaggtaattgagagggaattcctcctttactttgtttaagcaaatctccatctatttttattaatgacctaatctccaactaaattccctatcaatttccatcacctctaccaaacaagatattgggattaaaaatcaaatttccatcttaatctcatcatcaattccctcatgtaaactcccaatcctcttccctcgagttaccaaacaagccgtagaggtttcactaacataaagcatatatggctgtgtttagttcagcgcaaagtttggattttgcttgaaattggagatgatgtgactgaaaagttgtgtgtgtatgacagattgatgcaatggaaaaagactgaagtttggatccaaactttagatctaaacacagcctatataaatcggctgctgcaaattccaagcaaaataaaaaaaaattaagtgcagacagccatgttgcgttgtgcgcttttggggtacaaagtataaggtgctctttaaacaacctatcgagaccgaaacaaagatcggatgtgtgggtgttgacgacaaaaggaggagaagaagaagaagaagaaattcgaagatgaagagaggagttgaagagccaaaagctctcacccatgcactgtagttgcggtgaccgggagcaccctcgccggccatccccatcagctgcgctcttcggatcatcgccgctgccatgatcactgcggtttttttgctccttcgattcgatccgctctcgctcgcgtcggcatcgcctgcttgctagggttagctctcgctctcttttcccttcttccctgatccccgattcccgacccgacccgacggtctccctccggattttgtttgggttccttttttttcttgggctaattaaatccataccattacaactgctgtatcgattcagataaatgccactacaattcgtttattcgtaagcgtgccatccgaatacacgataggggcgaaactcctaaggcgattgacggtcaggagcgatcgggttttcctctcctccacgtggtttccttttttagcaccgtattactttcctattttagtaaatttatgcacccaaagtttatacacctcaagtttacacatctaaagtttacaaacccaaaagtttatatatccgattcaaatttgaatttgaattcaaatatttttatatataatatttctatacatctaaagtttatacacctaaagtttataaatcaaaagtttatatacccgattcaaatttgaatttgaattatatccgattcaagtttgaatttgaattcaaatatattttatacatagtatttctatacatctaaagtttatacacctaaagtttataagtcaaaagtttatatacctgattcaaatttgaatttgaattatatccgattcaaatttgaatttgaattcaaatattttttatatatagtatttctatacatctaaagtttatacacctaaagttgtttaggtttatagacccaaagtttataagtcaaaagtttacgtacacaattcaaatttgaatttgaattcaaatattgtttatagacccaaagtttataagtcaaaagtttacatacccgtttcaaatttaaatttgaattcaaatatttttcatatatagtatttctatacataaattttttcaactttgtttttttttaatttatagtgtagtagaaagagaagaaggggatgagaggagaggtgtgtaaagggggcatggggatcgctcgcgatcgatcgcccattagccacaccccaataggggttccaattgctatccaaataaataatgttcgagcatccttagttggagaaggattatgatgatattggctgctggtatcctttttgaaaacctgtacattcagtcacctggtaatggtatgcatgcatgcttaatattttctcttaagacatctgatggcaaattaatcatgtccatctttttagtagtactcagttcagctttcttaatgatgagagcaaaattaatctgtggatttgatttcagtctactatttctttgactaacttgtgagcatctttgttttgctgagcagcatgaagagaatccttaagaatttataattgttccaaagatttttaattcccgtctataagtttgttgtttgtttatagtgattgtgagcatttgtgtttgaacaatatgaacacccaaagctttgttatagacatgtaactatgtaagaatatgttggtgcccttgcatgcagggtactgtacttcttgcaaattaagtagcaatgcttggttctggagccacatccatatatactgtactgatgagcaacagaggtatgtatacacactagtacatatccttccaccatctgtgatggcctctaatatgtttggaattaacgggccgtcacaagaaagtcatctcaattcgaaaaaacgtccgattgaaatatggtcatacagacatgttacatgttagatgggtgcaaaactcaagcccgtcacagatgacatctatccgtaacgggccgtagtttaggcctgattgagatatccgtcacggatgaccatcatccgtgacgggcgccaacttgggggccaattgagataacaactaggcctgtcacaggtgactcatccgtgacaggctctatactaatacccgattgagataacttaatctctatcgggttttaactaatgcccgtcaccgatgagtatttttatatgaaatatttatatttataagttgacatgtagtaaaataattaactgcaatataataattcattttattagtcaaaataatttttcggatagtaaatgatttcaaatcgaaaaattgtcaaaaacaaaagttgtataacttatcaagatttacaacttttagtttggtcatttttctatataagttttttttaacagtttgaatttgaatttgaaaatatggcaacttcaaaacaacattttcaaatactaaatgatttcaaatggaaaaattgtcaacaacaaagttgtataacttatcaagatttacaacttttagtttggtcatttttctatataactttttttttgaacagtttgaatttgaatttgaaaatatgacaacttcaaaataatattttcaaataataaatgatttcaactaaaaagtcattaacaaaaaaagttgtataactcatcaagatatataacttttatttttgttatttttttatctgataaaatattagtaacatttataaaaccagatgagagatatcatgtggttccaagttgaaggcattccttggactattctgtcaaggaagacgaaagaaaactgaaactaacgtcactgcacttttttgtgtgcaaatggaaccacgctacttttatcagaaatatcttcagaacttcttcagtgttcagtattcgtgtgtgcttctcctaatctcttcggagaaaacgttcctaatcatttacttgttcgtctcattatttttcttttacaagcttgcatgcaccggcggcctgacgctgccgagaagagcatattttgacgttagagatacaaacaacttgatggtgatgattgaaaaagcccagcatacagacatcatttccgttgagtatgtagtactaaaatcgagagaagcacggcacaatcatagtacgcaataacaaatcatcaattactcccaccgtttcatgtcataagacattttaactttaatcaaagtcaaactgttttaagtttgatcaagtttgtagaaaaaatagtaacatttttaacccaagacaaatttattatgaaaatatattcaattattgatttgatgaaactaatttagtattataaatattactgtatttgactataaacttaatcaaatttaaaacagtttgattttgaccaaagttgaaacgtcttataacctgaaatggtcgaagtaataacaaatcatagtatacgttgcctcatgttgcctcatgttgcactaaggacaatgtggtagccattccgataaaaaaaagttgtcgcaagttttttaagtggaaaactttcagatataaatataatataattggagtgtaactatattgtaattgtattataactacgggagcgtatcctatgtacacaggccctcgcgtgtacacaccgtgtacaccaactaaaaattatcacaaaaaattctaggaaaattcatacatgtactttcaataatattacatctacgtgcaaaatcgcatcttcaaattcattctacatagagaataacaaaaaagataaaattctgacaaaattacaaccttaaaactgtcagattttttgttttttttgttacggctaaaatataatgaatttgacgttaagattttaaccctaggtgtaatacaattgaaagtataggaataattttttctagattttttggtgacattttttagttggtgtacacgtgtgtacacgtgagggcctgtgtgcataggatatgttgcctataactacatcgcaactgtgcaactgtgttgtaacttatatgtactgctgtggaagacacagaaaagctgactggctagttgcacatgcttgtgtacgtgatcgcacggtgtcagatttttaatcaacttttttttcataaaaaccataatactgtgaaataacacgaagcaaccccttccactgctagctttcaccctgttataaattttgtagaaatcctatatacttttgagaaatgtaatatgaagaagagcaaattccgtttttaaaggtggcgatataatactaagaagcacaagggtcttttgcaaaaaatcatccaaatctaatctcctgtcctcctcttccgccgcccccgccttctaccgttctccaccaccgcctatccttgccccagccgccagcatactacccctcctccccctatctccattgcccacgctcgcccaaaacgttctcccctccacacggtgacggtggcggtgagacaataggggtgttgcggggccaggactgcagcctagactggtggtggctagtgccgcccagccaaacaagccggcactcgccctcccatccggtcctaggttgaacttatattttgggagagaggtagtactagtgcaccaccacatcaaacaaccaactcaaacgcataataaaccataaacacaatattttagccactattacaaatgcacatgcataaaacataaagataatattttagctacatgacatgatagtcagaaacacgagtcatcacaaagagttgtgtcaagtgcaggtatatttttttgtccctgacagcaacggtttgctttccacaactaaatagaagcatcagtagcaaactttgcatccttatgtggagcatctcttccagctttccatatcccaactgcactgaatgcagcaaataactcaactacatgacatccaaacactagcttatctcgaaatgcacccctgggcatcccgcaggaagtcaacagcctgtgtgaatgacaaaacatatgtgaagctgaaaccgagatggaaaacaaagatgatagtaattgtgagcaaccacataccggttgagcgcatttctatcttcattctccagcctttttaccttctccacatcttcaataattgccttcttcgtcttcgtcttcaattcatcaagttctttgaggatgttggcctttttgacgtgattaggattcacatgtttgaacacaaattaagacaagaatgatcaattactcatggtatcagaggacggaaagtcatcagcattgctaatgttgttagagcaggtacaatagcaggctataagccaactataaatatattttaaagagaaaaaataagatagagaagagcagcgggctgcagatctatagtcagctgcagcacggactccaagacgtaatgtgtgtatgataggtgtgaccatgtattaatagtatagtaagcaactattgtatgaattgactattatattggctatacatgatttggagctagtagtgggctatactattaaacttgctctcagtgatatgcatttactcctcaacattgccagctaattaatttaatataataaaaaagtatagtggaccacctatttaattgacctattacatatagatggaccacctcgctattgtctccatattataatataatctccaaacaaagcaaacgcagaaaataaaacagatcgattcgactcccccaattagtgcagccgaagagaagagaaagatagccgagagagagggagattaaagagatgaatctccctcgatcgaaccacacaaggatgaactggaggcaggggcagcattgcagttacctcgtccgtggcgctgatggtggagaagggtcgacggctgcggagaagcatccgcgactgcatcagcacggcgtggcggagcgacatcagggaatccacctctctctctgtctctcgtctcgtagaggaagaacaaggctagggtttcgatcgtgcggaagaagaacgggaggatatagtactatttgtttcttttcctttttttccctttatctcttctttaaattaaataaaaaaatatataaaaacacttatccgtttcccgtccctaataggagtactaacaaacagctgtactgtcctatcctatatatttaatgtattactgctatattattaattactagaaaattatctgtgcgttgcaacgggtaaatacgttttcttagtgattgaaacattgcgatcactatactttatgattaaaaaatttaatgaaaatcctaacactgatattgctatccattataattaaaaatttaatgaaaatcattccttcgttttaaaccgaaaactcactcgttcattcctttaaatccctaggccattatgtaacctccactcaggctgcctccctttgaaccagccaacaagtagagccgcaggctcagaagactattgtcttttaacctcccaaagatagaccaatgcccatacgacgtcggagcagatctttcccatcaaatctgactgaattttgctcgatctcccaaaattggttgagggctttcgatccactcgatctactctttccgtcttccaaaatcagaggtaaaactcacgataaaaacaaccggggaagatcgtctatagtcggagattaaatctggtaaattaaaagtcgcatcaaaaggggaaatcatgtagaaaatgatgagagaagagcggggaatcgattttttaatcaattagagtagataatgcgcaatcgacatgaaggcggcatggcgctagggttcggcccgagcagcggcaggaggtgcgcggatggcgcggtggaatagatcggggaataaaacggtcaaaaaaaaacccagacagaaactgaaaaaaaaatggaccaaaaaaaaccagacggaaattgaaaaataaatggacaaaataaagcggtgcaatagatatcagttgggatcgggaaaaaaaagctgcaacaaaagaaaagatagaaaccgaaacaaaacaaacagaccgaaataaacagaagctgtgattgtggcgtgttcgccagtcggacaatgggcgggagtagataaaaaaaattaaaaacctaactcgatacctaatccaacacggatgacgtaccaaaattctggcaaaaatatctttaatttttataatagtaaagattaaaaaaaaactcgtggaaataaattatatacttgctcactgatatattagtacaatttttttatactagaaaaaatgcccgtgcgttgcaacagttaaaaacattttccagtggtacaaccgctattagaaactgagctatattagtaagttgtttggattcaagggttattttgagagctatttgacctttaatgtacctttccatggagagatatagagaaaagatatttttttagcgggcccacccaaaatagccccaattagcacctcttgggtgggatattttttgggtgggttatttccaaatagccctcaaatagctcatccttttggttctttttgggttatttgggctatttgagggagggctagccattatgtagtactagtgtactctctccgtccaaaaaaaacccaacctataatgaaatgagatatatttagcacaatgtgtcaacctcgttgtattagaatatgtcacaccacatcttaattttttttttactgagggagtaattagtagtagtactccatatttgttttgttattattcttttgtgagagagaattaaattgctactagaaacgaagagggagacgggtaagatgggccgtgctgagcctgggcctgtggcagagagagggagagagagatatatgcgtcagatggaaccctaactgaaaatccgaaatccatccatgtccatgtccatgtccaagtcgatgtcgttcgccggaacaaggatgatggccgcggcggcccggcgcgccttccactcccagcctccgtccggccccctcaccgacatcgcggaagaatcgcaggttgagatcgtctgtttgtttggttggttttggggatcgatcgatctttggttgctgctcatcagttgattaattgaattgatcgctaggtgatcagctccctttatgaggtggcaaaggcgaagaatctttcccgggtgccacggcagttggatccttcgacgcgggtgcacatcgctctagatatcgagcacaaaatcagcatgatcaggatcggtgctagtccttccgaaccgcaaggatttatttatttcttaaaatatactaatactctctctattcctaaatatttaacgccgttgactttagattactagcaccctgcccgagattttatcgaggaaaaggggatggcgtcaacgaaatttcttgacatgggttaagataaacatcaatcttccgtgcgatattatgtaggaagttactaatctgacccaaaagaaataataatactccctccgtcccaaagaataaatcctagaaacggatgagatatttatttgtactacaaatctgtactgagaaatatcttatttgattataggttcttatattttgggacggatggagtaataaaaataagctttaatgactcactcaccgaagcaacaggttcaaatgatcgacagcatagatgaaacccatttgtgattgattccaaaatagaaacctgaataatagataaactgatcagtcattagcataatctactactattctaccttgaattatggcgctggtcaaggaccgctatataggtgtatgctagtactgatcgctgacatttacaaactaagtaaaatgatcaaactcctttctgaacctaagccagcaaaacagacaacgttgatcattttctgttgaatagcgtcctcaacaagcggtgcattttcggtcgagcatcttgagagaacgcaacacaagagagagcgatgtttcaggaccgacaaaatctgctgtggatagcaactgaatttctggagaccgaacgactgccccatctgatcaggggctgcctgaaagaccaagagcctgcttgcctaacatcgtggccgtgggccaagcagttttctctcatagataagaatatcctgctcttagcaccggttttcacttcgtgtagcagatgccatcactgaccgatggtttcccagtcaaaagctccagcaagttgtctccaaaactataaatactggcagccatcgccaacctcattgtgtatgcatattctgcaatcataattcaacagaatttagtttcagtacatatctgatatcccatagatttcggcaagtgttatccgctagatgacgggagggggatgggggaagaagaagggcgggagaggcgctgggagggggaggggattaggtgactggtgcgcgggtaggggtggcgctggcagcagaggacgtgatgtcatgataggaatcggatgcggatgaagctcagagaaacgacggacggaaaatctgtggcaattggaaaaatacgaatttttttaagtatatataggttagatatgcataataaaaatgatgatacgtatgatgaactaaaaattgatcttggtttgcgttgcagatcactccgtggggacatttggtttgacaactgttgggcaaacaatctttctttagtttgtcttttatccacattgtttggggtgtgtgaggctcgagccaaggagaatcaacagtctgaccatatgtcctcctcgtcaccaccctcgtaataaattattatgtgtaaaatcatgagttcaaatggattttattagattatagtataatatgtacgtcttgttatcttcattatgattttacctcttgtggtatttatgtactccctccttttcacaatgtaagtcattctaacatttttcacatttatatatatctagattcattaacatcaatatgaatatgggaaatgctagaatgacttacattgtgaaacggaggaagtattattagtaccaacctccttaatttaaaccttgtgtgttcttaatgcattactacctccttaaatttaagccttgtggtctttattattaatacctcagtaatttaagccttgtggtcttgatgtactaacctccttaatttaaaagccttgttgtcttgatccattagtacctccttactttaatttgtaggcagtgtcacaacttaaagagttaagagtaactttaagtggtacaactatatgtttgtctcgaacttttttatttgtgcatgactccatgcacccaaatacaacttgctcacttactttcatgatgccttgtggtgaactgtttgctatgttgttaagattgctgaaatatttgtggttaagacgcatctttgttcattgttaccgacagttaattgatgctttatgaacctcctattctcaaacagcttcctagcaagatgatatcttgttacttttttttttttgcctataagatgtgcttgttttcctaggtggctgggctggtgccaagcgcctagtcattcttggtggctgccaagcttcttgtttggtgttattcgtgttaagtgatgcataattgcgatgagcaggtgcttttgttcgaataatggttcatactgcaatttccatcgggtgtcctttcagcatatatttcagtgctattagttatgattacctgttattattttgctccgacgtgtacaataaaatcgccgaggctgagagcctttatgaggcgcaagcacaagtatagcaatcaccttatagtatcacccttatactaagtggaaaaacaaaacttgtacaccgtaataacccctcaatttttttctttaaaccgtctgctttatatcctaataactcaattttagtatcacgcttactatggcaaatgctgtgacgagaaaatgtggagtgaagctgagatttgtaggtcagtgcctgtttagcacagctccatctcttttaaagttagagctcaactaaacagtttcagctccacctaaaatgagaacggagttaggtagagctttatcataaaatgaactagagatgtgaagctagatttagacagctgtacaactccacttcaaaccaactcttatagctaaatttaaaaatttgagctctaccaaacaggctgtctgtactactacccgcttgattttgcaaatgcactgcacgctagctgctttctgttccggggttcgaacgcgagctgctcgatcagctgcgaatgactaatgtaattttggaaacggatgctgaattcttgtctgcgcgcatgccctttgcgccatgtactgcttcctagtactgtcctcggtcttgtaaacttggccaatgtttagattccacctaaaattttacatcatgttatatcgaacgtttgaacacctgtataaaatattaaatataggctaaaaataactaattgcatatattgtgaataatttgcgagatgaatcttttaaacctaattgctctatgatttgacaatgttgtgttacagtaaacatttgttaatgatgaattaattaggcttatatataattagtttttttattagtgcccaaacactctatgtgacatcctatacaatatccgatgtggcatgtcaaaactttacacccctaatctaaacaccccctttgtgtagcacatagttttgctgcatatggaatcatgtctgctgactcgcatgagtacaggcacccaactttgtatctgatcgtgtcttcagggattcacctggagttagtctctgtatacacggtgaatttgatgtttctatattaaattacagtgatttaagattttaaattttttatctatattaagattatttaaatattatccacgtaattgtaggaatacccagcttcaaaaaatcttgaaataaagttgtgtcaaagaggactctgtagtgatggttaacgaagggccattttggtttgataccaaaaacatgccctactaatttattggcaaatgtaaatagtttgtgtgttagtttagattgaggtcaaatatttggtagtgcctctatcctatttggttatattttagaagtttcttcactaaactataataatattactttatattggtagcaatccaaatgttagctaaataattttaccctatcaatattttggtagtgccaaaatttacctagagtgtgatattaccaatgaattgatagggtaaggaaccaaacaagcccaaaaacctcagcttcaaaagaaaaaaaaaagaagaatagacttcgcatacatgatgatcatcacctggtaatacaaatcgccaaaggattaaagcatcaccaacataatgtatataatccaccccaaaattttgttttggtttcttaaactgaaaatagaaagtgaactcatctctttaagagaaagcctaaataaaaactaaaaatggaccattcttttaaactaccaatagaaatctcccattccatcaaagatcaacgctgatctccctccccaacgccaatttcccccaccacaccatcccatgtcagttgttctttccctctcccctctattccccactgttgctgccccacctctccctacttgcagggacggatctagaaataaataatagtgggggctgaataaactacatcatcataaatcaaatctccagtccccacatcttatgaatctatggaaaaaaatagtgggggcttaagggggtctgcactgtcccgggggcggtagtggggtctcaagatccccccccccccaattgtgagtccgcccctgcctacttgccctcgttctgctaaaaaaataggaatatgagtcgtcgaaacaacttccttcaaatgctactagacgatgagtcttcgtcggatgacgacgatgaattaatttttgagatagttgaaacagagtatgatagtaacagttttacatttagatgcaaaattattttgcatctaaaatgttgaaaatgattttcataaattagaaataccaaaattttccaactaaagacctaggtgagtctaatataacttgtgcctatatgaaactttgtgaataatttaaacatttttcctttctaacccaaaataaaaaaattttggattttacttgcattgcataataggtcttataaataaaatgtagggagtggcaaagttcttcaatcatggccacacctaggaggggaagcaaggagttgaattgaagatgggggaagagaagctgtgaagtgttttacaaggatgtcgagcttgccaccgtagaggctggcgacctcgcggagcatgcgttccggctggtcccggacggagacgtcgcggactgagccggtgacgcggaaccccctgccctcccactccctgaggcgctcgcccagctcggcctcgttcctggagcaggtatgcacggccgcccccagcgccgccagctcgtccaccaccgcacgcctgcgcatgaattccccgcgttgatcgtagaagcaacagaaggctccgcggcggaggtctccctagccagcgagaaggggataagtgtgttggggtgagtatccgatgccgccggcagggttttaaatttcgaaattgctatttctgtcgaggacactgaaattttagaaatttcgaatttttttgaccgaaattatttaaaagtttaactgattttgaatgaatttgaatacaaattgacaaattgacaaaaaaattgtaaaaaaacgaaaatttcgggcgagatatgagcttgccggtgggagggcaaaattaacgaaatttcaaaccctagctgcaggtgtcgccggtaatgagggtcctcttgctggccgaggggccatcttcccgcatcgccgctggccatcgccttagtactgtggttcctctttgctctagctatggcaatcctgtcccatctgtttgcaggaaggatgggggtattttgcgaagaagtcctatatcggatctgttcttcggaaaaaactcttcgaaaatatatactgtaaagtttatatagtgtacaaacttagaaactaacattggataaaaattggacatataagatttattcacatcactcttagtaaatttttcactatttgtaatttttttattaagagtataaattttactcacgataatgtggagaaatttcatacgtctattttttcatataacgattgttttatatttacactacttatcggtagttattcggttgttttgtgaaaagatcagaacgcggtaagcctgtaatgatcaaaaattttcacataaggtctccagactcgggagtccggccgctatgatcgatagcggtccggtctctactactctctccgtttcacaatgtaagtcattctagcattttccacattcatattaatgttaaagaatctagacatatatatatatatatatatatatatatatatatatatatatacatacatatatatatatatatatatattcattaacatcaatatgaatatgaaaaatgttagaatgacttacattgtgaaacggagaaagtatcaagcttcctccggatgaaccgtgggatgctggtcagagagagttagcctggagcgttggccagttcggacttcggaggatacaaaaaagtatctaaattcacaacacaaccattctattcatgtcttcttcaccagcaacatctgttcaatctccaaataataataataataaagaaaaaaaacctaattaaacaacatcttcagttcacctgcctttagcgaggcttcggttggctttgtctgtaagagcttggtcgatcgctgctgtaatcgctgctagtgtttccctgactccccggcgctcttcttgatcgtggcccgatggactcacccgattccatgatggaactgtaggtatcttctgcgtacgtagtcctaaatatagagtttagatcttctccatgcgtttgtccttgcaagtgcttcaggatctgaaaggagaaaaggaacttcttgtcacatataggagtatcaaatatcagttatttggttatgtagttattgttctattttattctggaacaaggcactaccactacttgtacagttgtactgaaggtttagcagtttcgatgtttcaaactcaaaacttttcagggaaggaaacgaacctgaaccatggatggacgcagatgtgctgattggcgcacggcagcggcggcacactccatcattcgcatcattttgttttcatcataatcatctccaatatccggatcaacaaggatatcaaagttgccttcctccatagcttctgaaatcaagggttttgcctgaagaagcaaattcagaaatgttctatcaggctagacatcaaagttcctcttagaactacatttattggagtgaaggaaatgtattagatgtcaaggaatgaattttgtcaagattcaagaacttctttttgttagaaactgacccaaccaactaacgtgctgtccatgtaagactcagatgactgaaccggcagccttccagttatcagttccaagaggacgacaccaaaagcaaagacatcggctttgtcagtaagtttcccgctagacaggaactctggagcaatgtacctgcagaaaagaggatttgctatgaatacaatgagggataatatatacttgtgctatagatattcatgttcagaaattagaatgaacaaactcggaatacatagggaatgctgaagagaagtactgacccaaatgtgcccattattcttgtggaaacatgggtgtggtttcctggttgatactttgctagaccaaaatctgcaacctgcaaaggatcaagacatactgagtataggactgtgcaatataatggcatattgtttgcaattcaaacttgtcctgggattgcttcaaaaaaaaaacttgtcctgggaaaaccagatcttcttgaaacgttgaataatatgtgcagagagagtaccttgggctcaaaaccatgatccagaagaatattggatgccttgacatcacgatgtataattttaggagaacctgaatagtataaacggactttttcgtattaaatcacagttcaacactagatacgaaactgaatataagtgtataacgcgaaatggatgggtggagtagaactaacagtcatcgtgtagataggccaaaccccttgcagatcccacagcaattttccatctttgctgccaatccagaggtggccacttgtcccctgaattaagttcaacagtaacatgatcagatcagagtaaaaaaccaagactaaaaaaacattgactaaacagtcaacggatgcatttgacagaagaaaaaacaaatatgtaaaccattattttttttattcattttagatgtagacataggttttataccgtgtaaatgcgtgtcgagcgtcttgttggggacgaactcgtaaaccagcagcctgtcgttgccggagatgcagtatccgacgagggagacgaggttcctgtggtgcacgcgtgtgatgatgtccgcctcggcgcggaactcgcggtcgccctgcttgctctccgtcttgagcttcttgatcgccacctcggtgccgtcctgcagcctccccctgtacacgcacccgaatccgccctgcccgatgacgttgtcgggggagaacccgcccgtcgcggcggccagctggtcgtacgagagcgagccgccgtcgatggagatggagtgcgggcgctcggagccggcgtcggagaacgtgccgccgctggtctgcggcgccgtcgggtggtggtggtgctgctgcatgaagacgaatggcagcggcggctggtcacctgcaagcaccaaagtgtggtggatatctccgacgacgacgacgacatggacgtacgtacgtacacgacgtcgaacgtgacaagaatcacaagatgcgcgcacctttgtagtaggggttggggttgtataacattggcggtggtagcggaagcggctgggcctgttgccgccgccgccgccgcctccatcgccggatccagagcgcgagcacgcacaagcccaaaaccagaccgacaaccccagcggccactttgacggccacggaattcaagaacgagggcgagcccgtctggggtgccgcgggtgccgggtcggacgccggggccgtcgtgatgatctcggtcacggcacggcgtgctctctgcccgtggccggaggagatgacgacgacaccatgcaccgtcgtcggtccaccggtgatggtcaccagggcggccttggcgcgatccaccacgtcatagagcctcgcgaaagctgaaggctcttcagggggtacatactgaggcggtgggggtacgaacgctgccggccgtgccatctcggccggttgggaataccggaaacgcgcccacatcaccccgtctgcggttgtgcgtgtgcgcggctcggtgcgcgcgaaacggaggcttttatagtgggttatggcgagagatttttaggtaaaaatatgttaaatgtaattatagtataaatatagtgtaattacatactaactatgtttttaatagatcacatcgttgacttttgaagatatgtttaatcaattcgtcttattaaaaaatttatgcaaatgtataagatataaataatgtttaaaatactttcaatgataaaataactcgcaacataataaattataattatgtaatttttttattaagacgaatgataaatgtatggcaaaaagtcagcggcgtcttctattaaaaaacagaaataatatatatgtaatttagcttcttagggcatccacaatatagtctaaaagtggtccataagcaatacaatatttgtttcagccacctagcaatattgtggaactagtccatagcaaagaaataacaaaaactacccataagcatataagcatatgggctaccttccatactcgtaaaggaagtcgtttaggataatgtttaagtcaaacattgggaatataaatcatgaataactctcaagttgttgagtttgaaaatgtaaaaaatatatgaatagatttgtcttgaaaaatactttcataaaagtatacatatatcactttttaataaatatttttataaaaataataagtcaaagttgtattttggagactgtgtcgctgtccaaaaacgacttcctttatgagtacagagggagtattatttgtctctgtcctatctatatggactattttgatatatacattgttgttgccattacaatataaatacatgctgatacctttttcatgaaaaatttgatgacacagaactccgtttgtaagctctcactccttctgtctcgctgagctgggctggcggttttctcctcaactatgcggcgcgtcatgcctctgtttccgcgcgaaaacagagtgcaagttgccacgggctgcacacgaaagcggagacgaccactcggttttggaggtgggaacagcagagacccactggaggcatccaccaatctgcggtgttggtaacaccgtaagtactcctacgtaacaatgacagaaatgagcgtggcaaatccgtgggccgaacggctggagacggcagcacggaccgggacttgtgctatcatccaaagtctaggtttaatgtgttggctagtgtgtataggaatgaacagttgtcgctgtccagaacaatgagttgacgttcacttttcaagacattaaacgtgtaatgagtaatcagggcgctctatcgtgcgagggttaagtattaacaagtcaaattcaatgatgaccttcatcaacgttaaaaactggataagttaactagctggccattgtcagcccagcagttgtgccagtagatcagatattgccaatatgtagaagcgtgtgtttatactacgtcgtacaattgctcgtatatatatatatcttgagcagcccatcgttttacaatttaatatgttgatgaagtacaatactctctcaatcctaatataaatataactttgtattgatgtgactgtatgctcagatttataactatagaatataccatatttgtacaaggtttcacttgtattgagacggagggagtagagttcaactactttagtaggtaaaactatgagaataatatgtaggcctagaatgagataagttcatggggaaggattgggatcctttgcatcagagtacaaaaatttgcaccatccattcacaatcaattcactaaacgaagcattttcgagacttccgtgaaagtcttcttttagcttgagttcatcggcctgttggcgtcccattttttttccgcttattaccatcttctgaattaggtagagtgggagcactcgacgaggcatctacgacagtagaggctcttcctcgttttcggccggacaattccataaatagaataaaaaaaaagtaaataagatcaagtaaccagaagaattgtgagaaataaatcaatttattaagttgagacacatcgagggataaaacatttcatactatcatcataagttgattccatttacaattgaatttatttattttttttgtttctttttatgtgagtaaattttattttgggccatatatttttacccatgttgcagcttgggctaggttttagctgagtttttcaccttggaccacttaatataaccatttgtttcatcctggaccatagccgctcatcttctccgagtccaacaggcgataacccatcaccaacgtgctcatccgaacaagcgttggcggcagcggcggttactgatgcgcttatttgatttgatcacaacacattagcttggttgctccatgctccacaatcccagccggccagccaagttacacctacaaccaaatgggcaatggaacatggcttccgttcactgaagcaacaaaaattgatgcaacatcattaaaattagaacaactcaaaccatgcatttgtgttgcctctgtccctaatgtaagcatcaacaaattactagttgctatttgaatcgattcccttgcctcacctcgctgttgtcgccgatccgccatgagctcgccggcctcgccctcgtcgacggctggcgtagtgcatctcgacaacacggcagctgagagggacgtgatctagcaagccaaaatggccctcatggcctagagctaacctgccgtcggctgaacggagaagtgcgccgcagtgcgaatcagctgtgcgttgctgctaaactcccctcggataggactaggagctattggcattaatcaagcacttatcctcttgtgctcaccacatcctcctcccatcgatagcccaaaatgctattcatgatgatagtgatagcaactcaagcaatactaacgcactgcccctggtccaaactgctatattttgataaagttagatggtgttaagtgaaaagattggtaaatccctggtgcattgtacaactaggctaataaaaaggggtccaagataaaccgaatcgaacaccgaagaaaaaaaaccgatatttaggttcggtcctttgattttcgttttgtttttatttggcccaccacaagtcaatcgcgcccctttcttctccccaaagaagcacaagaagaggaagagcttggcgacgatggcgagcggcagcatcgtgaagaaggaggtcggcgagaaccacgacgtgctcctcttcggcgtcaacaacagcgtcaagggcgacctcgcgccgcagcacccgatccaggccaccgtccacaaggtacccgtcgctgattcccctctcctcgccccctcgaaaaccctaacgcgctgaatccgggtgattggtggtggggcttgcccgcgcgcaggaggccaagttctgggcggataagaagaggttcggggcggaagccatctacggatccgctttcaacatccgcaaggatctcgatgcccaaatcctctccaagtaatttcactatcctatccccccatatgatttcgctgggaaaacgatttgttcgagtaaataatcacttgcggttcatgttaacattagataactgtgtcggtattacatagcatatattggaattgttagggtcaatgacaattttgggtggaattcctcacactcaaatggccttattgtgggacgagatatgtttctttgaatttgatgatggcatgtattccccctgtgtttgtctgttagataaccctcgcagtacataaaaaaaaaacctcgcatttacataattttctgtaggcttcaattaaaaaataaactcaaggtctcgaaggatcaaattaaatatgtacaaatgaaaaaccccaaacaaccagacgttacgtaatcattagcatgcaaatcaaacgggaaattaggggatttcgtgggttagggaaaataatctcacccgatcgctcgctggctcattgttgcttctcatgagacaccagccatcgcacttgctgtgtttgtgcgtctacccgaggacagtacaaggcaaagagacaaaccaacaaacaagttagtttcaggttgcgataacaggcatgttagctgctgttgtgtcgggtactcggatgttgtttatgggttgagcaagagagcaaataatggaccaattatgtctgagtattggtgtcaaaagacaaggttctctggcgtcacccatgagagaatagaatagagcacttggaacaggccaaagccattggtatcatgtgacaccactgctataacgttggatccacccctgttttgtgtgtctagttgtaaatccgttagctctttgcatttactgcaactattttgctcttattgtcgtatgcatcaagtgtcagtgatgttatgtttagtggtcatcagcggtattctgctaactgttactccctccattctaaaatttaagtcacaaccacctttaacctaaagaccaaaaaacaataatcacctcattgtttgaatcatcataataaatactaatgcatgcaccctatagaattagagatcttgagggtgaaggatttaagaaataataatttagtggagaggaggtgctagttaacagcctcatcttttggcttatgcttatgtttataagccaaaaattgaattttcaaccttaaatttggaattgattttggggttttttcatcatagtttattttccagcctttgtcttttagatcgctaaaaacacggatataaaaaatttatttgcaaattattttctgtttgcaaatatgccatttcacttattctgtcaataagcaaaacgatgggggtcctaatttcaatgcatgcatgtacaccttgtataatgaaacgtgaaaaaaagtagttgtgccgtatattttggaatggaggtagtagtttgcaagttatttctgaaatttgttctcgtggctatgtgcagtattttgagcactgtttttaaggtgtttaattaggtcctgtttcttcaagagcatttccacaaatcaaatattaggactgctaagaatgtattaatgctttgagtatgctaacatggatggaatgtctggattccttggtctggttgaatacacaatcatatcttgaggttgctcttgtttgtctctccgtctctccgatgtagtaacaactaacaactagcacatcagcgcaactgtgcaaataagggaaaaacagcgtgcgcaactcatgcccaggctaacattcaagatgttttggttgatgatttatctgtttgcaggttccaaaggccccctggtgcattgccatcatctatgctaggatacgaggcgctgactggttccttggatgatttcgggtttgaagattatctcaactgtaaggcttgttgtcctttgatttcctatgaatcttcttgctggcctttcacatttacgtgcaactatttgctcaccaacttttgctgatttattagctgcatgtttgatgcttatgttcttcattggaattatggaatccagtgctatcaagttctcattacctttatattaattctagtttttttattttagtagaacaaaaccatgtagtcttatgattccttgggagtttagaagttcttgggaaaccaagggtcatgaaatgatacttgtttttcatttttcatacttctagtcggtacatcttgataaaattttgctattaggatatacttggaggaatgtataataattatcacaaagtggttattttattctgtcctcatgatatgatatattaacagcaaattacatattttgctttgtcatccaagcttggttggccttactttgcatggcaaaacatacatctcatcaccattttcagtgatgagatgtatcaccagaaatacagcctctatagactatatatatttcagtcccacttctgccctgggaacattttttttcttatttacactcgctgagtgttcttcctgttgttggaaatgttacttagccttgtgttaattttctttttaccttggatcatgttgcagtgccccaagattctgacagcttccatgctccagacatgcaccacggaatggaggttcgccttggtttgtcaaagggaccgatttgccctagtttcaattgatttcacaaaatgtatttctcgtcttgcactgttctcctcattcaatatctatgtcgctctttagactgagatttcgatgcttgttttggttcataaccacacttgtgacgagattccttatccatcatgtagacctcacatgtcattgagataaaagagtgtgacaagagtgtctcatgctagctaaagtgtggctccaattttgttagccacacattaggcaagttggtcaaaacattgtgtcaaccttgcataaatagaaatactcaaccaaacagtccattacgcttatacactgtcaaatcaaaatgggacagtttcagactttggccgtggcttccatccatcgtcaatgcttcaagtgtggggacttcttcaacagccccatccattgtcgtaccatgtggttgatctaatataaaggcattccgagttgagctatttaaacaacccaactaaaatagtactccctccatctacttttgatagacatatttccaaatctgaaaaatttacttttgataggcatatttcaattcaatcacctatcctattaatgactttctatgatttaatgcgtgactctccattcttccacacaagattggctacatgggcatcgagaaatgtaaatattaatgaatcgtttgtttacgaggaataactagtagcatgtttaaatggatgataaatagaattatttttccttggtcattgtgacaagataaaatatgactatcaaaagtagatgtaagtagatggagggaatagtattggtaaatctctctctgcgagtaaagttcggcggcatgagttcttgctttctttggaccctcgttggtacatgcaaatacagagcagcgagtaatgcaattctcgttccctcattgcatgaactacgttccaaaatcatctcgatcggtgcaggtgtaggcctaacctttctgaaaaatcatttgcgtctctgaaatactccactccaggcagcacccggcaaatgctagttaggtccatcatagttttcacttgaaaagaagcctgccgaaggttccaataatttgaacaagcaaacagaacactggaattgcatgtatgtctcaaaatcgcagagtattgactcctttttcggacacgttttatttgtcagttgcgactgaaaaggacacatagaagaatggatgtgctaaaaatgatcgtccgtcatatgaaagatacatttaatgtgaagagcacttggggcacattgagttgtttagagattttgcataacacaaggaaatatttagtggaaatcatcaaataaatgaaaacccatgaaagccatacttacatattctctaaattcaagaaaaatttgctaaagataggtatatgcaagaaatacattcatactagatctagaggcgatagtggaggccgcggggtgcggttgccaaatctagccccctctcgttcggatccggcttgtccggcgctggaggctgaccctcaagccaccaccagcggagaggtgacggcgcggacgtggaggtggcagagtgaggtagaaagggcgcgacgacgcgccatcgatggagggcatgcccgcgcggtgcgatcggtggagaagggaggaagtggggcaccagctaggagtggccagtggcggcggtaggctggcgtggtgctgctaggaagcccacctgacggtggtaggactatggaagtccaacgcggcgtggcgatgcaagaggtcgatgcaggcaggtcgatgcgggtggcaccagcggtagcagaaggctggcgtggacggcgtcgggaggttggcgcgacaacgacaaagaagccagcctgactgatggcgtgaaggtcgacgcacgcgccaacggcaaagaagctggcctgactgatggcatggaggtcaacacagtgatgacagggagtccaatgatggtggtgtgtgccacaaggcatgctgagactgactgacggggggtgtcggtgcagcagtggccacgtgcctacgaaggatggccggtggtgaaggaatggagcatagctatggatcgataggggtgagaggtaggtgtaaaatctagcttggtcttaacggcttgggaaaaacacaagggttaacgtgctcaagtgaattaattatacttctatctctcgataattcaactgaactgttgtcttccttgtaaaatcaaacttagttatgctactttctccattttaaaatataaaaatctagtaccgaatgatatattttctattactatgaatatgtatctatagaaaatgttttatttaaatttaggttattatattttaagacgtaggtgacatctaaataccgttagtatggatttattgcttgaagttgccaacgtgtggtacgtgtgtgccatatgcttacgtcctcgtctatttaggcgaacggaacagccaaaagaagcaaatggaagcccaaaatggaaggcagaaggaagattatacaaatccattgtgacttgggtttaatttgtgggagcgccggagtagcctgtcgatttcagtaatgccggccagggccagtgtgcactgtgcagcgatgaaactccatccatgggcgcggtcaaatccggggggagagagagagagggaatgggaatgcgtttacttggccgggacacgacgtgcagcctcgtccacgtacacgcgagcagagcagtaaaatcgcccgccgcgacaacgagtggatcggaggggagccaactgtgaagtactagtactactcaagtgcggtacacatgtactacctgccaggccgcgactctctcctttttttaaaaaaaaaattacacaactacaacagagacactcacaatacacgcgcactcacctttataaacacatacacgtaaaacctacccctatgagtatctttgaagactagaccatcaaatccttaagattgacgaagtcactacagacatctcgctatcgacaggtacgtcgcctaccactgaaagcacaacgccgataaatcctagaaaatttgctaccatggaaagttaaacccaggacctataagatactactgagtctctcgtaaccgtacaggttttttcgcgccgcgactctctccttcgcgaaagccgacgcttgtatgcatgacacgcgtttgtgacagcttacccaagtctaagtacgtctttctgcccttttaactagttcaatattctctcagttcttaaaaaaaaaaagacaaatcctaggtttccgtgtccaacgtttaactgttcgtcttatatgaaattattttataattagtatttttattgttgttagatgataaaacatgattaatactttatgtgtgacttgtttttttaatttttttcatataagacggacggtcaaacgttggatatgaaaacctaagtttgtcttttttggacggagggattattgaacagttctcatttccatacttgttatcgtgcaaaagaacttttcgcacttctaatcactagtttagtattcagaagtttggaataaattgaatttaagcttattaatagatatgaaaattagaattcttagacgtatgtactttgcttctaagttacacacaaaatatatcttaatgttttttattatattatatattgtggatttgatttttttggaattactcaatacaagattgtcatgtggagtcttaataactattattgttttattggctgtttttaaaatactccctctatttcaaaatacaagcatgtctaatttgtttaatagaaattaaggtttaatacaaaatactttgatgcccctcatgaatggttggggtgagagggtatttaaaggtaagctggaaagaaatttaaatgatagatgattgatggaataaatagtaatccgaacagtattagaattgtttatatttgataaatttaaaatgtgataagtgtttatatttttgaacagatgatgttagaaccaatatatacataaaaaaagtttctaggatatgattttaacaaatgattcattttaagaagtttgttttttcttggatgaaggggtagttaccatttactagagtttggattttctttttcatgttcaatatttacattactgatagtgtgagatggaatcttcatttatttttatgttgtgttcgaatgtgtcggttcggaacctatttctccaacatgaaaaatgagataggttgttagcacatgattaattgtattaaaacaacttaaatataatttttcaaaacaactttcctaaaagatgtataaaaacacatcgtttagctggaaagtgtacagccaaaaacttgagagcagaagttgagaaaggagacatttgaacgcagccttggtctccttggacaaatggccagatttactcaattttattcgattaacgtggacgttttaggaaatataagcatggatattatgcatataatgattggaatcagtccgctggctggcaggctgatgtgcttatctgcgctataagaggaggatggagcacaggtggaacagtgactggattcatctacagaaagaaaattcaagatttaacaatcaccaattttattctaaataacattcattttatgagacggagaagaaataatcccgcagatgcacacctgggcaccaccggaatctccgtcccccgctccgcggcgcttcagaagtctcgtccccactcccgtgccgcactggcccagccgcctgagacgacgtgaacatgtggcgctgagccgtcgcccgagttccacacgcccaccccatccacaataatatatccaatccacccatccatccgatcaaaatactgggagaaaattggagttgggacgcgagattctcaggcgagcacacgatctcgcggcgcgctcacgtccacgccctcgcatccacaagcgccgcggttaaaaaaccacgaggcaccgtgtgtgtttgtgttgctgtggtggttgccttggctgctttggagagttgggaggagcagcgagagagtgggggttgatggcggcgatggcggcggccgtggcctcgtccccctccccctcccccgcctccacccgcctcctccgcggccaccacccgcccccgtcgtgctcggcgccgtcgctgctccgcctgaccaggtcgtcgcggaggctacggctgcgcgccgcggcggcggcggaggaggccgacgtgctccccgggcctggggccgagggggagatggcgacgggcgggaggctggaggagcaacccgaggggccgatcgggggcagccaggtcgacatcggcgggctcgccttccagggcgacatgggcggaggagggttcgccggcgggagcgggggcgccggggccggcggcggggacggcaacaagatgctcgaccgcggcatcaacacggccatcgtgctcggcgccagcacctacgccctcaccaagctcctcaccgtcgaccacgactactggcatgtacgggaaccttcgtcgattccccccaaatcgttttgttccattttgtcttctcttctctgtgctgttcttgatttgattcgattcgaagctaacatcgttccgggcgggctgttgttcatgattggattgggtgcagggatggacgatctttgagatcttgcggtacatgcccgagcacaactggtcggcttacgaggaggccctcaagaccaacccggtgcttgccaagatgatgattagtggcgtcgtctactccctcggcgactggattgcgcaggtgtgcaaacgctttaattttcctcttatttagagtaatagcttttatgcagctgcgcttgcatatttgctgattctgttgctgttgatgcttgcagtgctacgaaggcaagccgatcttcgagttcgaccgtgctcggatgttccggtctggcctcgtcgggttcacgcttcacgggtccctttcacattactactaccatttctgcgaggtaaacatcgtggtcttccatgctctactgcctaaagctttgtgtcatgttcatatatggtgaatgatatgaagccaactgtttttcttggctcaggcactgtttccattcaaggattggtgggttgttcccgcaaaggttgtgttcgatcagacggcctggtctgcgatatggaacagtatctacttcgtggtcttggggttccttcgtttggaatcaccggccactatttccagtgagctcaaatccacgttttggcccatgcttactgtaagcactgatatttcctttgttataataatgccttaattgagttcccatattctatattcttcttttttttttaagaattgaaagtttatgaaaaagctgtagttgtgcagttgatttgttgtcttcagtgttcttgacagcaaaaccattgcctgtggtcatggtttttggtactatgatccttaatttgttgaagggattcgatgaattcattgctctgtatacaagtaaattttttaggttaatattaacattttgtcctccaattattcttgccacatctattttctcaaagttttaggtctagaagccactattattgaattaaactagtatacaattacaacaaagctatgagaagtcattcaaattttgaactttttaatgttcaaataattattcaattttcccttctaataattccatccataatctttctataatcactgaattatttcttaatttcaaaacggtttttacagtgttttactgctaacagagaccttatgctgggtttcaattattattataggccggctggaagttgtggccttttgcacacttggttacatatggcctagttcctgttgaacaaagacttctgtgggttgactgcgtggagttaatctgggttacaatactgtcaacgtaagcccaaacatgtcaatttcactttattactacggcagcctgattaaatcgcgaaagataaaaagagttcttcatttcttataacaagagttcttcatttcttgtttggcagttactccaacgagaaatctgaagcaaggaactccgaggacgcatccacatcaaatgcttccaatgtatggaacagtttaattaaaaattcattctgtcagacatgttatcgttcgttctaacacccaaaattcattgcctcttctacaggacaattcaatatagcgaacggtatagccagccaagctgccctttaccttcatcattttgggcttgtatatattgtacaatttgtagctgcagctctgcaggtgtaacctttttgcaaagataaattaaacatataagatgtgtagcaactgccaaaggcaatcagaacgaaattaccttgcactggatcaactgttgacgagattatgagctatgcaattttggtagctattcttttgatctttgaaaccccttttcagtgaaatcaaccgtcttgcattgaaccttatatgatcgacaacgcaagcaaggagcaaaacctatacaatattttggggtggttacaatttacacagtattctatagacgctagcaaacaaacagcttgctcatcatcagacagaacatcttaaaacaagttttcccttgatgcgaacaaaatgctgtctgtacattttttcgtttttgctggcatgctttctgtacaatctgatgctatgagtaatatacaactaatgctactatttcgaggaaaaaaaaaactactgcatggcatgggcaggtgtgctatgcccgtatttgtaatttacaaaattgcgatacttgtaagtttgaagcatgaaaacctaccagaattcatgaggccgttcacacgcatcgtttgcgagcacacaaaaaggagcatttccaaattacatgtatgaatccaaccaaaacttttctattgtgcgcaactatctatatcaattgttagctactgttgcacgcttaaatagttaagtatcactatactgcagcagcctctgtatctttgtgaccagcaatcagatctttaagcacagcctttgatgccaactttttcgccaccaacttgcagggacctgattttgttgcggagtatgtagtctctccagccttcacccgagcaatgaccgatgagactccatcaacatggtttttttcgtaggttattttgaatgatctacgatcacaaaattcttgcagccctttcaccgggtcaggctcgatggtttcgggggtggcaagaggttccaatagccgcttcatgcttctccaaacaacctccttgtcacacttgctgtcgagataaatggcaccagctattgattcaatcacatccccgagaacctgtttgtttgcaagtaaagcaatagatccagcttaagctattcgatggaaaatattacagaagtgcacaaaaataggttagtccaaacatataattctcctattccagtttacagtcagactaaagacattttgtggtcgtcatgctgtgatgcactatgcatcggaacctagttaagactatctttagttctttttataaattctctagcaactctttaatccaaactagaaataatggatctgatgcctggttaaattttgatgtcatcactatatggcatagactataatgtatccgaggtaatggtagacctaggaatactgagtaatgactaataagatttaaaataaaagacaaacaaattaactgatcaaattttaccataccagctaggtgcattttcttttgcagaaaaggagaaacaaactctgctatcagactttcagaatatatgcaatatagccacctacaccaattacaccgtagagaatacacacctttggtagaccaatgcccgcttcccagccataagatggacctgtaaatgactgcccaaattcctcaaggtagtagctcatcttcctatgcagttctgatgatgagtgaaggatatgcttgtttaatcctgatttaacagctgcatgcgcgtaacaattgttgttcacagaggcagatctaagatctgtcaacaattctggagtacagtcagggtatttgctgtagtaatattcagtgaaaagatgatccaaaatagcatctccaagaaactcgagcctctgcaagggacacaaacttgtcattcaactcaaaaaagatcccaaactaacaacagctacttgagaagtttgattcagataaaaaagaagctagacaaaaaggcaaaggcctcatcaaaaatcctaagccttcagagcttcaagccgatgcatgaggccatcaacggtcaccgcagtatgacgaaggttctccaaagcagcagcgcacccatggaggatgtgacgtgtaaacgccaccaccactcggcgtaagctgaagcaaggttttcacctggagatcagtatgggctaggtggaactacaccataacggcgcctccaaggaggggaacagtgcccaaaggtgacgctgtcattcaaccagccaatggctcgacaaggttttcaccagttgattctccatccagcccacacaaccaatccgcagcacaacggcagtcgccggatcaccacaccatccctctagcaaccatgcccatgccatagcccgacagctcaggcatgctcataggactaccctgtttccggccactccatcgacatctcctgatgatagccacaacttccaccctccaatcaaagctccccatgaccaaaactacagtctccagccatagaaggggaggagctccaagaagaggaagatgcttggccggcaaaaacggaagacacgccgtcaccactacccagctgcttcttgatcatcgcagatgcccagctttggtcgttgtcgtacctcgcacctccaccctgttgccaccatccatgcaccacaaggagctccaaaacgtccaagcggttgggaggagtcctctcgctgctcggatgctagcacgccccgtggctcggatccctacccctagcgaggacgcaccagatccagtcgctcaccacggcagggctgcggtcgccgttgatgccaacttgaatagccaggaacacagcctcaaccaccgcccacgcggcccacttttgcgactaggacgaccgccaaacgcccatgcagccgctccgccgactgcactcgagcaatcaccacagcgttccggcggatccaacccagaagccccgcatcctgcctaaccggtgccagccactgttgcagcctctcctagcgctgccggctttggctaccatccaaagccgtcccaccgctgccgtagcaaccaacgtcacgcttagatctagctgccatccatcgtccgtgcgagagcccaaggaaaggaggcccgccgccacacggtttccggcagccagctccagcggcggcaaggggtgggaaggaaggaggtggggtagggccggcggctggaagcgccgcccgagtcgctgaaggagcgaggctagtccttcagttttcaggtttcagataattctacagcaagttaaactcaaaaggaaatgaaacatatagaggattgctaacatagaaaaaaaatgttgttgcaatactgtttaatcatttgcactttgttgagtaaagatcaaaaggcataataaagccgtgacacatactaaatagagatgatagatgcttttatatcaacctgatagcatgaagtagggccagaagtctgatatgagccatgtgtcaatgcttcgagcaataataaagaatcattgaacttgtaaccaagcattccctctaagctcctcacattaatgaactcttcagctttcattgaaattttcctttcaactggaatttcagtgtgaaattctatattcatccctaatgatttcatcaaaagaaatgctgccttttccccagcagtactgaggtaagccccaattaaggcctcaactgaatccgcaatcctcttacttttaatagacattttcctttggctgtacataccattgggtgccagaaaggaaatttttttgttatcacgctcatcatagtccaagcaagggatgatccaatctcttggattaaactcctcagcatgaatgtaaccctgccaaccaaacataaagggcaagagtatcatctagtaccagtgataaaagacagataagtcttctttgaaacatgaaaaggtgaatagaaatattttctggtacttgaaaaataacacaattcattttgtgatgaacaaatttgtatgcaaagcattattttatttcatgacatagccctagccacatagcaccagaaacaaaaattagacctttaaaattgattggctgaaaggattacaagtcggttgagcggattaaagaaagctatttactatctcactgcacacgccgaagatagaatccgtttcaaggataggcagatgctaccattcttcccgccattcttgcttgccaggcaaagtaccgctgcttcaacggtcatgaaagcagaccacgtcaagccaacctcagatctgactacaggtgccatgtgacctgagggctaggtgttggcccaacaaggagtaatatggtctgagccacagccttgtattaacttagggtcagcaccacaaggttttggtcacctacaatagtctatattggcaacttggcaaacaattcaatgcaacaatagagttcccattttcctaaaaaggaaatatgtggaacattgcctaattgtgatatagcagttgcacaaaagaattgaaataggctgacatggtatgaaagatactgggagatgtaggactattaatattgcataaaattagcaaggatgtgcatgtaatcagttctgtagtgtgtaggtgtgtgtttctaaggtccttttacccttctttaacgcaatgatatgcagctgtcctgcgtgttcgataaaaaaaatttctacatgcctagctcaataagaaaaatacagttagcaacaggatctagagtaccacaagattactgctgcaggccagctggcacagagctgcattggagatcaagtttttcttcatttttgttaatatgccttcatgttgaagcctgtattcactaaaaaggtgccgagttgtaacatatttgaggaaagaatccccaagtgtttctaatgattcctgtgaaaattcttcttggcatttctttgttgttaatgcttccaggatctgcaactcatgaaaaaaatgcagagaaatacacatgtaagaaatatgcataggggaagtaatttattcaggtaacaggtaagaaaattcagattgacatgtacattgttaacagtggggcatccaaaatattaattagaaccataaaatactccacggattcaaatattcttatatcttatttttacaatataggaccatcaatccatacatggttctatagagtacaacacaccatcaagcacctccattggagtgttaatgaataatgcagacagctttttgtatgtgcttatatagttacattacgcattaattgaaggtatttatatgcataagaagttattaagtaccactgcctcatcaattgctacaaaaataaccaacttctacatggcaacaaaaggaattatttctttgctaagtgtccccgaaatatcttgcattatacatgacttaagacctgtcatgtttgcaagtagaaggaaccaaaacttatgtttgcctcattaatagatagtcacttcgaagtgctggacatattcttactaaggcactgttgctgcattaaacaactaaaaaaatcagaacctttagttttcactgtcaaatgtcatcactcttcctacaacacctactggtgtgcccaagaatgcacttatatccatttttattttaaattcttcaaaaaataagggaaatatgagttttcttatatgacgacatctagttgatctaggtacttcaataattcataaataggaaactattgatgagaaaatcaaccttcaaaaccggtacgtcaaactgctgcactgttgggcctaattggacctttaatttcacagaaagaagcatgcactggatgcggaacattatggaaggaacatatgagaagatgtgcaaattattggcggacactggtgacatgataattctgcagagttcaggtggcaactcaacactatatctatcaccaggttctgaaacaaggaaaaaagatgaccaaatcagtgatttatgcatatgtagctctgtaaagatagtacaggcagtacattagttggaccattgtctaagagttcagctataacccactgtaacatgcctcattgatagcgatgcaaaatacacatgtatgatcaagcccagcaatatgtgtgggatttaactgtccgattgaacatgaactcagggtatgtcaaatgtaatcttccaagtcccaaatacctcactgcctaattttatagaagctaagctacaagcaacccatcattctgtgctaatatactacaattttgatagtaatatgaaaagtacatttactgctcctgaaaacgaatatagtgtctggccaaataaagaaggattaaggaaaagatgatagagaagcaaaatatatttaaaaaaggcatagtactccaaaaggttattaaactagaaaaaggaaaatttaatagtagcaaaaaatatgtctacaattaaaacaatctgcagtgccaatatttatatcaaaagagcttattggtatgatgtacactctcatagtaagtactcacagtagaatgaaatctaaatttcataaaagtagcgctaaaacatataccatattcagctgaggatattaaatttggaaaactttacattcaaatattggaaaattttaaattcaatgtcaagcaagagtttacattttgggctacatatttaagaattcaattagatgtacagaaagttcagaagggtctgtaactcgtagaaactaaaacacctaaaaattttgtcatcaacaaatattaaaattcattatctaatcatgtttataaatgttctgcataatttccaacttagtaacttcgagggttttattacagataattgagtcaacacatgtagtcaaaacggaggatagctggagaaaacattatgtaatattactgcaaccagagaaaaaaaaaacctttttcttttttagagtagcagttgtggaggaagttccgcactttcacatgtttactg

SEQ ID NO: 66530 - DNA, 2318 bp, Oryza sativa
taagataaaatatattacgtcttgattttatccgaatagttcggatcaggtcatcaacgaaaaaacaaatggtttttcggtcgtacacataaattaaaccagaactattttagtacaaaatatgttacgacctccggattttatctagtctcttcggaccgggtcgataatgaaaaaacacgtggttttttttgatacacacataaattaaaccacaactattattttaggacaaaaaaatatgttacatccggatttgatctgctctgttcggactgtgtcgacaacaaaaaagcatgcgggttttttggtagtacacacataaattaaaccaaaactattattttaggataaaatatgttacgactgaactgaatttcatccggtccgttcggacctaatcgacaatgaaaaagcacgtagtttttttttgttgtacacacataagttaaaccaccagaagtactatttttgtacaaaatatgttacggctggatttcatcttatctgtccagaccgggtagataaaaaacacgtggttttccgatggtgcaaacataaattgaagaactattattttagaataaaatatgttatgttttcatacagacggtccggatcgggtcgacaacaaaaacacatgttatctctagtttttcctttttcagtccgtacgtgaatacgtgatcctaatttcccattccaagttcgttttcgttttcctatttttctactttccgatcgacgcaggttctgttttacgtaccgagattcacctttcttcaccgtgatttatttactaatttttcataataccccttcttgatcaattctactaccgttaagtgagaagatagtaaaaataaatctaaaccctttaattaaatgagattaatagttcaaattgcttgatactacgagtacggaccatcggagtgagactcttgttcgagacatcagagccatgcacaaatgatcgacaagaaggcctcgttccctagatagcagatagcatgtacaactacgaacaaggccgtcataggcgatgcaaaagccttaccgaaggttggtatgggaaccatgtcttctcttgtgtgaatgatattctggataaatccaagccgacattcaccttttccctcatgcctcatattcccaaaactctttgatatcctctccgcatctttcttcttgttttgtgacttacctcattaatgttgctatgtctttatacagtgatctgttttttatatatggagtgaattgttgcatgctcaaagacgtgatataaaaagagttggagaagaaaactacaaggaggttttttaccgtaattgaggttgagggcatgcaataccatatcctagctgtcgatctgggaggatccaacgactgaaattggttggtacctcatggtaccgtgtctctatgaggggcggtaccaattgtgataaggtggtgaaagggtagaattgtacattcgcattaacctttctcccgatccgcctccctccatgtttgatgaaatcaaaacaacgaacacacaaaaaatagggaaaccctatattttattaatcacgattcattaacatgaatattaacaaatacatgagggctcctacaggagtttgcgttttgcctttgcgagaatgcttaatagaaagatatgatgactagagattgcgtgcagtccgctgaaacccagcgcgtagcattgaggctgtcggttaatcatccataggatgagcctatggaacacctctgattaagctgcgcttttggtcatcatcttcaaaattatttgctcaccgagggttttgaggtttgtgtagatttaatgataactgtgatatgggtggctttgcttcgccgaaacctggtcacaatatattatcaccacatccatacgtggatcaggtatcataataaagcggatgacttttgcctcgtcggtgcccagtcatatataccggcctttattccagcttgccaatggctttgcccaccgcctcctctgttcccgctcgcagtgtgatgacgccggctgccacctccgctcgtagtcgagcgtggacgtcgacgaccgtcgtttcctcctctcccgtttgagtgcgacactagcaactgccatctcctccgccccttcttaatcttcctccccctccccctagcgcctgcactctgcccatcccctcagccagatccagccaccggcggggttggggcgctagttttggcgggggcgaccggccggccgcgggaggcctttcttggctcgatcgggggcttggcgacctctggtgcggtggtctggtgtg

SEQ ID NO: 66531 - DNA, 10328 bp, Oryza sativa
cccgtaaccctgacaacatacatgaaatattaaatatatgctaaaataataactaattgcacagattgcgactaatttgcgagatgaatctttttatcctaattactacattatttgacaatgtggtgctacagtaaacatttgctaataacggatttattaggcttaataaattcgtctcacaccctatataatactcaatgtgacacgccaaaactttacacccctggatctaaacaccccctcaaatttgaacaatgtaagagtagtactccttcccaaaatataagaatttagaactggatcggacattttctaatactacgaatttggacagcacgtcccatccagttctaggtttttatattttgggacggagggagtacatggcatgaagcatgatgcgtgtgaaatggaagaaaaaggatttggtagcaattgctttcagaaagaattgttgcacagagttgatcttgcacatggtaagtcaatctttgcacggacgttgcttctatggaagaaccttgtgtgtacttcttacttggagaaaacaacttcttcaaaccaatcctgacttgtacgtagttcttcaaaccttacaacgtgcaggtccattcgattagggatgagctaagaggttaggcatatgatgtgaaaaaaaatcggatgtacacattgcgcgcgcagtagaaggaggggatggaaaaaagacgattgcacttttacaacagtagagactagagaaaatacgaagtatcacttaaacactttcaagacatgtgaaatcattctattgtcctcttctagcttcaattcatgttttcaaaaaaacttttagtcaggtcgccttgtccaattgttttcggtacaagaaatgacgacatatttatgtgcaaaccacatatacaattcagacgaacacagggatgattcatcttttgttctcttccccaacgacttcacatgaatcatatgcctttgtaccagctatatatgacttgctttttatattgagaataagcattattctcatatctccttttccttttctttttcaggtttgtcctcgtacaattgtaatgtccaaaggactggaaaagtgcagtaacagaaaggtgcttcacaaactgaaaagttgaaagccatgtcactgcactacgtctgacaaaagaacaacagctataggtatttggcatttttattggctactctataaaaaaagcacattaatatttgtgtcaaagaatttaatttctacacaagatttataggcagagggcatgtagctccacataatggagctcagatgatcaaatacataattacatagtccttactacatggagtctaaagaaatatatatatatccaagtagtgcagcatcatgcacggccactacttattagaaataaaatgaagtgaataaagatatgcttctgatgatgccaccggcgtgaaccgagcaatctttcatgcagattttcgcctccacctactcccacgcacgcacgcaatgagcaatagttggttgctgacttgatccgagctttgacaaattcagtttggaactttggatgaatctgcaattctgacgacaaaagggaagggaaggacaaaaaggttttactttaatcttctttcactcaatgtctaaagtgattttcagagacatacaatgggctttatatctttcttttactcaacatctaaaatgatattcagagacaacacaatgggcgaagacctgtatttatctctgctctgaaagactgaaacagtctctgctccagctacgaagactgtatacttgctggtcatacagatccaggatgtgtattatttgcaaattcatcagaaagcatgactcaaccatcacacacactcacacgtaccatctgtcatctctttcgatgatatcattcaacagggtgacaaactgaaaacaaagaattgcaagaaagattggaatgaacacaacaggatgacccaggtatgatgatgattacagaaaactttcaggaagataagcgagccaaacatagaaattgggagataaaacattgttgcatgattcacaggttctcaaaatgattaacggcatacaaacaacacgaagatctagagcttcaaatactacttcattgtagaatggaaaaaagaacagtactcgccctggacctgagttgaggatagaaattgttacaatcgaggatagaacagtactcgccctgcacctaaattgttacatgcttgtcggaggatgcctggtacatgcatctacgattttgacgagaagaaatgatatttagacatagtactatatcatcgtaattgatgtccttgttgcctgctccagttcttcaaactcagcgcctagcgcttcgcttcctgctcttctttcggctgcccttgtcatcagaatcactgtcagatgcagatgcagattcggagtcagattcagacgatgctgatgatgaggtttcccttctgtgcctcctcttctgctgcttccttttgggtcgccgcttcttgtcctccgagtctgaggagctgtagcttgagctacttccagaagaatattcagagccggtaactgatgattcactgtcagagtcaaatacagaagcctcactactatctgaatcactccgtgaacggtattttctcttgcttttccgtttgcttttctcagacttctccttcttcaactttgctttcatcagcttcctttcctcttccttttccttctcaagatcaggattctggaactgataggaaacaggagcagccgtcttcttcagcttggggttcttgagctgctgtgtcctcgagggccgcgaaatgtagacccgttcgttcttgcactcgtatgtccagtgcccaggctgaaaacacttctggcactgggtatatgcgccaccagaagaagaagaagtttgcgcagcttttggtttcactcccagtatcacagccttctctgtactcatcagatacatctgtctcttggcctccttcctctcctgccagcgcgaaggtccctcttctttctgcccataagcattgacattgcgggcagcggctgcagcagctcgctcggcttgagttctgctcaatcccttggcagcagataaggcctgtgcttttattctctcagctgcagcctgagacttatcgtcatttccagacatcttgggctcacccaacaagaatcaaatcatacaaaatcagcaatattatgatcctgtaaggaaaccaaaatacatcaatagagtaatttgggtaatgaaaaataacgcaaacaataaataagctttctgctataccaaaatcaacacattgatgcaggaaaaaaaatctggcacataatatttttcgttgctataagaacaacatctacttatcaatttgtcatacgctcggtctgtgcctctgtggtcaatcattgctacgcccaaaaataaaaaaatggacaaacccttagagctaagagattctacagtaaaccgtggtaagaaagaaattgcgagctacaacccaaaagcaagcaaataaatccaacgaatacacctccccaggccgggcggatcttaacgtgggggcatggggattcactcgaacccccccccccccccaaaactttattccgtaacaaactgctgctattagtgctagggttagggcaaattaagagaaaagcttccagatctaggagaagagaagctagggtttaggcgaagacagatggtgcgggggtaggaaggtgcgtgtgggttggtgctcaccggcggcgaggatgcttgcggcggaaggaggcagcaggtccgcctcggctgctcgccgagttcgatggagatcggcgcaggcgaggcggcgggcgaactcacgaggaaaagagagagagagagagagagagaggagcgggtcagaatcgggagaggtgaacgggtcgggatgtgggggcgagcgatgatacgtgggccgttaatgggccgatcactatgtcggtcagtgatgggctgatctttatgtgggccggtgatgggcccatgaagtaaataatgatttgtactgatcctaacagggtaaatttacggtgatattagacaaccatgcaaagttttattgtgagatataaaacgaagaaaattagaaaaaagaaaaaacagaaacaatgtttttattttaagattctttaattttattatgcataaacggagttgaggttgtttatttacatcctacctacatgctctgtgtgattctttcagaacttctatataaaaaaatttccacaagttcctgatttttgaacatgcgtgcaaattagagtataataaaattattatttcttgatatcatatgatatagaagtaccccgcaaaaaaaaatgatatagaagtatatttatttgagatccattgccataaatggtcccaatacggaacccatttctgtttctcagaagcatgagcccctgacacaacctagcagaaaacacatacaaccatctcagttttgtcaagattttggaggtctattacctgcagcgagactgaattctacccgggaaactactttttttttattttatgaaacacgcgaaactactataaccataaaactgacagcttttcaaaggccatgttacagtttctccacactgaaaaaaacagtaaagttacaccaacttcaaattgcaacctgaactatgaatattgctgccaaatggagtaatatatacagcaaaggaaagtaggagcatgaatggaaaaggaaaaaaaatgtggcaaaggttccaaaaaaaaaaacatcctgactacacaacacacaacccattatgatcatgactgaatgtatctgatatctgtgaattctaactgtcgaatgcacaataacaccttgcacagccaaagtaattcccaaggtaatgaaatccagactgaaactcttatttgatggtatatatcatctctaaagccgctaaacctgtaaagccaaatagcttggcaactcctcaaagtgcttccctagcacccattggtcagcgagtcctgcggctgttggctggtttagatggagaagacggtttgttcttagcgaaatcgacaagatccttgaaaagagaatcttcaggtttggtctgccgtgatgcggtcggaactgatgaacctctctcattctcggtattcctctgattaagcgaaaggccttctgtttggctcaccagtccattgtacccggcaccgttgttaccactaggaaggccgtgctgttgctcgaagtactgctgtctttggccataccttgctggaggtggcggtaaggaacctggagcttgcgcttcccatggagcttttggaagatcttcaccggagtctccatacttgttagcatttgaagacgaagaaaaaccagggatagctgttgggtttataaaatcatcatcaggtagactctcctgcctattgacagcaggacgatttgactcgctcataggacgagaaggcatagagaagctgggtgctgcagttgggtttatgaagtcatcagacacactttctgaccggctatcataacttggcggcggattcgtttctgtttttgaatgagacggcgcaggtatattggctggggcagttggattaataaagtcatctgatactttttctgtcttgtaggagtcgccactaagatagtcaacactgcttgcctccgtgaaaactggcctctttgatgatggtggcggaggaagaagtgggcttgggtaaggcctttcactttttggagcagaaggtagattgccctgtgctgctgtgccatcccttgcagacctacagaacatatatttgtacatcagatgacaaaactaaacagaccgtgaatcttggtatcataacatgatccgcatcaccaaaacattttcttaagagcagtcagctgatgttgccacaaccatccaaagcttagaatagcaatagcatgtatgagaaataattagtaaagggtactaatagggaaaactaatatagcttgcctgcgggaaagaacagagaactcgtcttctggctcatcgtcttcatggtgcacattaagaagtggggaaaatgaaaccccagtaggcctaggaggggctgttcctcggtttacattagcagcagcaggagctgggcctgaaccgggaggcactccctttgcgatgtcatcatgacgctgaagaacacgctgcagttcatcatttaaaccgagagcttgaaatagaaggctctcatcactgcagaggatacaagacaatatgtcacatgacaatgtgaaaaggacatggaaccaaaatttcagagtaaaagaatagaacatacccagtattgctaacaaggtccatgactcgaccttgataagatcggcactgcccaacaaggtcaacaatgacctcctccctcacaccctacaacatgaagcgcaattagacagaaatttagagaaaaagagcataggtgggtggaatggtggattcaatagttaaatacagagacgcatagagacatcacactagtgcaagtttggtcataataaattaaaatattagggcacattatttttagccagataccagagcaagttctagaaaatacaaaagcttagaaatccctctttaattattcttatgccctcagtctcctatgctgctaaacatgattccctctgaacaaatggaccaagtaaaatagttcgcacattcctgtaagctgatgaggtaacatggatgaacaaagatataaatggatattggataatatactagacttcaaagcctagcaagaaactactttgtcatccattacacatagatctgatcaatgatgggacatgtaatagttacatcctcttctgtgcacaattcacagatacagctcagctcactacatgtgaaatatgctgtagtatgatcatatgaaataaaacacatgatttatgcataatttttttcatgggaaaaacaaaggtctagaagacatgacaatcatattaaagctcttaaaagtaaaagaaactacagaagagatacaaggattatacaacactgcactaaattttgatgcttaaaaaagtcacctcagggtgcctgtggtccaaagcatttaacatctcatccaacacatccacaattcctcgagcactctgaatctcacttagactgtaatgcacaaggagcaagaattaaaggtggattataactaaagaatttcttctgcaaagatggtgaaataaattgataaacacaattgaagtattcaggtattgtttagcatgattatgaaactaaactgtcacaaggcaataagtagaatctattttggcacactgacaccgccatattttgttgttagaaataccactataagtatgaaattcttggaaagttgcatggccctagttctatgaatgtcttgcctgtaaggctgtaacagggagacaaacaaaattactattaatgtaatgcatcataattactttctagtatgctttagagttcaggaatgaggacaaccaaggatagcggcaactgcaaccatcagtagcggaggttccaactttagatcagagatggcgtacttcaagaaagcaattaatcactgaccacttttttcccccaaaatacttgacactccatagttgctaacaggtatttttccaatatcacacctggtgggcccaaccggaggttcagcttttttttttttttttttgcccctcaaaactactaatgtgttctcagtgactaggaaaaaacaagaaagatctggagcctgatagcctatatgcaccgtgaaccttctttccgtactctccagttgtgctgagcggcaagtcctcagggttggagccttggaggcacacaaatcgtccagaagcaacttggacactgctttctgctgtctgatgcacaatttcagcagaatagagatactttaatccaggagcattttcgaaatttaactaggaaacattttatagccttgggaagtttgcttggctaatgggtgtcatctatagaggaacagagggagcagaacatattgtgagtacgattccactcctaaaacatgcctagccatttaatgtggttgtaggctgatcagtatttctgataggaacatgtgtttgaaacttttcccccacaagtgtgaatttacaaaccaggccatgcttgttccaaccaaagtaggttattctaaagagaatgggaaaaatagaacaaagcaaggcataaagaaacagcaaaagtaaatggcattaagaaactatggatgaatatgacagtactgcttgaagtgaacaagtaaataaggaacaaattttgcattagaacaaaagaacacctcaaggcaggtgcagaaggggcgctagattgaagagaagcttgtatcgctgcatcttcatagctttgacctggaggtggatatagatgtggttgcctcaatggttgagtttgaggaggtgtaaacagtggaaccgtgttctcctcacgaggtggaaaatcaacaccagcattctgcacacaagggcaggatatcttgttcatggtttggacagaaacagaagcaattgaatattaactcaaaagtaaaaacgttgaagatctaagtttacattgaaacaaagtgcagaacagattgaagttgagtggaacagtagtcaagtatgagctgtgatagcacaggataaataacagatgagaaaactggaatgaacacaagtagacagtaccctgagttcttggtaagcagcgtgatactggggatatctgccagatgcacctccaaaagccacttgccatgtgtcaatcaaactcaatattttctcccgaacatttaaatctggctgaaatcataaattggcaatcaaatacagaagcataagaatgtaggaactataggaataagtcttggctggttggtcttggtcttgtggtgccttttcctgcttttcagctttctaggacagcatctctactttcagtttggatgctctaggacagttaggacagcagtttgttgagatgctctaggacaatatgttgagatgctctaggacagtttgttgggatgctctaggacagtatgttgagatgctctaggacagtttgttgggatgctctaggacagcaccctcttagactagcatggctgcatggctgctacaagcagctataaatatgtatccaatcctctttgggaggatatggcttttgagtttgtgaatgaagaaaaccagaaaattgccccactccgagtgccatcctcttctcaatgagagtagccattgaagttctaacatctggtatcagagccacactttcctgtaggctaaacatctcttgttccaccccttcccaagctcggttgagctctcagccaccaccagcagcagcaacaccggctgctcctccttcccctttcccttccccctctccacgcagcagccccccggaggtgcgccatgtccgacgttcggtctcggcgttcggtcgtctcgagcactcggcgtcagcaggacgccgagctcgccgcagcagaagagcgcaggcgagcaacggctcagaccgctgcagcagcagcgagggcggccagactggcggcagcagagttggcagcagccagggcggaggcagaagcagaggcggcggaagatgcggcacgtgcggcggaggtagaggttgagaccttgcgcagcagcatcaacggctccatcgccggcgacatcaccgccgacagggagcttgaggagcttgcaagaggtagggcacgggagcgggcagagcggtgggcagcagcccacctccacggcggcggcggcggcccaagggaccgcgcgcccgccgacgggaacccagacgggcgcgggcgtgccggcggcagcccggagcccgcgcgcggccctcgcaggcagcgtggctctccctcccctgaccggcaccatggccaccacggcgtccagacggtggtcagggactttggtcccggcggtgggtggcctaccctcaccaaaaccaactacatcgagtgggccgcggtgatgagggtgaggctccaggtgcggcacatgtgggaggcagtccggtacggcgacgtcgactacgacgaggatcggcgggcactggatgccctcatcgctgcagtcccgcccgagatgcagttctcgctttcccagaagcggactgccaaggaggcctgggacgccatcgctgcggcacgcatcggcacgatcgcgcccacaagtcaacactgcaggcactccgcaaggagtgggagaacctggccttcaagcca

SEQ ID NO: 66532 - DNA, 3355 bp, Oryza sativa
ctacataatggatttggacttgtcttgttgtttagtcctctcgtagtgttctttagtcctggggaggttcataagtaccggggaggttctgccaatttttttattaaattttgacaacttttaacatatcgcattagttggcctgtttggtagagctctaactcctaaatttaacttcagaagttgggtctagagtggagttgaggtgctgcctaaaaccagctccacctctttagtttattttgtgagagagctccacacagttccgctctcattctaggtggagctgagctccagctctaggagaggtggagctagagctggacctgtgccaaacagaccatgtaagcgttaattaattaatgatctttgttacctacaaatacaccgataatcttattcatatgcaatactagtattaaattcctatgcagcacaggctccgtagcagtcggcccattagtcctatactcctattcgccaatccaccacttctcacaggtaaagcaccttttcttcctctcacattcgtcttcctcgatgcaccctctccttttcatttttacgcaatctttccttccgccatctcctttccattcactggcggccggctacaatcaatctccggcgagctcccactgcaggttctcctttcgcccccgtataaacctcccacttgatgcagcactccaacacactgtatgacccattttcatttctcttcatctggacctcccaaaagctcgactgcagccgcttggaaattgtgaccatggcgagaccgacagcggaccacaacaacgaaggaattttgaggtggcgcgacatggagagataagatgggggagcactggaagaaagcgtcgggacttggggagaaatatgcgggcttacggcggcaatgctttacccattctaatcttaccccttgcaaatggatggatgtgagtggtacctcgtggtacctggcacctcataataaaaactctcatttttttactctactttgctctatgttcaagtcagtgatctaagcataacgctgtaattaactatcctatataaaaactagatatatgttgattaattttgtttcactacccttgaaatcccatctccgtcctgtattcaatatttcgtatatatttaagttatgacatgaagtgaaattaagatcctaaagctctaacctcagtgtttcacgtcatcgtcagttctcagccgttggatcagtgacttgtatcgtttctcagccgttggatgaggaaaatgcatcactgtcagattgaagacagcccaaccatcatctcacacacagatagcacatgaggcccatgtaataacttggaccacgtgaggcccatgtaataacttggaccatgtgaggcccatctgtgtcgatctaggcccaatcaacagtgaaggagttagggtttgtttttttttttttttggctcagtgggggtttcctcatggagttagagtggtggcggtggcggcgcttctttccatcaacggtgctcgggaccgtagcgttagcttctcctattctaaaacatctttcgcttcaacttccctgttcgactcttcatctccttagcaacgaaactgacagccacctccttcgctaataaaagcatgcaccaccaacgattattcttagcgatgcaagcagagctgcgtagccaagcgcctgcttgcctagatcaactattgagctcaggtagtcaggtaattaatcagtttaagcatgtcaggttaatttctttagctccctctcactctctcaacattttcttttaatttcatggatcccaatttttccttttttatttcttcttattaatcacacaaccaattcaaattcgacaaatttaatgttgttaagtagttcttgttttcactgaaatctctgaagttgttggaagaaatcagtggaccgaccaagattattactgtccgcatcacatctgatagatagtttcagcaaattctcggtaaaatgctttagcagtgcagcatgagtggtaagaagaaccacatctttttcgaatcatgatatttatgtgtttctatatattgttatggtcttagagctgttggttgctccaagtataatttttatatgctccacaaattattgccttcattgacaatgttttaatatacagcttattactctgagggatgagtggtggtatgatatgctgtatattttatctgtgcagggcactttttttctctgaatggaccataatatctgttgagatattgcattcttactcacctgttcataagataaattattgcatggaaccatggactgaatcatatatcgtgtgctctatgcagtatggacatttgctaaaatcctactcaatttatggtgtaatgtatatgtagctcctgtaagttcttcctagatgaattctgaatattaatgtttgcttcaaatgtaatatagcgttgacagtcactccattcttaccttaagttataaatatctcaggctcttactttctctgttctgctaatacaacttcgaactagttatctatataaactaatttgttgtaatagccacagcttccatattcttaatttacctacctgctcttttatagaaaaacaattgggaaagcccctcttgtatattaattgtataaagtttattttaatttctctaccccttatggtttacatcttttgctaaccaaataggaatatatattaatgtacttcaactggctattttttttattattggaatagacatttctcattgatgtttatattattttatatatattacaattttatgactgaattgtatacccaaacatcccgcatcaacgcgtgaggtgtcaactagttatacatatgtcagggatctctacagtttactctgcggctcttcctttagtctcagatccgctgctcccgacatgagctgcgacccgctacatcgcaccactcgtacggtttccaccggcatccaccacacaccacaatatggtttgctgaccgaaagctgcaaacaatgtactcccatcagccagctttgtgcgcatgatgcctcaccatggccggcactcacaccgggtaaggatggtgctcagagtcagagatacttggcaactcacactctcgagtaaccacggcagctgccacagcgagacacattagaatgtcagcactactagtcactatggatgtaatgaaaaccttcgaattatttttcttgttcggtccacttcttttctgatgcttcctactcccatcacatcacaatgcaagacaacttgaagaaactagattctcttatatatctacctctcccattgtcttgttgatt

SEQ ID NO: 66533 - DNA, 2683 bp, Oryza sativa
atctaatggcacgcttagaggtcaataatagggctttattctcgccgtttgctgagttgtcccgtttcgcgtgtagtttcggagcccgaagaccagcagtgcgaggatttcgaggatcaagctcaagatctcgagcgaggcaagccacctttgaacatcttgagcctatatttgaacttaattatgttgcttgaaaaatattatgcattgataggatcgcacttagtctgcttgtcccgtctgcaaggcagattggcagacctacctaacttgttgcatttgacccttccattgtaattgttataccatgttcccttgtacccacctagttgcgcctcggtaatcgtgcactctgcactggtatcgacggtcgccctcaaacttaaaatctgagaaacatcttgggtaaaacttgggttttacaaaagacttggaaaacccgacacctgggtcggtgcttgcgaactaaatgaatttccaaaaccgcggaccggggaacgtaccgggtgtacagtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtagccgttctgcacgggctggatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttgtgaaatttgctgttgtggaatgggtttgatgtttgaaaaatctgcggctgatgggatcagccaggcccgggtggccgtttgaaagctgttggccgggtgccaatcttgatcaattcaaaagactgatacattgcacatactccgaccggacgagacgcactgtctcatccgtgttgtttgagaagcactcccttagttgtttcagaaaagagtttaaataaaatcaatcgaaaaaaaaatagcagcctttccttgaagcctgcattaaacacttatttcccatggcttgctgagtactcctgtactcacccttgctctatataaataatcccccctagttgctgaagaagatgaagcggatcccgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttcctgtgatactagcactgtttcctgggactggtatcgattaacaggttaatttggagcgtcacgggctagttccggtcgggactagttcggggcgtgacaattaacatatgtatatggcaatagtggttatatcatactttaagagaaaatcacattaacaggatatttatgagaaacttagaatgcttaagtaaatagctacacatactgatggatctgttcaactaacaaccatagtttaaaggtattcggcatatgttgcaaggcatctgtataaagcttaccaatagaactctaattggaaaaataaaccaacgggtaacagatccagagaaacatcaccccagaccgaaggaaaattactataagagcagaaagcatgctcatagcacaccaattatattgctcacagaacagaattcatgtgaatgctatcattatgttgcttgtaatacaatggtggatagtaaaatcatcaataatttagtttaccaaagatctattaaggaccgcaagaggtggacacaaaaaaagcttacgatactttggctgaaccctttctaatcctgtaatttaaggtgtacctgacattaaaaatgcagcaactttcagtcatataaatggtgaaaataattaagctgtagttccactcttaattactgaaatactaaaattatatgttaaaatacttcagttgcttcaattagtagctgtggtatgagacaatacacattaatagtggccggctctcttgtaagcattctatcgtcatagtatacaagcttattacattttctcatactattatagtagtgtgagatgcagttatgcttggagctagctaccatcaatttaacgacaaaggtcccaagtatgtaaatcctcttctagtagaacatatgctgtggccattgcttcccatgtggccatccttagctgcatcgagccctctaacaattgtagacaaacctaagtttaggaaaaagaaattcgctaaaacaattctctgcataccatgaaaatatgattggcttcagatgtagcaaatctgccatcataattttctagagatgatattagcccatatctacatatctgaaagagctaaagaacaaaaatatggccggagcaaagaacagctcaggaagag

SEQ ID NO: 66534 - DNA, 10330 bp, Oryza sativa
agtctttgctggacctctccacgatgtcgatcgaggaggcgttaggtcgcctaaaggtcgtcgacggcgatgagccacagcctctctcggggcctatcaccattggcgggaagctccatctcactcgggagcagtgggaggccagccagagtaacgggaggaagggggagtcccctccctcgacaggcggccgcaagccgcgcaaggcgcgcggaggcgtccagctgcggtgggcgcgaagacgcgccgagggtggcgctcgcagaggtgcccagggcgacgccgctggcaaccacaagccggcacgagacgacgcctgccgcaactgtggcaagcttggccattgggccaaagactgtcgacagccacgacgcggccaggcccacgtcgcacaggtggaggaaaagccggctctgctcctagcacacgccagcatcgagctatcttcagcggcaccggccgcaacggctttcctccacctcgaggagccgaaggtacacgccttcctcggcaacagctccagcaacgacaaggctgatgggtggtacctcgacaccggcgccacccatcatatgactggccggcgggagttcttcaccgagcttgactccagcgtccgaggctccgtcaagtttggggatgcctccggcgtggagatcaagggcgtcggctccgtcaccttcaccaccaagtccggtgagcacaggctgctcaccggagtctactacatccccgcgttgagaaactctatcatcagcgtgggacagctggatgagaacggctcaagcgtgttggtcgagcacggagtcatgaggatttgggatcgccgccgtcgccttcttgccaaggtaaccagaggcactaatcgactctacatcctcagcgcgcaggtcgcacaaccagtttgcctcgccgctcgtcgagacggcgaggcgtggcagtggcacgagcgtttcgggcaccttcactttgaggccctgaagcggctcagcgccaaggagatggtgcgaggcctgccgtgccttgaccacgtggagcagctctgcgacgtctgcgtcctaacgaagcagaggcggctcccctttccccagcagacgagtttccgagccaaggagcggctcgagctcatgcacggggacttgtgtggcccagtgacaccggccacaccaggaggacgacgttacttcctgctgctcgtcgacgacctctcccgctacatgtgggtgatggtcctcggcagcaagggagaggctgcggacaccatccggcgcgcgcaggctgctgcagaggcggagtgcggccgcaagctacgcgtactgcgcaccgacaacggcggcgaattcacggcggctgaattcgcgtcgtactgcgctgatgagggcattcagcgccactacaccgcgccgtacagcccgcagcagaacggcgtcgtcgagcggcgcaaccagacggttgtggggatggctcgggctctcctcaagcagagggggatgccggccatcttctggggagaggcggtggtgacggccgtctacatcctcaaccgctcgcctaccaaggccctcgatggcaggacaccgtacgaggcttggcatgggcgcaagccaggggtctcccacctgcgggtcttcggctgcctcgcgttcgtcaaggagcttggccccatcagcaagctcgatgacaggagcaccccaggggtgttcatcggctacgcggagggctcgaaggcctatcgcatcctcgacccggagacacagcgtgtgcgcacagcgcacgacgtagtgttcgactaagggcgagggtgggtatgggacaagacggtggacgatggttcgactctgacgtacgacgacttcaccgtcgagtatgtccacttcgagagagctgggggagtaggcagctcttcttcaccaagcgtgtctaccccagtccccgagcctccatcgactccgacaccaacacaccctcgggccacggcttcgactgcgacgagctcttcgccgacaccaccacagccggcaaccccacgcgccccagcaccaacagccactcctccgagcacgtctactccgacgccagctcgtgttgagcgcagcccggtggagttcgctactccgctctcccacgacggggagcgcatcgacgcgtaccacgacggcgagcagctacggtaccgtacgatggaggatcttctcggtgaccagcccgtgccaggaatggtgcctcgcgacctggaggcgcagttgcaccttgcgtgcgacgacggtgagcctcggtctttcgcagaggccgagaaacacgcggcatggcgtgccgcgatgcagtcggagatggacgcggttcaggagaaccgcacctgggagcttgttgatctccctcgtggtcaccgcgcgatcacccttaagtgggtgttcaagttgaagagggataaagccggagccatcgtcaagcacaaggctcgcttggtggcacgcggtttcgtgcagcaggaggggatcgactacgacgatgccttcgctcccgtggcacggatggagtccgtgcgactccttgcgctggctgctcaggaaggctggggcgtccatcacatggacgtcaagtcggcgtttctgaacggcgacttgaaggaggaggtctacgtgtaccagccgccgggattcgtgatccccggcaaggagggaaggtgctacgcctgcacaaggcactctatggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttggtgatcaccggcaccaaggatgcggaggtcgcggcgttcaaggaggagatgaaggccaccttccagatgagtgatctgggcctctctccttctacctggggatccaggtgtaccaggacgactccggaatcacgcttcggcagaccgcctacgccaagcgcgtcgttgagctggctgggctcaccgattgcaacccagctctcactccgatggaggagagactgaagctgagccgcgacagcacggcggaggaagtggatgctacacagtaccggcgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacattgacaccagcaagagcacgagcgggattctcttcttcctcggcgagtgcctcgttagctggcagtcaatcaagcagcaggtggtggccctgtccagctgcgaggccgagtacatggtggcatccgccgcttcgacccaggcgctctggcttgctcgactgcttagtgatctcctcggcagagatactggagcggtggagctcagggtggatagccagtccgctctggccctggcaaagaaccccgtttttcacgaacggagcaagcacatccgggtgaggtaccatttcatccgaagctacttggaggaagggagcatcaaggcgagctacatcaacaccaaggaccagcttgcggatttgctcaccaaaccccttgggaggatcaagttccttgagctttgctcccggatcgggatggctcaactttcccacaagacgacgcacaagacttagggggagaatgtaggaataagtcttggctggttggtcttggtcttgtggtgccttttcctgcttttcagctttctaggacagcatctctactttcagtttgaatgctctaggacagttaggacagcagtttgttgagatgctctaggacagtttgttgggatgctctgctctaggacagtttgttgggatgctctaggacagcaccctcttagactagcatggctgcatggctgctacaagcagctataaatatgtatccaatcctctttgggaggatatggcttttgagtttgtgaatgaagaaaaccagaaaattgccccactccgagtgccatcctcttctcaatgagagtaaccattgaagttctaacaggaactaggaaagcaatagttggccactgaatgtgagtataatcctcacctttttctttactatcttaaccatttcacttaatatgtctcgctcaatgatttgctggtaaacaacatccccacagtttttgcttagagtctctagcacctgaaaaggaagacaaacaaacagaacaaatcagcacattaaacaagacatgactgtgcacatagaaactatgctctttgtttcctaaatctggaggaagcacaagaagtttccaaaatctggaagaagaacaagaaataacttctaaatttgtgtagctagtgaagacaggtgaattcttaaatttaggaatgaatcgacctaaaactcacattgttaaaacaaaaaaatcagaagataacacactgagtatcaatatacaaggactcttgaaatactcacataaagcgtcagaatttgcacttttgaattcttgtttcccaggcgtttctttaggagcttgagtgtatccttggcttgtctgtacttcagcaaacatttatgagcatgctataaaacatgacaaaccaaaagttgtatggggacattgaaaataaatcccagaaagtatttaagacgaaacaattatgtcaacaattcaatatacaaaactcattatgcaatgtgcatcactcaaccatgaaccgaattatcaacaaattatagcaaaatgtcttaaattagtgtggcatcacatacacagattttaatgttagcaaatgccacagattataaaatgtaatcactgcctggagagacatataaaccatattggaagttggaagactaaaagttattgaagctatatatcacaccaacgtacagcagagtagagaaacaaagttttttttttctctcgaacacgcaggagagttgcatatcattatattaagataaaagagttaaaaaggactcatgcatgcccataacgggaacaaaggctataagaactttccaaagaaacaacaaaaaactacaccatgacttagcttcatctctaacatcctgcatgacggaattgaaattagctgaaacctctccaaagacacatccacctatgtttccaaatcaaccaagccaccaacacaactaatgagttaaaacccttgcgatgttgcttagccactttctgcaaagcttaaagccaccacatggtgaaaacagtgtcatcgggaccttatctaaggtgctgcaagccaaccaaggacaaaactgagaaccatacacttcttgtgaacacacataaagtgagcaagtgctgcacattctcctcctcttgattacacaatggatattgccaagatggtcaacactgcgatgggccaatcggtcagcagtccaacaacgatttagcgaggctaaccacacaaaagaattgcaaagaggccaaagctcaagttttccaaacttccttccacggctcaaattacatgcccctgatgagtttttttttttgtgtgtgtgctctcattgctgatatcatcatggcaaaaagtgatgtcatacctaaactgcacctcaacaacaaatgacaccaactcatcaccaaaatcagtggcctccatgagattatagctcaactaaccaatcacaaactatcatcaattattgagttattctgctctccaaaccaacaaccgtacaacctaagattccaaattcctaataaatttggaagaaaaagactgaatatgcttttccaaaaaaatacaaaacatatagcaatagacacagaacaaactagccaaaatcacagattcaatgccttatagaagcagcactaaaaccctgctaaatttaacgattttataaacaagcctaggttaaacgagatacaacaagcaagcaagatcacaacacataaaatgtcagagatgccacgataaccctactaaatcactcacgggttgaacaacatagagaactacctaggaattctccatcctaccatatgatagcaataacaattacaaacaaatcaaagaacctaaacaaaaagtctcgaacagaggcatcatcgagagagagaagccagacccgggatccatgttgatgatgtcgcagagctcgatgttcaccgcccaatccggcccgatcagcatgtcgctcgtcgccctctccgcgcacgccacggccgtcgccattttccccctctcaccaccaaaaaccctaaatcctgcaaacaacaacaaaaacaaaccacccaaatcagcccccaaattcccacctttccgcacctccccaacgcccccaacccgaatccgccccccaaaaacacatcttccaccccgcaagaacccgagcccctcaccgaatctgagcgacctcctccccaagattcggcgccaagaagcaccaaggcggcctcttttcaccgatccggaggtcctggccgcgcctgggacggggaggagagggagagatgcgagcgaactgtaggattggaggaatttcggtggctcggcttggaggaggagatgaggaggaaggagaaaggttggagaggagggtggtagactagactaggcaggcagcaggaaagaaggaaggaggaagagaagggaacgcggccgtagactttttctttgtttagttttcttggtgtgaaagtgagggcctgcaaaattatattttgtggtgctagtttggaattgtgagaaaagtgggatatcaaagtactccattcgtcctatattagattgtgagtttttacttgtaatgtttaactactcgtcttattcaaaaaaattttaaaattatttttattttatttgtgacttactttattatctacggtactttaagcataattttttgtcttttatatttgcaaaaaaaaattaaataagacaagtggtcaaacgttgcaagtaaaaactcaaaattccttatatagtgggacggagtaatactgtcatctagcagccccatcatttggaataagccaaacgacattttaacgaataaaacatgatttataaataaacttttatatatatgtgttcttaacaatttaaaagcaatggctgaaaaataaacttagatgaaaaaacctcaaaccaattataaattcaaggttgaaaatttgaattttagctactaagtattagtataagcgaaaaaatgagactatgatgactgatgaggataggatcgatttttctttatattagatcttgaattttttttacatgggtaaattatgtattttggaaaatatatagttatgttgtgaacttctttgatgtcatgaaaaatatctttttttagaaactctcaacggttgggggtacatactagatagatttctactatcggaaaaaatacattcttatcaacacaaagggtcattaagtaggatctttgcatgaatgcttactaagtaagcaagttctacattttggttgcgtatatggttgatatgaagttacataaaagtgcaatgtgaaaaccctggatgaaataattatataacatatcctatgtaagtcattttcactcattaattatattatccttgtgagtctattttctacacattcacttttttttcttccatttctcataaaaatatcaacacactatttaccattagcactaggcgactttgttcctcttgctacttctcttataaggagagataggggatatttacatgattaaatgtgcttgttaatatgtcatcgtatgaaatagttgcgacattttttgttttgcttgcagtgatagacttggggcattacttctctgttgcatacttttcacaaacaataggaacatttcaaacttttagagaaagtatctcatgttttttagagcatcaaattgttcattgtgtcaaatttatatattactcgaatacacaagccaaaacaattggttttatgtacatggctagaaaattatactccatccatttccaaataactgacaattggcactattcattttaaaccgtgaccattcgtctttctcatttaaaaagtataactgaaaaagcagaggaacaataatcggcaggaatgcaagtacaaaaataaaagattatagaacacagtaaatacaaaaaatgatagtttgattagaccgcgagaaaaacacaacaatcggataagagacgtaagctcaaaggaaatttttcaacaagtttgagttcttactaattttttttcaaaatttctttaggattatctattttataggaatttcaaagaaaatgatgggcttcctaagaattattttccgatcctctataaagtgccctgtactaaattaagtgatcgaactccacaagaattattcaatgaaaaccaatcttcatcttcaattcagtagacgaccacccactataaaacgccatattcgttgggcaagaagtttgtccatttgacgatcaaccacacggacccacccttgatgcagaaacaagcaaagctttgctcatcttggccgttccaggccaaaattgctttctgtttgccacccaacttcctttgggttaagcaagactaggttggattagatatgacttttaaacataatcctcatatcagcacaaaggtaatgttggttcttggatctccttaattaatcacctgcaaagctagtttttttttctttttatagcaagaaagagaggcctaatcatggtagtgggtttcactatctgcatgtaggtgcaagcaacagtagagctggctagcatttttttccttgtttgttatgtctaatagtttaagccaaaatggttttggctattataaaccatcaaaaataataattataaacttcgctaggcgtccacatgtacaactagaattatttttgtattggtccatgtgtgtcaacgatttgtaagagaaaagatataatgacttttaattagttttgtttttgtcacaaagaacctctcgatccatcatgtattttgtcttgtctccttaatgtaagaagaaattcaacatgccacaagcctgaaatcaacgtagaattgctaatgcatatgccataggagtataggactaatagattaaaaaaatctactgatataaattgggcaacatttttttagataatataggtagcaattacaagtttcaaactgcagatccttaaccggttttcctactctggtcgcatggatgtagtgtactgctccctccgtcggattttgactttttgcttgcactgtttaaccactcgtcttattcaaaaaatttgtgcaaatataaaaaacgaaaagttgtgttcaaaatactctagataataaagtaagtcacaaataaaataaataacaatttcaatttttttgaataagatgaatggtcaaacagtgcaatcaaaaagtcaaaatcacttatattatgggacagagggagtactagatttgtactacttcagatttcctaggctgagtttagttccttccaaagttgaaagtttgggttgaaattggtacgatgtgactgaaaagttatgtgtgtatgacaggttgacgtgatagaaaaagttggaagtttgaatccaaagtttgactgtttggtagctagccagtcagccagacacggttttgttgagtcctcaatcttcatgcattccaccatgatttgatagccgaacgattaatggcgaaaactgataaaattcaaacggaatgtatcaaatatttggattttttaatacatgaaaatttatcaagtggttcttaaatatagattggctcgataagatcaaccatgacagtcaagcagtttttgttgtattatgaaatcctattcatctctcatgctttcaaatctatatgattatttccctagcaaaacaaatagatccgtcctaaaaaggaattattcccatttaatttgaaaatgattctgcatgagttctgtaaagaattttgtatcgaccaattcaataatttgaagaacagagtcacaaagaattttcctgtattctactctgggccttgcatgcatcacagtgttagaaatggctttaagcttttgcatcctgggcctccaaaattagttggtttaaaagcaaacccacgtacctaattaaaattgggccgcccttgttcacactgcacacttcatgctgccgactacaattagg

SEQ ID NO: 66535 - DNA, 2847 bp, Oryza sativa
tttttaaaatataaaaatatttatatcatgcttaaagaacatttgatgataaatcaagtcacgataaaataaatgataataacataaattttttgaataagacgaatggtcaaacgttaattaaaaggttaacggcgtcatacattaaaatacaatacagagggagtatttcccttagggcacacgatagctagacttggatggaatcaaagttcccaacatgctgccagatgttaatgtggaggatgtacatatataagtacatttaaagtagccatatcacgatggaccttctgttataaggagatcttttggatataagttctcgacaaaaaaaaaaaattattcagcctagcccgtcggctagcatggttactgttttcgtgatgcatctcattcgtatcacacgcatagagatttttctggttttatcgcaccgtagtctggcctccatccttcctgttgtgaaatgctacaaaatattctatgatgtgtagcatcacaaacaataaaaaagatgttccttttttacaagttagctatataataggagtaaattaattaaatgtttagagatgggggtgatatatataagggccggaggatgagagaatgcattgctttttcaacaccctccgtatctcagatagcaaaatacatggttggtccttaaatatctaccagagtatcatttagatccataaacttataaagtacacatctatatctataattttggttgatgtatcacccaaggtctcaagaaaacattttttagataatggaggatttatttaaactcagttaattacatcaagatggtacaatcacactgagtcacccccggtctctgcataaaatgacacaaccaaaaaaagaaagaaacaactaggaatatctcccaagcataaaagtttgacagaaacatcttagtgcctatcaatccatagactagaccaaaacccatgttcctaggtaaaaaaaactcctgcgccacctggtccaactgtcgtgataccaccacaatagtatctcgtgtcccggtttatggaggatagcccagatacgtagccatcgggtaactaaagtgataacctgcaaaggagaaaacaccatcttgttatcaaaaattatttcattcttgcttagccaaatggaccaacacaaagttatcgcgcccatcaaaagcagattcctcatgtctttaggatacatgatagccaactcccaaacatatgactaacattgcgaggatgttttaaattataagctagatgaattacaaactacacctagcaagataagcgacactgaaagaataaatgttggctggtttcatccttgtgacaaaaacaacatgtcttactacctttccaatttctcttagtaaggttgtccttggtgagcaattacgcctagcgttgataccaaaggaagattttttactttcaccttccaaatgcgtctattgatattcggaaccccggtatgtgttagagctagataatgagatttaaccgagaagaccccattcggggtgaggttccagtgaaactcatcttgctcatgtaccagaaccaaatcagctatgtgaggcaatatgttataccaagcagctagtttttcaccaattaaatttagcatttagccaacttagaaatccaccatggcaacaaatttgcgtttagctccttgactacagatttgtccccaaccctagtcctctctactctatatcttaccgtctttctaaccgggacgggttggggaggggggagggctagaggggcaaaattttgctctttatttgaagaaaaaaaatacaagagtctcgctaggtaataacaaataaattacaaccacaattttcgtgtgatatatagctacatatattatatctattttttgttccaaattgccgatggataaaagttggatgtatggaagtgatcgagtgagcccagagtttagaaggggcattgtcggtttcataaatgttgtagagcaagacaagaacataaggaacaatcaatgcatgacttgtccatgctttgattgtaagaatgagaagatgtttaccagcaccgtatgaggacaagcatgacgcatatctgatctgtcgaggattcatgaagggttacacatgttggacaaagcacgaagagcaataggcactgaataatggaaggcaatgaagcgagcagccttgtgaacgaggaaggacacgaagatatgcttgtcgcttccccattgggtggtgatcaggtggatgtcgataatgataccgatgacacctctgcgacgggctgaaaaacctatcggtgaacggtgagagttggggcccgacaagtatatctctatcatcggtcgtgacggctactcgccagacacaaatgagattttcacattagtgaccaataatcagtgatcacacactttgtggttaatgatgagggttgtgacccgttacggatgactggctccgtagtagtgtgaggtgtgttgcctgccttcacagtgatgatggcaccgcggcagattcatgggatcaccttctccttatcatactgcatgcatgtatccctatggggatctctgactaccgatgatcgatcactgccgtcctaatcatcatgatgggttaaaagcaaaatgtttgccaccatgtacagccacattagagcaggtacaataggaggctataagccatctgcaaacatattttaagtagataaatgaggagagagaatagcagcgggctatagatttgtagccaactgtaacacggactccaagacgcaatgtgtgtatgataggtgggatcatgtattaatagtgtagtatgta

SEQ ID NO: 66536 - DNA, 5089 bp, Oryza sativa
  unsure (1)..(5089): unsure at all n locations
acaaacagtaggattttcaaaaaggttaacttctagaacaactgttttctccttcatttttggggaaaacaagttttctcaggatacaaaactactaattggctggaaaaaaataatggtggaaaatcttcagcacataatagaaataattcctatattatttattgtttagtatcaaaataacttttcttatttgtgagggaaaactctacaaaaatggagattaaagtgtggtcattgtttcttaattttcaatattttaaattgcgattctgatctcaagcgattcacaaagaacccaacacaatctaacagaatcaagaagagcataattttttccccaaactacaactaaataagttccatcaacctaagttagcaaactctgttctccaacttttttaaaaacaaacagattttgaaataagacaccattcctaaaacccaaccaaactcccattcgagaataataaaaaagagatatgcaaaaaaaaaaagatccaatgaaactaaactttacatctagaaactgaaataatgcacaattagcaagtctaaaataatttacctgctcctgctcctggttgtttgagccttcgggttgccgccgccatggccatttccgatgctgctgctgctgctgcttccatggccgccgctgctagtgctgttggtgctgctcgtcctgctgctggtgccggcctcgctgaactcgccgcccttgctccaccactcctcctcctgcagctgcgcctcctgcttcttcttcttcttccccttcgtcttgttcttcttgccgccggcggcggcggcggcngncngnttgngcgacaccttcttcttcccgccgccngccgccgcggngagcgnggggcngagcttggtgcgcnggccggtgtcgaggctcacgctgcggtccatgctccggctcagcgtccgccctatcgtcctatgcttcctcgccgtcttggcggtggtgcatttcccctgcttcttgctggcttcctcgcccatggcgcccgccgcctccgcggtgatcgtggcttcgacggtgggaggtgctggggtggggggaggaggagggagaggatgcggcggcggaggaggaggggactcgacgatgtcgcggagggagagctcgtagcaggactcggggaggccgcggacgaggtcgagcatctcgctcggtacccggcgatcgcctgcgccctcgacggcgagctccccgccgacgccgggtatagccgctggagctgctgctgctgctgctgcccccagaactccggcgacggcgtgccggactccggcgagccgacccgcgacgcctgcagccaccgcgactcctcctccccttccctcgccgccatcgggttccccagcgggctccgcatcctaaccctctcgaactcccctcctcccccacccaccgccgacgccgacgacccctggaagctgaactccagccgccgctgccccgacggcggcatcggcatcatcccgacgccgagagagagagagagaggttggaagagagatggagagggagaggaaggtgtaataatggcgatgtggaggaggaggcgaggaggcggagggggagaagaagaggagagaagaggagaggagggaaagcgatggcgggtgggtgcaagcaagcaaggtcgttggtgagagatttaaaagcgggatttaaatttggagggagtacattacatacaaagctttaaataataataattaaattataaacaaactacactgtactttgtgtatatacggcgtggcgccgaactgtacatcacagcaaagctgctgtacatctccgtcaggtccataccgtggattcgtggagccattgggttcggaatcatctatcataatatcattatcgttacgtgatcttaactttatattatcccgcacgacagtgtttataaaagtagtgtcattatggtagataatgtgaacccgatggactaatggtagtatcttcacctcccgcacgtaaaacgaagggatctattatggtattactaattaagtattagttaaaataaactttaaaaatagattaatatgttttgttaaaacaactttcctatgtaattcttttttaaaagactattgtttagtatgtttggaaaacgtgcgcgtgaaaaacgaaggagtataggttgggagttgtgagtgacaaactcagcctaaaatcttcataaacccgagacaatggctactgttcacacctctcgtattaatatgtaagatgtgtgcagtggtgaaatggtgatgtgttcgctaccatgtgtgatcacgtctgagtcggatgacgcataattcgtgatatattaaaattttgttattatgttaatagatggcggtgtaagtgattggtaattaatgcgagtgattaaaataaaccaagggtacatgacatgagtgttgaaatgtttgctagcttgattgttgcaatggcgtttaatcggtgttgtaggatccaggggggtgaatggttggtatacccaaaaaccgaaaacttttagtggaaataaaagttaccctcgaaatcgacggaagtcggtctgaccgagattgatctgccggtctgaccgaagcgtagccgccggtctgactggtgttgatcttccggttggaccgccctggaatccctgctgcgcctgttgtcgtccccggtctgaccgaaggtcacccgccggtttgaccgccgccttgccgccggtctgaccgccgatgtgtcgccggttagaccgccgaaacccggtgaaacataaattgaagaattctaaaagtagatgacgactttattgattctctctgtatttacgaagtgcacaaacagcactccttacagaaatttcgactaaactcaaaaccctaactcaaaactcaactcaattgctttcaaaagcgataccgggaagcctcatgctccccctctatttatacccgaggcaggcaggaaccaaactcatactaggagtcctaaacaccttagaaaaccctctagtacaagaaagaaactttacataaccaatcgtaccaaatttggactccttccaaattcgactccgcatcccatacacacacaatacctccatcgtatgccatatggaatctccatcaaccacgtgcatcaactctagcctaagtatcccgcataatctctgaccaccacggacgtcgtcttatccccaagccgactcccggtccatcaccgcaaatactctcccgagacatcgagtcacctacacatgaaataaataaagaaaccatattccgagaccaagctatctccaacttgactcattagtagcaaacaacagtattacatacgtatagtatccatctagaagccataatcatgaaataatcacggatatccaaacaaacaacccgaaagcgaaactgacacagtgtcggccggtcagaccgcgggctggccggtccaaccgctcgattaccgccggtctgaccggcatacacagcccggtctgatcggtcacatgaaataatgaatcctgcgatcacctgtgaatccaatcatctccaaaccacttcatgaataaattccaaataacaaaaccaataatctccaatgcccaattattcatcacagaataataataaaaaacacctttgattttacaagtgtgagtgctttactttgttgtaacaggaatgctaaaaaaataggatcctgtttctcctaacccctcaagctggggtctggggaggcatgtgctaccgccggtaggtccggccgatgagccactaggcaccattggtgtagcctcctacttatcctcatctttacctcaactcaacttcggttgccatgggccacctcctttatgttctctcacgtcgctagtagtggtttgtgtgtgcccacacgagacacgaccataggtctaccaggtgtaccactgcctccatcgttgtacgataataccacataccccgcgttgatgttacatggttgtccgatgataagtaagatctatatggtggaactaactaaaccttcacaaactcaagacagtggccacggttcacacataacaaaaatatgtgagatatgtgcggtggtgaaccggtaacgtgttcgttaccacatgttaaaacgtctgagtcggacgaggtgtgttttatgtagaactcataataagaaattttcttattatgtattctacatgtcagctgtacggttcttttttcatttgccacgtgttaatgtaattctatgaactagttagtacgtggcaaataggtggcggttttggtgattgataattaatgcgagtgattaagaaaacctaagggtacacttggatttattgagtgttgaaatgtttgcttgcttgttggtggttaatcatcagtgtgagtgctttactttgttttaaacgtgatagtataaaattgtgccattttcatgacagaggaactgttcctatccattatatttcgtgcagcccctaattgttgtgatactttagttcattctgaaatgtgatacccatgctatataaatatggcattttcatgacgctgaaactgtactgatcgatcgattgtgttcagcccctaattgacacagcatgcaattaacagctcgatgaaagcgattcagtgtttataatttgcagcatagttcagtagccatccagatgtctggcacgtgcttagaccgatggagaaaaaactgacatgatggttgctacatgtcttgagctgttacatctcacaaccactaaataatccgtggttaatcaaaatactactgctgcctttgttccataatatatatcactgtcaaacatgacacgatgtctaaaactaccttttaacttttagtttcttacacacactataagatgtagcaacaaaaatcataacgatagaaaaagtaaattcaaatatcaattgaacaatattatttcttaaaaaataaaatttaatttgtattagactaattttcagtcgaatatttaatgagttaaatctttataaatctgtgacagagagagtagcactcgtacctatctcagattaagcaagacatcaacta

SEQ ID NO: 66537 - DNA, 1822 bp, Oryza sativa
attttttctgcggctaactagctatcctaaccgctatatagagcgcacccttacttggctagacatcgcatccaaaatctttggcagaacgagaaaagatttggttctctgtagtatctcatgttcacttgccaaacaaggatagtgcagagcagtgatttttaacttctgttcttctaactttctctgaagaaccttgcttggaagctgaatgtgtaagtaggatgggaccaaatcttcagcagttaataagtttcagttaagcaattgattactagttgtgaaatcttgaggacactcttgccaataggtagaatgttagcttggaattggatggagcaacgcttcactgatgaaacctggttctcctcatgcaattctcagcattcagtagtaatcatcaatcaagctgctaaacagaatagccatggcagttactacctcagtcctaaaatatataaaaatctataatcaaatgagacattttctagtatcagattcgtattactaaaaaaaatattccatccgatactaagttcttatatattttggaacggagagagtaagtcggaatgcatcaaacggatcccaatgaaattgatccgaatctacgagagcgcaagcgaatattactacagaatatcaggggttacatgcaaaaagttcttcttcccattcccctgaaactgaaaaagatttggcacgaatcgaaccctccaatccattgcttgcccttttttgtgtcctccagcttctagaaacttctagaacccaagtaagtccaagccgccgccgccgccgcctacagttgcttgcaagccgcattggcccaggtaacacgcccgcgatgtgctggtcattctggtgttgataggaattcacagttttgatctctctgctccattctgtagcctccaggtttggcgctcaccacctgttcgacgaaatgcggcaagagggagcagatgtgcgcggcagccacaagatcaagaagacgactgctgatgtggaaggcgggggtgaatggatcaacgccctcccggaagaggtcctgcagcacgtgatgtcgttcctgccggcgaagcaggccgtccggacctgcgtcctcgcccggcgctggcgccacctgtggaaatccatgcctgctctgcgttccatccatggtatctgaacaagcacgatgtcaggaacctgaacaggtttatgaattgtttgattcgctaccgggaccgcagaatgccactagatatgtgcgagatcaaaatcggtgcttttggggagggctgtggtgaaccacaggttgactcacttatcagatatgcctctgttgcgcaaagctcggataatgaaggtcgaattgcatgagcacaacgataactttttctctagccaagctgcctcttatctcccagcgcttgacgaggttagagcttagtaatgtgccattattatgtggttttgttgattctttgagcttcccagcatggaggccctatggatgaagttctgctatatagacggtgagaagatatcgtctcagtcacttaaagagctgaccatgattgactgtatattttttcgccaatttcggatttctgctccaagtttggtgaggttggaaataactgattgtgtgggtaaagctcctgtgctggaaataatgccatctctagtaaaggcatttatcaggttccgagactctagagatatttgtggtaaagaagaatttgggggtagttgtactaatgctagctgtgataattgtggtgctaatggtgttgacagtggagattgtgtgcttctgaagggtatttcaatggca

SEQ ID NO: 66538 - DNA, 588 bp, Oryza sativa
tctgggaatcttttgtcatctgctctagacatttccactgatgtagatataagaaaaatcagcactatgttcaattctatgctctgttttcgtactgatttcatgttcattttcgtgctccttttgaaagctttatttggatatttacatgagttagattgaatgcccatttaaaagtttagaccctgggacctgtagggtagttaatagatgaggtagatatggtgcccttaaaactttagggcctggaccctgaactacactttaatatacaaccttaccttctgacaaggctaagtgaaacacccacaaaaagattgggaacagttgttctgttgggttggataaacttaatactatcacccactgtgccattcataggacccgtctattaaaggataggaacaaaggctgaccattcactcactgcgccaagtggggagaatgctattcactcaaggccacagaagctcacatggtcatgagctcgtgagggcaaggaatctcctctcccctggatattagttatcatcagtagtagcagcagcagcagcagtagtagtagacagccgtagtaatcatctttgc

SEQ ID NO: 66539 - DNA, 6085 bp, Oryza sativa
atgcctgtgcagcctggggacgcccgctcgccgcgggagcgtgtctcgcggcctccacggggcagggcagcagcgtcagcgagcgaggcgcgcggggagaagaagatcgtactactagaccaccgtggcccggcgtggcgtggcgtggcgtggcacggcgcgcgcggggggaaaatgctctggcggtttggcttcgcggcgccggtgcggtttgtaatgggggtggtggtggtggtgcgggggtggcaagagcacgggaattaactggcgagcacgtcgccgccgtttcttgctgtgtgtgtatggcacgccaactaacctgtgcccggtagcatgggaaaccgttgtttttcttcttttttttttccctttccgtctgttttcaaaccctcctgcatggagtagtgtagtagcgttgcatgatgatgcgtatagcgattattctttaaacagcaagaataatactccttaagtcttaatatgatgttattgtttttttataatttattttaatttagtataaatatgtaaatgaattaaaattatacttttttatgataaaacaagtcacaacaaaataaataatttttttgaggaaacaataataaataactagcatggtggcccgtgcaaatttcgcggctagcatctttatattttctcatataatagcatatatgttttctcattatattattcaaatatattaaaataacaacataattttaaattttgcaataactttacaaaactactaatgtgtaatattcatattatattttatatacatgttagttattaattatttttaatatcaaattttagttatttgtaaattatatatattcctatatggactctagactcgtcttttaatatttctttttttttaattccgaatttcctgtaaattgtatttctatatagcctatatgctcttcttctaatattatttatttttatttctgaattttcatattatattttatatacgtgttagttattaattatttttaatatcaaattttagttatttgtcaattatatatattcctatatggactctagactcgtcttttaatatttttgttaatttcgaattttctgtaaattgtatttctatatagactctatgcttttcttccaatattatttatttttatttctgaatttttattacttctaattgtatttctatgtggactttaaactcatctttcaatattctttaatttttaatttcaaatttcagttacttctaaattgtattcctatatttgtaatcctatattgaccttaaactcttcttcccatgtttttcttaattttgaatttttgttatttataaattgtatttttatatggactctaaactctacttttaattttattatgtttattccaaattttagttagttttaaattcctatatgaactctatactctacttctaatattccttatttttaattccgaatttctatttttttcttaattgtatttctatatggactctatactctacttctaatattccttatttttatttccgaatttctattatttcctaattgtatttctctattccttatttttatttccgaatttcagttatttcctaattgtatttctatatggactgtatcctctacttctaatattccttatttttaattccgaattccagttatgtcataattgtatttctatatggactctagtctcctcttctaatattacttattttttaattccgaattttagttatttcctaattgtatttctatatggactctatcctctacttctaatattccttatttttaattccgaatttcagttatttcctaattatatttctatatggactctagtctcctcttttagtatcccttattttttaattccgaatttcacttatttcctaattgtatttctatatggactctagtctcctcttctaatattccttattttttaatttcgaatttcaactatttctaaattgtatttctatatgactctaccttttctttttctccgattaatgtgagaatttctaggccatgagagcgaacgtggaggctcctttttctatttctttaataatataatagatatttatattttttaaagaaataaaataaatggttaaacgttatgcgaaaactcaacgacatattatattttgggatgaaaagatgacatactatcattagtcatgacattagtacctgattgttgcagtctgatagcttatttatcattaatcatggcaagtccggtttttctctactacctgatgttcatgacaagtccctgttggctgttgcaatcattgtagttgtgccagatgggataatatattagcagtttgctaatgacagagtagtgacgttgttttcatacatagagaaatccctagggaacatggcaccctgccggctcccttcgcaacttggtgacaccgaccgcacaagtttcagctgtcaccatctcttgggccgcatgttggcggagaaaggcagcccagccgtcttctagttgaaactaaaaggcccagcacaactcatcccgcacggtttcgctgatgaatcgttgcgggttgccgctttggacaccgcctaggcgcctactccacgcgccgtcggattcctgcccggaactagctcgatctcactcgttgtcgctggtgacttgtgccggcttggctaagatcaagtttagtagagccactcctagcttaaaatcatctataattaatttaatagccaatacatataatagttatatgcaaatatacaccacactattgatatataatttctcatgttatatacacattacgttttatgttttatatatgtatgtatataagtgatttatagtatactattgtataacctgctctgctcgatctcatctcggtgatcccatacttggcacgtacacgtgccctcttgatgacataaacaaagagcagacagcttgtgtgcgcttgtctaggtagaaaaaaagggatccgatcgatccgaagagcatggtgaaaagcacgctattaccagtaccaccactgttcgtttcgtttgttgggtttcggtcatcgccccacacatgtcgcgcatgcatggttgtcgccgcgacacgtgccggcgcgcgcacctccctctccgcaccttaactccttcgctctccgcccacttccccatcacgcgcgagcgctgccatcctctcctcctagctaggtcgatcgacgtcgagaatggcagatcggcagcagcagcacgcgcacggcgagggccggacggcggcgcagcgcctcgggtacgcgcccgcggcgtcggcggactcgccgtcgacgacgctgctccggcgggtgcagacgcacgcgccgaactccacccaggtggtcggcttcctcacgctggccgtctccggcgccgtcctcctgctcctgaccgggctcacgctcaccggcgccgtcgtggcgctcatcttcctggggccgatcgcgctgctcaccagccccatctgggtgcccgtcgccgtcgcgctcttcgtgctcgccgcggccgcgctctccgcctgcgcattcgtcgtcgtcgccgtcgccgccggcacgtggatgtaccgctacttcacggggaggcaccccgtcggcgccgaccgggtggactacgcgcgcagccggatcgccgacacggctagccacgtcaaggactacgcgcgcgagtacggcggctacctgcatagccgggccaaggatgccgcgcccggcgcgtaagccgcccgcgcgcgccacatgtgtgtcggtgtgtggcatgcagcttagatgtgatcgttcttcttcggtgtgtttgtgttgtcgatttcctcacttcttctgtaggctactttaatttggtattttgatcttcttcttctctggatcgtacgtcactcgggttgtatttagtttggatcataagacgtcgcaccgggctgaattgatcttcgtcatttggcctgattcgatctcgcaatggtcgatcgcaattcctcccagctcgaggttacgctcaatgacgactctttgcgtgtgagatgtgacctagctagaaaagtccaaaattttatcgttttcgcaaagcaaaagatgtgaagaagcaaacggcacagcattaaacaagcaagaagttaaccaaacaatctgaattggaagcggttttgatatgttttttcagttgggactgaaggcgagcggcgccacaaaccaaattctgcctcaccaaatgagctgagatcagcgtgcaacggcgcaaccagttccgtgcaacagtcgaagatgcattcagagatcagtgcgcccaccagttccagtcgagcagagggcatccgccatgccggcaacaacaccgaaccatcgcatcacgaaccgccgtgaagaccgaagaagaaacagggagacagggtagagataggagaggaggggatgacacgtggggcctattcttgtaaaacttttgtgatgactaggctgccgcgaggataccaagtactccgtaaatcaaaaccgccatctaaacaatgaggtagttttgaacgattttaacaggggaacggctaatgggcgatcgatctgaacgatcgatccccatccctgtacactcctctccccgcttcctccctccccttctttttcttgctacaccataaatttttaaaaaaattaaaaaataaagttggaaaaatctatgtataaaaatattatatatataaaaaaaatttgaatttaaattcaaatttgaaacgggtatgtaaacttttgacttataaactttgggtctataaactttaagtgtgtaaactttagatgtatagaaatactatatacaaaaaatatttgaattcaaatttgaatcgggtacataaatttttgacttataaactttgagtctataaactttaggtgtataaactttagatgtatagaaatactatatataaaaaatatttgaattcaaattcaaatttgaattgagtatataaacttttgacttataaacattcgctctacaaactttagatggataaactttagatatgtaaattttaggtgtataaacttaataaaagaggaaaagaaaaaaatgaaaaaaaaaacgatcactgccagcgatcaatcgctcgttaggactttcgttttaacagttggagaatcaatatatcaggcttgactgattgagggggggggctaatgggcaatcgatcgccagggcgatcgcccagcgattagatccgcccccctccccctataggcaatacctcctccctcttctccccctttctcctccccttcttctctcgggaatgctaatgggcgggtgatcgctcccccgtccgcccagcgatcactcgcccgctccctcctctatactactcctctcctcccttctcttcatactatagtaaaccacaaaaaaaataaaaaaaacaaaaagttagaaaaatttatgtatagaaatactatgtataaaaaatttgaattcaaattcaaatttgaatcgagtatgtaaacttttgacttataaactttgggtctataaactttaggtgtataaactttagatgtatagaaatactatatatagaaaatatttgaattcaaattcaaatttgaatcgggtatataaactttaggtctataaactttatgtctataaactttaggtgtataaactttagatatatagaaatactatatatgaaaaatatttgaattcaaatttgaatcggatatttgaattcaaattcaaatttgaataagatataattcaaattcaaatttgaatcagatatataaactttaggtctataaacattaggtctataaactttagatgtatagaaatattatatataaaaaatatttgaattcaaattcaaatttgaatcggatatataaacttttgacttataaacttttggtctctaaactttagatgtgtaaacttgaggtatataaactttaggcgtataaatttactaaaataggaaagtaataaggtgccaaaaaaggaaaccaggtggagggagggaaggggga

SEQ ID NO: 66540 - DNA, 7029 bp, Oryza sativa
cttctaggataaggtgcttgacatgcagggtagggaggaaaaccacgaggttgggcgaggcacgacaagcgtggcagtgataaacccttttgcgtttgtgtcatagaaagcaactgcaatcatttcctccagtgtggtagggaaggctcacactcttacagtccagtacgcagtgagatgcatccccagtctcattcgtaagtagttcgatgtgcatgaagcttctaggctataatcatagggtgctcctggccctttcaaggtcggagtgatcccagagtaaacttggtcttagcatgcagaacccgcccatgattgaatttgagttctatcgtgatctcagacatcatgtttgagccgaatctgacccacaatttgtagagaggtagttattctctaaacatcccccccccccccccccgcgctgcttctacgactcgcgtgtcgcgtgagtggggccaacctgcagagtcacgtggccaaagggaaagtaattcccctctacttctcatacccccgggcccatatctccaacatatatgtatcaaaatttgatacctctcggtacctcttggtatctcttaagtatagtaacatttcttttttagaaattagatatatgacagttttgttcttaaaattttattgcaggaggtttttaaatggaaaaaaaggggttattttctgtagtcatggctgatgctgatggcactggtgtgagctagtaacaatccagagaacaagttgacgggaacagatgactataaacgggctattggtgtgcgtcgagatcaaatggataattcctctcaccggcgccggattctcctgggcaaaaatgtggagtttgctcggccaagtggtcagcagctcaggcacgcacagtctctttttcacagttttaataggagtacgagactgactgcgacgcaatgccttctggctcttttgttttgttccttttgttctgtttcgttttactcccccgaaaacaacatcacgctagccgatcaagcttcctcctgcgagaatgcgacgcgaaaactaaatggaaatggttgaaggtttgagcccgatcaggcacgtttcccagctcaagcaaaggatctcacccaatgttactgactttctgctacctgaaatgaatgcagtttctgggcacaggttttggtctctgaatatgaaactctgaaaaagtaattctgaacatggagaagaagttcagacaggaggaaatattggaatgcaggaaattcagtaaaggtgtgtagacaagtagaattagacagagaaatagattatgggcttcagctagaagttaccgcatctcatctcagattagaagtttgaaaaaccaaacaagcagatgagagataattaacctctccatccaaatccatcactccagttatatgttctaactgcatgtgcttttcttttcatgtaactatcgttgagcacgtgataatcagctgctctcatgtatgaatgctctgctacagtcgcggagaattgacacgaaagatacacaaaatggatcgaacaccagcatttcaaatcgatagaacaggagagccattttcatcatggtgtccagttaatttagcaatcgtcggtcgatcggtggtgcccatttcagattggccattccgtacgtttgtccctatgctgtcatgatcccaattatgaacgagcgaactgcatatatcttaccggacgtctccagcaatcttaagcaacaagcaccgaatcaatcacgaagcactgctacacattctggatctgatttttttttcaaggcaaatattttgtatctgattttttaatttttttttaccatttataagaaagtatcactgtatttttctataaaactcgatacctttatatgccttttttctagtgtagaattcactgaaaattttgatatttactacaaatactttttaaaatttctccttgttaattaaccataacataaattaggcatcatgaatatgagttagaatgtgcagaattgttgaaatctcaatgctacaattgtaggttaggtctcgttggaaaaatctctcgattactaaaaaagaaagacatgaaggcctttttctggatcacaaattttacaggatttttgcaccgtccagttctattcctttaaaactatcctccatttcaacgaggtcaaaaattccacctatatgcacgcaccgcctgggcgagcaccgatcgaatcgtcggagtccggccggccacctggcgccgccgccgccgctcgtgatggcggcgcatccacggcacctcggccggccggcgccgcacacgtgtcgcgctttgtgctaattaatctcgttcgtttccagccctaaagctagtcgtaattagctgttactacctttcctttaaagtagcaggacgcaccgtgctcaaagtatgtatcatgtgtgtctacacagtgatccaacagtactatcaccacgtgtgcatcatccatcagaaataatttattaaagaatatagtaaaaacaggtaaatattaatttacggaaaataaaaaaatgtcactctcacaaaattaatgaatttgctattgcacatgtacaaactcgggtgtacaaaaccttgtctaatggaggtttttctcgcgccacccgtaggcgttcacactctgtccgagaaagacaaaggccagttaagtcactgacttcacactgttcatagtccacattaagccgtaattaattaacctaatcacgtgattaattgactatcaatatatgcagaaccaaacactgtaaaattaattagaacggatgcgggtggctgcggctgatgccgttcacgttggcgaagaggccgacgagctcttcccggtaaggcaagaacgtccgccgcggcgtgcccccgccggcgctggtgccggtggcgccaccgcccttagcgccgtaagctatcctgtggatggcggcgaccgtgtcgatctctgcggcggcggcctgtgccgtcttgcggccgcttgccggcgtcggcttgggtggtttgggtttgggcttgaagtgttcgacgtcgttctccttgctactgggcggcgggatggggaggaacaggaacttctccttgccgtcgctgtggctgcggccgacgacgagctcgctgatgcggcgccaccgcgccatggaccccgttgagccgctcttcctgggcgggcgcggggaggccgatgccgaggcggagccggcgccggcgccgggcgtccagagacagtagctctccggcggcgcgccgtccaggccgccctcgtcggacgccggcgcggaagacgacgacgacgacgacgtggacgtggaccacctgtcgaacgaaccacgggactcctcgaggaagagccgcccgagcgggcccctcgtccgcggcggcaccgtcgccgcagcgtcgtccttggccagatgctgctggcgatcgcctcctcctccggcgccggcgcggccgaaaaccgggtagaacggcttgatgcggccgtcggcgaacaggtcgtcggccacggcggcggtgcccgcgggggagtccctgctgacgaaggggaactcgaactcgaactccccatcggaatcagattcctcctccactcccgtcgtcgtcacgtcgctggaagaagcctccgccggcagcacgtcagcggcgacgtcggcggtgggatcttgcggctctggaatcctctcctccatggtggcaggagagggggaaggaatgagaattgagagataggaggaggagtagacgagaggcgacgacgcgggtggataagaaatggagtcagagagcggcgtttataaagggggtgttgcaccggtgcacgtcttccagaagctcgtgctgagctggtgcagaccgtggaccctgcctgaagagaccctccccaagcatttctgaattctgatcaatggcgtggaattttcaaccaaacgtgactcctttgaaagttactgcatccatctcaaaatataaaaatctaaaattaaatgagatattttctaatactacgaatctggacagtcgtaatagaaaatgtcttatccgattctaagttcttatattttgagacggagatagtaaatactccctccgtttcaaaatgtttgacaccgttgcgtgtttgaccattcatcttatttaaaaaatttaagtaattatttattcttttcatatcatttgattcattgttaaatatactttcatgtacacatatagttttacatatttcacaaatttttttaatatgacgaatggtcaaacatatgctaaaaagtcaacggtgtcaaatattttgaaacggagggagtatacaagatttacagggctattttattagaaattagtttgatttttaggagaaaaaaatatctaaattcctccattcaaagaaagccttaattacctcatttatgtttttttgtttcgacgatgcgcaaaagcattgtaaatctctgtatttattaagattttgtttgggaggggagagttactacaatttatgtgatgtgcttgatagtgcagcggtaagatgtgtagtttcaactctgagattatgtatttaataatttattcttaaaaaataaatatcataatttcatgcatttgcaccaccaaaagcatgaaggagctcgccgtggtagggaagcagtttggacgcctggtaacattaacgattagccatacaacgattcagggtaaggcatcaggatgatcaatagactcgtcatgtccaacaataaaaaaattaacttagatatgtttgcgggtgacatatttcatattgatctgtcgtatcaaattgtttttttatctttgagtcttttttttaaaaaaataaagtttgataaccatttgaaaggtataaaaaaatgaggaaatgttctcttcaacgatgaaaacactttttcccattaggttgcatgatcgtgtttattgtccagtatacgatgcatgatcgacagagaatatgaggtgttttaactaacgtaccgttagtgtgttactgttatagctaactttgcactgagcagcattaccatagcagtcatatcatccatcattagtgggcgcgagatggattaatcaatgacacgtaccgcatgaaaatgatatgattcgagtgcgcgctcccaccgcgagactttgtgtggactgcaactgcaatagtctaaagggaaccacttcccttggactccaagtctccctttgcgccacaaatcaaatccacaatcctagaaaatcctataagagcatgcatgcatcaacgaccatgagaaaaaagaaaagattagatatgaaatatacgacgacgcatgcatcatacagtcgctgtcttgccctgatctcatgacctcatgaattaaagcggagaggctggagatcggtctcatcatgtttgctgttgacatgctacttcaattcttccggatcaatcgatcggttaacgttcggttcgtgtgtctgtgtgcatgcacaattaatcgagagagaccaacatgccatatgcgttcccacgctggttacacacggcggcgaactcaaactcgtggagctaagctgagctagcgccaggagccagggagaaagaatcagggtgattaatcacctagctaattactccaagattggcaggaatggatggatggggtggctggctggattctctcgtttgtccgttggtccctagctcgcttccttgcttgatgcgcacgtcgaggtggagatctcgccggcgtttagcgttttcatggtttcttctcttctttcatacggcggctgccgctgctctgcgcgtgatgttgatggtgacgtagcggccggccacccggggggcgtgtacgcgtggcggtgcgcgtcggcggtaggcggtgcggtgcggatgggttgtcgtctcgtttcgtcgtccgtggaattcggcggtcacctcagctgccggcgccgcggcggccgtggccccgtgtggtcgtctgcgtccggcgggggtaacgcgaggatgggctagttcgtgtgagtgggccgagaaggtgcggcctgcctaacgctgacgagccagtacgacgttgatgtgggccgatagatacaccggcgctaggcctaactggatcgctctaccggttgcgcaacaaaacctgctcggccgttctagatggctacctaggaataagttcactttgggtgcctctatttgtcgtccaaatttcgtaccttgatagcaaaaccgggtacaacacgttctccaacttacgaaaccatttaaataaagtcccttgatagtatttgaccccggttttagctgaggtgtgcctacgtggcaaatttgactcaatcttcatctgacatgacattgacgtggcgcttacatggcaattcgatccgaaaaataataaaacctatggaaccacatgtcagttttacacacacaataataaaaaatggtggggcccacgtggacctcacctatcatcctccctacccttctctctatcccatccctctctatcctttctccttcctcttctctctatccctctctctctccccgagaatggcgagcggtggcgggcggcgacagagctaagagccggtaggcggcgggtggagcggtgccccggaccaagagtagcaccagagccagtagggccgccgtcccgccgcctacggcaatggccgcgaccgccacgccggacaacttctttttcttcttcttctcggccactggcatggaaccacctccgctgcctcgtccatccgtcggcgtgccatcaggagacggaaagaacggctcgcatgggcggctcaggggcttgccgctgagctggaggttgccgacgaaggactcaggcgggactgcttgttctgtttttctccggagattgttaagatattctgcttgactgcttgcctgacgaaatctagagcatgcatgcgcataactgtgatgagacaaccacatgaatattactacctccgttttttaatagatgacgccgttgacttttt

SEQ ID NO: 66541 - DNA, 22085 bp, Oryza sativa
aaaaagtcagcggcgtcatctattaaaaaacggagggagtacttgacaacttgttggatcgatgtttccgcggagagcctcgggcaagatgtcgatcttgaggaacggcggtagtagcagcccgaggaacttggtcgtctcgccggacatcgtagggatgtgcaggcttgccacgtcgagaaggaggaggggatcccgccggccaggtcgtgggtgcggggccggtcgccgccgggtgcccgccccactccgtccaccgccgctccttgcccgccccacttcggccgctgccgctccttccacgcctcactctggccgccgccattcctccccaccgctccgccgccgtcaccgctccgccctgccgctccggctggagagagagaagggggatagagagaaggggtagcgaggatgacaggtggggtcccaccattttttattattgtttgtgtgaaactgacatgtgggtcccataggttttattatttttcggatataattgccacgtaagcgccacgtcaatgccatgtcagatgaagaccgagtcaaatttgccatataggcgccacctcagctaaaactggggtcaaatactgctgagggaccttatataaatggtttcgtaagttgaaggacctgtcgtacccagttttgcgatcaaggaacgaaaatcagactgggcgacaaataaagggacccaaagtgaacttattccggctaccgacgattgcggtcccgttggatcgctatccatgaatggaataagtcttactttgagtccctctatttgattcgtgcccctcaacaattgtaccagatatcctaaccccctctactattaaaaccggtataatttaacttccttgatggttttgtgagctatttttgctgaagtggttcattggctaatcaaataactgagtcagcacatgaggcttcgaacacaggtcgtctagtccaccaccttgtgaagcttagccggaagatctctgggcgtttcttaagggagttaaagtggacttattccatccaaaacatggttagcctatttgggtagtatcgatctctcccgttctttctttccttccttcccttcccttttttttcttttttttttgcgagaaccccttcctagttcttacatcatgattttctcttctgtagacaaactcaaaatccccacgcactatatatatacgagatacagaaaaacccctgatgaaattaagtacaggcttctacccacagttagagaatgcagatattggaaatgaacaattcccatataattggagattggaattgaatgagaatcctgctgagtccggtgattcatacaccaaaatctacggctcagtatcaaaccttcgatttgtgccgttaccgtggtagcaggcgtaggagcctttcggtctgtcaaacggtgtgcacaccaatggaggcccaaggatacagtcgtcacggtagtgccgcaaagctccgtcgatctggttctcttctgctgtttagtcgcatatggaagtttgtttccttagattggttaatctttacctcattaaagatggtgtttctgctacctttgtatccatctgtgatgtcctggggtgtatccctttaactctgtctttgttaataaagttgtttaagtttttttaaaaaaagagaatcctgcggatagaaagcatttcgacgtcaccagaatctggatagagtttaaattagctgaaacgaaagcaaagatccccatggtttagccccctggattcagtgattaggtctaatctaaaaccgatccttgccgcggaataaaggcggggcctatcgaccactccccatagaaaatttcagaaaaccgggcagagaaaattcagaaaaaccaggccacccccaccaagcgcaagcgcgcagaaaatgacatcgaatcgagccgatcgatggcgcggctgataaagttagccgaaagccgagccgccggagaacgggccgcgccgcgtgcatatgcaatccaaaccaagaggctgccgtgacgtgtatgcgtatagctccagcagccaagtgctaccaaaccccgcttccaacggccggccagagagcgacaccgtggtaaaacgacggaagagaaaaggagtagggaacaaggaagctgctagaatcaatttctttgtatattgcacgtttgcaaatatctagactgggtacacaacttgcatatataacagagtagcacatggattggactccggccgtactacctccgcccccctaaataaattaatttctgattacgaatttggatataacatagttaaaagttggttaattatttttcagtgataagcaaggtatatatggtatcttcgtcaaacttaaaatatgctggcttagtttcttgagagatgcttatataaattgtgtatatgtttatagggatgagtatgcgtatattataagcatctacatttatactatatatgattctaaaacaaattgtttttctttaagatagagggtgtagattgtaagttgtccatgcatacatgcatatgtcaatcttctcttcgcccatgcatatatacttgtcaagctcctaggtggtccaatggctgtcctagttttcaccgctagtgttaacactattgaagacggaaaacccttaaatataaataactacggtctaaggagtagtaggaaattttcagcctcatcttttggcttatgctagcttatacttatacttataagccaaattttaaattttcaatcttaaatttgaagttaattttggagtttttttcatcgtagcttatttttcagcttttgcttttagattgccaagaacacatatataaaatttttatttataaattattttctatttgtaaatatgttgtttcgcttatttcgatggagtccttttttgatggttcaatcactgtatgctaccttttactataaaagctagtagttcataaatatgcagatagtgaacactggtgttaatgtacaatagtgacatgtactaatagtatcctagtttgaaatttcaagctcacttgggtcaaaaagaattttggtagctgacaaattacgcatgttaaacgctcctattacatattcaactgttcaagaaaaggctcttaaaggttattcctaacaactccactatttctttggctcctaagcatgtgtaaagattaaccatcaagcaaacctctggaagaaacatcttggatggtagtatggtacgacctgtagcttttctcaggatgtttttctgtctctcacctgcttccttaattaactcctttccgtcctttgtacttgttgtaatggagtaccctagtttatgcatttacgcaccttctcgaaggatttgccttgcacaaacaggccgggtaggtaaaagaagagtaaattttataaaactatatggtttatggttaaagttgtataacgtcatatattttaatacttgtcatttaactatattttggtactaaaatttcacaaaactacattattaacaaatggatccacccattagatgacgtggttctttccctacatatatttaggatgcaggcatgaaatggtgaatgtttcacttaggataaagctcctgtgtctacattctaggtgaaatatccatatcattttgcggtggacccgttcgttgataatatagttttataaaatttcctaaaactgtaattaattaaatgctaagtttcaaagtgtgtatatttaattttaacttagatcataagatataaagttttgtgaaaaattgactttctttttttaaaagaaaaaagacttgcgagtccagccgagccgagccgagctgaaatccatagtagccaccctccgtggtatatatccacgtctcccttaaacgcaacccctcacccacccatcacacacgcaaaaccaccgtcgtatctattgctgtatcaaagcggagacgccaagccagagtcgacgattcgattaaacaaggaagaggaagaggagagagagagagagattggagtggcattagcgcgagggggaggcgggcatgggggtgctgcggagcacgcagagcatggaggcggaggtggaggagatgcgcgccgcgctagcgctcgcgccgctcggccgccacggcgcgtggaggtcgggggccgcggcgaagcgggaggccggggcggaggagggcgcggcgcccgaggcccgcaccgtgtgcgtcaccggcgggatatcgttcgtggggctcgccgtcgtcgaccgcctcctccggcacggctacgccgtcaggctcgccctcgagacgcaaggttagtcatcgcttgtctggcccgccccaccccgcccttagcagcagcagcagttgcgtgttcgtcgaatggggaattattgccgatgagttggatggtgtttgcttcgcatttgatttgacatcggatcatgccacccgggagttggtaccagtctctgtttgtgaaatctgttttggtacaccggcaaaatcgactgcttatttttaatgcctgcaaaatgcaatgcagttcgattcacgtacgtcttcaattttagtcagagaaaacaagttcaattttattactaatcccttgtcgggcagaagatatccagtaatttagtccaaacttgtaccaatccgattttcaaattttatagtatgcaaagtaccactaccaaattgcagtaataaacgaaacttagattagttagtatattcattttggatcatttatgcattaagtcattgtctctaacccctttgcaccccttgttttagttggtaaacctttgtctttttttgctcaaatcgtattttgtttccgcatgcttcggttcatgcttggtgcgttgtgctgtggtgaacctcacgcgatgagcgtgttgcactttgaatgcacgcaccaaagttccgttccctttttgctattcctttttttacgagtcgagggagagaaaattttttgagtgactgaaccattttgccattttggcacttttttgttggaaccattttcagtgaattttttagtgactgaagcaatttttgctattttggcaaaaagtccaatttttgttccaattcctggaaatttttttgagtgactgaaccattttgctattttggcaaaaagtccaagggagtgaatgaaattgctttggtctccaatttttgttgttgttatttttatttgagtgactgaaccgttttgctacttaatttggaatgggaacttttgcccattaagataatcaacttcgttctttgcagtatggagagcatatgacagtagttgatctcaattcattttgtttgtctagccacttctggtatttggaggttccacgcatgatgtttggtatctccagtcctctttatgatgtaaaaaatattaggattggtagcatgttgcatcaaaaatggtccgcaacgtatcgccatatatcaccttcagtaatgtatctttcacaatctaaccagccaagtcactccctttggaaaacaaggacctactaagtcatgcgtattaaaggagatgtgacatttttctcccctgctcgctcactccacttgtgtgacatagggtaatttggtcggcgaatagagcagaagcaaacttgtcaaaacaaaacagcacaaataaactgcaatttccacagcagcacacaaatgtatttgtttctagtggtgtttacagcctactttaccttgtaataacttacaaggcacacaggttacaatctcctttgacaactatgaacctttttgttttggacagtgggaacctggggattgcattagcacaaggataaggtcctctcttctttatcagtatgctgataggttcacctcatcttacaaccttctcaaatggattgtttggatgattaatccgacaccaaaaggactgctgatgcaccccttcttgtcccatagctgttgtcagttcaaaacgtgtaccatgccaatgaatgaggatgagaaaccgtgggcactaagttagattgtaattaatggtaaactgaagtgaattcttctgaatttttttttctttgaagctatcttctgaaacttttcttttctatggcagaggatctggacaagctgcgagagatggagatgtttggtgagaacggcagggacggtgtctggaccgtgatggcaaatgtaatggacccagagagcttgaaccaagcattcaatggttgtgttggtgtcttccacacatcatccctcattgatccagggggcatctctggctacacggtgagttgcttgacctgtgttagcgttcatacaatatgtcagataagttcccctgcttatttggttcatctgtggaacaagtatgcaatcttgatagtgtcatctctcctacatattaaaatgtatgagccacatccacaagcatcttgtctctattctctatgaatacaagagtgcacaatatgggataggtagatgtcatacctcatgaatcaggctaacacacagcatcacaaatcacaatcctattagactagtaggatatagtttttaattaaatgcatttatagttagagtacactttatgctggtaaatacacaaatcaaaggtaggccatgtgttctagagcagtagtgctatataactgctgaaattattgttggctattgacattatgaattgaccaatcatttcttctccgttaatgggcaagacttgaatatctttaacttaaggatgataagaaccaagtcagaaacaaaagtatctgttagccaaggcaactgactgatcttttggaaaaaatatcaacttttttgtggggcgaaaacattatcaacttaccatgctgaaatatcgaaaaccagagaaaagtcattactcattactggtctatatgtcccactaacacaatacaaaagtatacagagagttttatagaacttaaaatttgtaattagatgcgatgatccaactaggtgttgctctttagggctacacgaataaacagtgcctcggactaggtggtaggtatagcaccaaatataaacccataaataagtagcataatgcttttaagcgtggaccagtgtttgaaacttcaacaaacaaattgactgagagtggtaccacgtaatctttattatatcatatatgatgttgccatgtactttaggttcatctagattctaatcatagatatggtgtttggtttattggttctactcagcatatacagggaaacatcttttagtttttttctaataaagggggaaaatccagcttacatataaataacatacaagaaaaaaaaagagtgactcccttagggcatcagagtattgtctgcacaatcaacacaatagggagaaacagcacaatgacattgacacaatccctacggatattgcaaggaaattcagacgtcagtcaggaacagcaaagagattaaactcaacaacacttgtacagttgtacccactacataggcaatcgaagtgttataggagtcctgagtccatccttacgcctgacatcttttaggtctatcataccgtatatacagtgtgatttgcacctgcagcctataacattcatcctgtgatgcatatgtttcgaagatatgaaaggcagcccattactatctcggttgcagttgaaagctcagccacttgacgaacagtacgaatgtttgttcatcgcttctctcttttctcagttgtagtaactaacagcgcacttgtcagactttttggtcaagactcaagaatgacctgaacaaatcaaatggttgggtggtctattgccttgttccttttgacattccctgcaaaatccatactatttttgcaaccgcatgtttcactattcctcctgtttgcaaagctaatcatactagataaaaaaaaaaactaaccttttcatatatcagatatacttttgcctttattttacgatagctcattatgaggacttaagaggcagctgtggttctagaacaattgctttgctagatttttattagaataggcttgctagactttccagttttattatctatcacagaagtaatttaaaaattatactccctccatcccaagataaaccaacttcgcatgggatatgacatatccatagaggttggtttattttgagacggagtgagtatgttgcatgccatgattcattgttagttgggcagtcaaaatcccgttttagtgagcatggggcattgccatagccttaccaccagatgagccaaccaaagaatccgaaactgattgggcatctaatggtttcagtgcacttgcttattgacgtgatccactgattcctctatggtccactcatgtcaacatacatgttgtagtagtagtagttaagtttcttcaaatatatatttttttgggcaagttgtaatgggttctttaagtttgttgtaatctatattcaaagcctggaacgctgaaaaccgtatggtcttggccagcttcacagaaagaactcttgcaatttcaagtttgtgtgataaaagaaaatgagcaccgaattgaaatgcctttgctttcctaacttgtccacaccaatttcaacagaaacacatggcgattctggaagccagagcggccgagcaggttgttgaagcctgtgtcaggacagagtcagtgaggaagtgtgtgttcacctcatcgctactggcatgcgtgtggaggcaaagctaccctcatcaccgtcgtcgcttccccgccatcatcgacgagagctgttggagcgacgagagcttctgccgcgataacaaggtgagagaggacaaaccaatctcgaattctcaaatcaatattgctgcgtttaaaattaaaagaacataagaacagctaggaatcgaagcaagcattctgaatttctaatggctgggtcatgacgaacattttcagctgtggtttgcgctcgggaagacgatggcggagaaggcggcgtggagggcagcacggggcagagacctgaagctcgtgacgatttgcccggcgctggtcaccggcccaggattccgccggcgaaactccactccgtccatcgcctacctcaaaggtcagtcgatctcggcgaactatactactctctgaatcaatccgatcgaccggagctaagctctgacggacggcggcgcgcggcggcgaactgttcggtgcaggagcgcacgcgatgctggcggagggcctgcttgcgacggcggacgtggagagggtggccgaggcgcacgtccgcgtctacgaggcgatgagcggcggcggcgcggccggcggccggtacatctgctacgaccacgtcgtccggcgcggcgaggagttcgccgagctgcagcggcagctcggcctcccgatcaccggcgtggcagctgcctcgcggcccggctactccgacgacggcgacgtcggcggcgacgggcggttcgcgctctgcaacgggaagctggcgaggctggtgtcctcgcggaggaggtgcacctatgacgtctactaccccgcctcgtacgactaaaaattaaatgaaagcgtcgagttcgtgggtgttgcgattcatcttgtacagaattttggtgcgttaataaacctagctagatagaacttgtacagtacaaaacatgaatatggatagaaattagaagtagtagaagagcgatgagcaaacgccacagtgcggccggaagattgcggagaaagacagcgatctgcagaccatccaaagtcgatgactccaacgagccaaaccaaaattttgttcgtcacgtctcgtagaaaaagccaagaaagaatccgaagatcggagataaggccaaaattttgtcaaatgattttgaccaagtgtatttggatggaatactctcaaaatcaatggtctagtggttcagttcgtcttgggccttgaagaattggcagagtggagatacgtccgatttgggccgaaaacgccctttcgtgacggcccagtagaattcgagaaatcgtggcctcatgggccgagttaggtcgctgcaaaaccgagaccgtctccttcctccgcgcgcgttggcgcatttggtcgagcggctcacgggcgccactccttcggcggcggtcgtggcgacgacggcggagattttggccggacagcggccgtagcgcaaggcgtggagcggagcggggcagtggctgggagcctggggtcgatcgcgcctccgccattgccatctacttgaggactccgcctcccgcggcggctccaatgctccgtccctgttccgcacgggcttctgctactccggcgacaatgacttcgcagccggtttgcctcctcccccgctccaatgattctaccctatattcgccttgtggctgtttctactactgtgttgctagaatggaggggatccccgatttccccgtagtcaaatcaaaggggttagggattcgattgatcccccacctatagcaatgtctgaaattctgattagtgaagtagtatattttattatttcgtttctgttattttatctacctactgcgatgaacatgataatgattctgtttcatccatcttaatagtactttttttttgagaaagagaggaatggtcccatttcattaccgaaattgatagcagagtgactagtactacctcgtatgtatgcatgatgcatctagaacaatgcatgaacactatcccttacattatcaaattcctacatttcacttcaagagggaagctggtacatgtcctgataaccatatactatccttgcataaactgtatatatatacaccacacgatgattgtgcagaaagggggtcggaagaatcacgacgaccaccctaaccaatgaggaccaggagtatagtatttcctggatcacagcatttccactcattcagagagtttcaacatagatcataatctgacatcacgttgttcccagatggtttgccgatctgcaagcaggatatgggagggatggtgggggtggacaactctccaaaggcttgccagcagaatgggttgtacaggtgatactgtggcactatcaggggtttgagctgtattccagtaagagtgatctctgaacaaggcgagctatcactgcatgcaaaatgggcaggcttgattgtgaaggtccccctgatattctcgtactgaacacctaaaaccgccactgctgatgtttggtttctgcaagttgttctgtcacagtaaaattggtctattatgataggtgtttgaacttctgacacttgtatgtttgagaaccttatgccttgaaccaaccctgaacctccctgcataggaatgtcagtgttttttagctctgtgtatatggtggtcattgttggactagtcacatcatctaccagattatgcttacctgccaagttttgattctgacaccagtcattgttttgaacatgttgacatctcttacggtgacattggatacacatgcttttgtgttgtaccttcctagaccaccaatgctgatcccatgccctggtccacagttcacattatgtatgtttatgtcactgcagcctgtctggatggaaacacaatcatcgcctgcatcacagagagcaaatattacttcagatacttgtactagtgtttttagctttcccttagtcctgaatcctgtcggtttctacaagtgagcactgaacagatcaattggcatgtagtttatttattctatatgttacctaaagtaattaattggtagactttgtatgtttctgtttgatgccgatttctccccaccaagccttgccaaaatttggtaacagcttgaccaaacaatgccaaattatcaagaaatgatttatggagccaaattggaatggaattttgtcaatattatgaagcccaatgcttgtcgtttctggttagtgccatcaaaatttggtgggggcgaaagtttgcagctattgccatcaaatcaatcagcaccttctttctttattttggcaaaacctttttttttgaaaaaaaataaatcgagaatgcagcactatattcctatctaacatatcacatttgaaactatactggcttactgctttgattgagttaatgagagcattaccgcaagcgaggttagagtggtgaatgctgacttgtttggaattttgcaggtgtattccatcagtgttgggactgttctcaggcgatgagatggtcaggtcatgaaccattactccttgacagctatcaaacttgagatggcactgtgagctgttaacaatggtgataccagttactgtgacattggaactaccataaaacctcaatgcctgcatcaatgtatgtaaccactgttttaatttgttccagtaggcagttaccaatatgttcaagtatacaaatgcaaccaaattttgcttactgtaggtttaatctgtggcatcttctccagctccacattgtactgttggaaagcattcaaggtaagcaattaaatttgtctacttttgacttgctataagtgtgattgttatagatgatcaggccttacagcatcaacatcatcattgtcgtcgtcatttggatctgaataggtccaccattcttgccccctaccatttatgacaccacttccttgaattgatattccactaagttttgtgaattcaagccattgaagcaaaccagaaccccacactcttgtactggtttgagctaaaatagttccatctagctgcaaaatggaaacacgatatttaataacagcatctctacttcttcaatttgttctaaaatctggatgggtacactatagaaacattccttttgagctcacatctttcgacaaacaaagatacactcagttcctgatggtggttataatatggttattaaacactgcaggcactataataatattgggccaaaatgaaaaaaaaaaagcagcagtttttagtcagaaaactcccaagtaaatatctcagttgagttgaaactgatatatatattgaattggtcaagattgtaaggagtgaaatactacaaccatgtcatttgttgaataaagtattctggtatatatgttttatttcaagcaacggaagacacttattcctgtcaatgatatgccggaatacacattaggacaaggattagagttacctggaacagaatgtttggtttgcagtaaggcccagaaaatgagattgggccaacgacaaactcaagttcagatggtacaagaactgtagatgcctccaccttgcatgctgctgcccatgcttcttcaaaagcctgaatacatagacgataattaagttcaaccttgtttggaaagaacacttcactgattgaatatgaacccaagtatatgctcagataaagtgtagtcagcagtctgctatttcttttagtcatcgctagaacatctttgcagcacgtaactcccaggaggagaaaggaagcctttcttattttagaaaatacattcttatgctactggttgaattttaggataatttttcaactgataacgtggagtaattgaattcagtgttgattttcttgattcttttcaataacaattggacacagcatgaactgacaatgggaatcaatatagttctatactaaattcaaggatagttgtattctgtgataatcagaaaattgcatttgttagcccatgacatttctggtacagtaaagaaatccaacagataccacagaaatttgtactcttgtcaaccattcatctatatgataccaatttttaataatttaaccccaaatcaatgcaatatcgagtaggatttgtaaagacatgtttcttttcagggttgcacccaatcatgtgagaaaagaataatataaacataaaattcaaatcaagcttgttgtgtcatatacagtttttcatgcaagattcctactctgagtaacacatagtgtaatattttcaaaggccggtacgcttcaaagttcctgttaagctctttttaattttttaaaatagaatttcggccatcttatcactgcagcatgttaatgtgaaatgtattaccaaggcaaaataaacatattcttatgctataagaatgaattcttcacaattgagaagcaatcccaatggacttagaactttctttgaagttccaggaaacgcagcatgctatcaggtattgcagtctgaattatacattctgcacttgagcctaaagaatggctagctgattgtaactgacaatagaaactgaagcatatcctaatgttttaaaaaacaaatgaggaactcttaacccagaatgaatgatgcaggtggcacaattttttaagttgaaagcagaacactttgagaagcagtgcggcagttacctgcgtatcatctgtaactccatctccacgggccccaaaatcaaccacattgaagactgtgttctgtgattgggctgctggtggctgtggtggcggcagcaatggaggcagcggcggtggcggagatggcaatgtatgaccacttccactgcttggtggtggcattgttggagccggatgtcctttgccctggacaggtctttcgctcgggttgacgggcacattcgggcttgtactcgggcttggctggtatggatcctgattccctttgccatattgcttgtgggaattgttggtctttcctttcccttttcttcgcagcagagtgctggaggatgctctgttttgcctccagtgcttgccacttcttgcgtcagataaactgacattggaacacagaacaagcaagacaaggagaagcaggaaggtgagacctttaatcccaagccccatctttgcttttgtaactttgtatctctcttgttctgagagaacagtgtatgtacgtgtttggaaggaagataggtgggtgagggagagggatagagtttgtggctttgaggagggaaagagggggtttaaatagagacctccattgtcatctttgcttcctcaaggctggagcagagaaatcggaataaaaggagggcttttctttgggaccccaactcacgtgcatgcttgagaagcatgaattgcattcttgcagctgcacggagaattaaaggtgtatacttgtagtttgtgcttttgtgcatcaccatcacagttttatcccttgtggtttcctttatggtgttctttttgtgagaatcggttggagtaatcacacgccctcattcctcaaggcttggccctgcccacttgccatagttcagaaaaactagacaagacagcttatctgtacttatgtactaacggttcacggggtagggaagtggcatgtctttgtgcctacatggaatcatttgccactagtttattctttgggtagggcatgataaggcagccaggtgattaaactgacaacatgctttatataccagtttgtttaccattgtcaggctattcttgtcacaattttgtcccagactcccagtcatgagaatttacctatatgtgggtcttttttcatgcatgcttcttctctaggaaataacccgtgagtctcattaatacaactactactgttcaggtatccacctcatgatagacctcgctttgaatccaatcatgccctttacacgcaggaactcccaaatgcaggtaatactatgtactatgttgtaactttcttttacaattttcttaaccatattttttgtgaggaattttcttaaccatattattttaacagaatttatagaacaattttgcttcttgagtggctttacatgttcgtcattgcgcgcaacctcaatttttattattgcgggcagacacttgaatggatggctggctggccccaagagtcatgggatgtgggaagcatgctaagaagatccaacatatccctcttggcaagtggaaggtacacttggcatgaccattttctgattttcagcatacaatgtaatgtgcatttataagcttattagagttcgggttttcatcaggatcactggtttcctactgtatggctaaccaattgccgttcacatgctcgcagggatttgtcacgggaaggagtggccggaccaactgccgctaccggactagggagaagggccccccccatcccaagttgcccaacgccattacacccaaacataaacaaagccaccaacctctcctctctagtatgtaccatccacgtcgccctgctaaatctccaatctccaatcaatcatccattcatccatgcaaccacccggccgcgcgtgctggcacgcatcagcaccactcatttgccgtcttcaactctcacaagtaagtggatgcgtacgtgcgtgttcgtggctgccgaatgtggcaggtcatctgcagaaaaaaaatatccctgcatacaccaaaaacacatgttgcgttattggctagcttgccactcctgcatcgtgttgcattgtttgctagcatgcaattcctgcagcgtgcgccactacatgccactgtccatggattaacattggatggatccattaaacttacacaggcttaatgccttagcagcttgcatatgtgataatgtggcatttagcttacacggaaacaacatttgtaacattgtcatgcttcaggttttcgccattatgtatatggccaagatagtcgtcaccggacaggagctgttaagcaagcttactgtcagcagcttgggatggaaggtatgaatacttctttctgccacatttttccattcaaggccaaaaccgttaacatctatagcaagtccttccaaagctggactcgagctgacatggtcatcgtaagatcacagccaatctgctgtgtcctctgcgttagttgtaccagttgcaacaaacccttaaactatgagtagtaactactactagcacccataaaatagcagcagttacgtaccaataaacatatctgcattcaacttacataagttttcttctgtacctgaattgtttggacttgagtggattaacacatcaggcaggcaacagaggaggaggtgtcctagcttttgttggctcctgagacatgcgtgcagaggattggtggctgttcgtctctcgcgttcacgggctgctgcgtcctgccaaatcggcccgattcgcctgcgctgtaagtgtctgtctcttcccccttctgaacattattgaatgagacaccagccgcacatccaatccaccatcgtattattgcaacgccctcgctgaattttcagtagtctattactacctccatcctattgtaagtgtaaccatggttttccgcgtctaactttgatcatccgtcttatttgaaatttttttaaaaaaattaaaagcataagtcacgagtaaagtagtattcatgttttatcatctcataacaacgaaaatactaattataaaaaaatttcaaataagacgaacgatcaaagttggacgcagaaacttatggttgcacttataatgaaacggagggagtacattacaatctgcaatttgctggtcgagttagagataacacgagtttgttgtcagtacgggtagcaatctagcagagtcttgattgggatatgccaacaatttgctgatgcgctgcaagagtacactagagcaacgtccaaggccggccggccggccggcattagccggcacagcacgggccacggccaaagctcgtctctggcttactccggccaagttgcaccggcgattcatcgaatctgccgcacgggtgcatgtcgccgcagtagttcgctggtgcccgtgatagatgcggccgactggccgagcagccagctgcctcccaagttggtaagaattggtgggccgttattttgtttgggctggatttgcacgttggtgccgggcgcatctcaaatcctgcatgggccaggctgtattatctggtaggccatgatatgttccggccttgtggccttgtgggacagatttttggatcaaatttgttcacctgggtacctgctcttggtcaaagttggtggcagggcagcagcattttaacaaatgggaatgtgcagacactgacggtggtccccacccagtagaacatatatagggcctactgaccttactactccagctcaaccgtatctatggttctctatacctactctcgcatgaaaaaccacgacagctgagctacctcggacgttgagcttccctacactctacgtacgtacagtactcctatacagcaagagttctgctccagtacgtaaaactcctatacaacaagagtactggacctacggcttgtgtagtgtgtactcttccctttggcacgtactagtcgattactgttagggtggggtactgcctacgtgggccaatgccttctggccacctaggagatgatgttgacgtggcgaaggaggttgggtgtgggatgactggtggataaatcgctactgcgtgtggggcagtaagagcaggttcaatagtatcgccggtcgatatccatgtccatatcagctaacagttaatatattgagcaaattattcagtacatcacagctctcaagaaacattttttttcctgtgggacccaactgacaagcatcttttatagcattcatgtcactgcgtgtggacccatgaccatttttaaaagttgaaaattcctatcttgcaggcttttcactttgagctcacgtagagttggcgataaaatagtcgcccgttcatatcacctctcttcttctcagttttgctgagatggcggtactattgctggttattgtacctgttctaatgccgcttggctggcatgcagaaaacatcggtcactcggacaccaccaagggtcaaggaaagggagaatcagcatgtctcagttctcaagatgatttgcagagctcactgggatcctctgtgcctgccaggattttcgtcaaagagatgcaagtgctaagtatatcatggttatccctctaagaccaggtacaatagaagattattagccagctgcaaatatattttaataagataaaagacgagagagaagagcagcgggctacagatctgtaaccagctgcaggctgcagcacggacttaaagacgcaatgtgtgcatgacaggtgcgaccatatataaatagtatagtaagcaactattgtattaattgtctattagatcggctatagatgaattggaggtagtagtgggctatattattaaacttgctctaagagcgagtacaatagcaagctataagttaagctgtaagcatatgtggagaagagaagaaagaagagagaaggaaagcgggctacagatttgtagccagctgcagcacagactccaatacattatgtgtgtatgagatgtgggatcatatattaatggtgtagaacgagtataaatagcatgctacaagtcagctgtaagtacacgtggaggagagaagagaagaaagagaagtaaagcgggctacagatttgtagccaaatgtagcacggattccaatacgttgtgtgtgtatgagaggtgggaacatatattaatgatgtgtatatgcttataggtaactattgtatgaatgagctattaaattgactatagatgaatgagctattagattgggcaacatatcctatgcacacaggccctcacgtgtacacacgtgcacaccaactaaaaaatgtcaccaaaaaatctagaaaaaatcatacacatactttcaattgtattacacctagggttaaaatcttaacgtcaaattcattatattttagccgtaacaaaaaaaaacaaaaaatctgacagttttaaggttacaattttgtcagaattttatcttttttgttattctctatgtaaaatgaatttgaagatgcgactttgcacgtagatgtaatactattgaaagtatatgtatgaattttcctagaattttttgtgataatttttagttggtgtacacggtgtgtacacgtgagggcctgtgtgcataggatacgctcacattagattggctataaatgaattggagctagtagttagatatactattaaacttgttctaagagtaaggataatggtagagctcaattactaatattagctcatcttaaatctaaatatacagtaatagattagttataaggttggctacaattttcttctctcctctctctatctcttagagcaagtattgtcttataaatgtatattgtggtgcagattttaaatcctataaatgcttatatttataagagttttataaacaaaatgcttatgttttggaagagatgagtattttgggacggagggagtatataaggaaccaggagaattcctgcgggtgaggtagacagaaacaagaggagtacagaatttgcatgggtgaatgtcgttgtataccctagcaaatagcagcaatacatgaggtagggtacaaagaggtaactgcaaactgcgtacctctaactatctcaaaagatgctctccctgtatatctctcgtgcttaccgcataaaaccattcttaaagcaatctcgaggcctttttaggcgacagccttttgaacgacgatctccttggaacaaccaattgataattgtcctctgatgcattgtaaacaatgtgctcgcagttgtactacgctaatctactgctcgtacttaatcaattgatggtttagctgaatgttttgtgatcacacgtgcacatccatgtgagtttcaagtttgtctagtgcggactagaggttgggcttgataatgttgcattctctcctactggagtatagtacatttataattttattttcaccggttttttcaccatcacattttaggaatagatagcataatcattaattacaacttgcggttcatgactcctagggggtgtttgggaactagagactaaatttagtccctctcacaaaagtacaagtccctatggtagggacttatgtttttgtgagagggactaaagtttagccccactttagtccctccaactaaacaccaccctagagtcttgactttatactacgctattctttgaactttcttttttttgtaaggcatttgaattggaaatttcatactttatgaatttaatcaactgttaaccaagatataagtacatttaatttgcagtacaaactataccaataggtacatactccctcactcataaatattggtatgcataaattaggaataagagaaaaaagattctcttccagtcatcttattgattaagtgtttgtttactttgttgtcaatttcaacattaccaaattttagcaatgctttaatttttataagttttgacgttgtcaaattttgatagtgttggatgtagtttgatgcctttctaaaatttggtagtgtttttgtgagaaccaagttttgaaactactaaaatttagtaaaatgatattggtaaggtaatgtttagtttgttaccctaccaaaatttactaggatcgaaagtgataataaaatgaacgtaccctaaattttgagctttgaattgcatgtatacccctcttacacaattgattggctgaaaatgcttgacctcccgtgcattgaaatcattgtcttgaatgtattcgggaacagatgggggtattcaaattagttttgcatgatattggtttcaattattactcctgtactacttattctatgaaaagtccatgttaacgtttaattttgaagaaagttttaaaatatgtagttctgtaataacgttagcgttaaatctataattttgtgatataatatctttaatttttagttttgtgatagtttaatcaaagtatatgtggttttgtgaagtttactctaaaattaaagtttgtcatacaaagatataatccaaaagtagtataatttttttttgaagactcggatagcactagagactagagtccatgtgttcatctaaaacagacctcagggaggggaggaaggcaggaagcactgatcttctccgacacatgctattctttccatttgaagtgtcggaatccagtgcacaaatcaaagagctttgatcaagacagacgattagacgaacccttgaacgccatgaaaaagattgcgtg

SEQ ID NO: 66542 - DNA, 1683 bp, Oryza sativa
agacacagactctacctgcaaatgcattggtaaatgaagttaggatatgcttatactaacctgaatgtggaacagcataagtgaaacaaaaccacaagaagtaactctcctaaagacacaaacgtatctttctgtccaggcactagcaaaatagtgtgacgattgcattgcatgatgtttatctttcttatatatctagcaaaatacccatgcgttagcaacagattccacaaaagtataccgtaagtttctaaactcgaaaattatatgtatattaatcaggggggaatatatataacttgcaaccgagcatcaatccacaaatagccaaaccatgtgcataagtgatctatttgttcactcgcataagatcccaccaactctggaggtgatggtgggatagcaggctcatcatcgtcactattcactatgatcgctctactgtataggaacggaattggagaatgtcttttgctaacttatggatacaaggactagatgttaaaggtacaggctttggtttatcctttctccattaaactccttgtataagccatttttaagtgtgacatgagcacttgcagctacctaggggtgtaagtggcaaccagcgaaacccacttattttgacctataagtgggttcgcggctgacccacttacacccctacagctaccaccttggtaggtttggcctgtcatatactagtatcaattgataaaatatagaaaaatcatgcattgatattgctaagctgctctgctaacatatttaaatgcatcaaatggatccacatatattactttatcatgcagaggagagagaaagttctctaaatttttagtgcccaaatgaaattcccatgtaaaattattcttgtaaaaaggctttgtttctaaccgaggaagagcacctagatgacatctataagattgataaaagtgacaatgaaaagcccaacaaatgagttcacaagaaaggatggtttaggatagcaattatctccatctttaacttaaaccaaaactaaagaaagtaaccttaagttcctaaaaccctacagatctagatccacaaacaaatcaccaatatttttttaaaaaaaaaacaacttttagtaggaatgaatcaggtttgcaatatcgtgcggcagtgcggctactgctcggttacaacggttacctcgcacaataatcctcttggtttttaaaacctctcggtttttgcggtaaccatgacattaccacagtaactgtgataacaccaggtaggggtaatccctccccaaatggtaaggtaaatcctcctagatccagtggaaaatcataccattcattaaaaaaaaaacaacttcagaccaatagtggaataacccctgactctaaccccaaacacatgacaccctcaaccactgtttttattaaagcacacgatcgaagtcatgtgactcaccagagatcgaagcacacgagttacactggcgaatggattcacacactctctttgtgctgaacccatctcacaaagaaaatcgccgagaaactctctctataaaaaagcctcaataaaagcaggagaataatgattttatatcaaaccggtaaaccccatccagcgcgcacatggtttggtcttgtagaggttttcttttgggggagagaagggggcaagtcttgatttgtt

SEQ ID NO: 66543 - DNA, 4797 bp, Oryza sativa
acttcttattgcatatgccagccttctttggcgataattagttcaacaaagagacagagaattttagtagcacttttaatgtatgtttgctatgtgcttctctgtcaatttgtaagagacaaagagagacaaatctgatgtacagtctaaaggttcctaaaattgatattgcatccatcaaacgttacaaacatcagcacggctggcataccaaatgtataacagtgtaagagacccaggatatcctacctagtctggccattatatttacatgaccatttcctggttcaactattatggatgctaatctcatactagcatcattatattagagttactagctatgctagagtagtgttcgtcatgctcagcagttcatatgtacatgattggcttggtcgttataactagtaagcaaaccttacaaattcacatacattgcacagaatgtctagcaatgtttgtaaataactctttatttctcttgatacaaaaatgcgctccttgcgtattcccaaaaagaatgtctagcaatggatcagacgcttgtgtagctcatgtgtgacacatggagctaggaataggatgatttgctagtgctacttcctccttaattcatccctaaaaaatgactatgatgagaaaaaaaatattatatgctagcttttaaatggggacaaaagaagggacgaacaaatttggtgatcccatactgatacaaattgtccatctagcagtattttgaccagcaaaaactcacgaagtggcatcagcacagcaaagattacttcaccaaaaataactaccacgcattcacagataattggaacctatactccaataccaagccctaagaacgcagatcgagccctcgtccatatcaaaaacccacaaatacgccagggcatgaacaggaaaacccttagattcagcacttggcagccaaaggttgacgcctttgggccaagaacactaccccggagctaaattcacgcgacctgcggcctcaaaacaagaagcgacgctcctctagggccagagagaagattagggggacggaactcaccagtggcacccggacgcggattccggccgcgggccgcggcggcgcgcctccggcagccgcatccattgccggatcgatccgggcaggcaagaacccccgcgattcggccccccaggagccaagaacccgcctctccctcctctcctctcctcctcgctactacaggaggaggtcgccttggtttcaaaccagcagcagcagcagtgggatgggggaggccgcagatgcaggagatgctctcctctcctgggagcttgggttggtttggcttcgaatcttgcggcgtgttcaggacttcaggtcagtacggctcgagctcgagacgtcaaggttctcaagactcgtgtggactctcgggcacatgagacacacgcacagtccacggcgtgttcagacccgtgtactgcactacagcaagggctaccaccctgaatgactggcttcttctgttgaagcttggaaaattgttttgccctgatataagtgattttaatattttattggtgctgtttgaccactcgtcttatttaaaaattttatgtaaatataaaaaaactcgtcttatttaaaaattttatgtaaatataaaaaatgaaaagttgtgtttaaagtactttaaataataaattaagtcataaataaaataaataataattttaagttttttaaataagacaaatagttaaacaatacaggtaaaatgtcaaaatctcttatattaagggacgaagggattacgttttatcttcgaagaattgcagtctcagtagaccccattgtaatgtttcttttcctcgactctaaacttccgtaaccaaaacctagttagtcatttattggcaaaaaaaagttcgcttaagggcctttctagtttttgttagaacatgagtgttctttcataacacatcttgtaagtgaagatttaattcctgagtaatatatccctttcccccaaaaaaaattcacctcccttatttttcgtttacatgttttttaatatgtaaaatagtgtattttttgcaaaactttatatatataagttgtttttttaaaaggtaaatgagtccactttataagtttataatagttaatgttcaattaatcatgtattaatgttttttcgcatgcgctaaaaatcatgaacacagccttagcttttaagtactactagaataaatagaattggggataagaaaagtcgtactagttcgtcgtataacggaatccaaacaagataagaacgacataaaacaaagcaattatcatccacggcataatagcttgaagatgtactttcgtgtttagtttgtatggtatatgattttctgaagtgttgatggaatttataggtaaattataaattagtaaagatggcttgattactattttgcttatgacagatatgactctataaaagttaatcgcacggctataataaaataagaaaagtaaaaattagatctaatagactctttgtaaccctcaataaaaaaggctaaggcagccatggctatggtattggtgtggaatcatgttgatcaatgaaaggtgacgaaaacctattgaaaaattttgttagcaacaagagatctaagaatggtgcaggagtttaactggatcaaaccgattacttaatataactttttatgttaaaacggattcatggtgtgataataaaatgcctcaaaagttctattcatatgaacattgaataatgtttcacaatttatttaaaaaattcaaacaaataaaaggtacccttcccaaaaggtttaggcccctttgattcaaaggaaatttataggaattttagaggatttcattcttataggaattttttctacaaagccctttgaatcaaaggaatgaaccatatggaatcctatgaaattcctatggaatgcctcttcacataaaagttttggaggaattttaacaagaggtagaacctcatggaagaaatcctttgagtctttatctctcctcaaattcctgtgtttttcctgtggtccaatcaaacggtcattattatgtcttttctgtgttttgcaatcctctgttttacactttcattcatatcagaatcctatgtttttcctattcctcagttttttcattcttatgattcaaaggggcccttaacagtggcatatctacatgttgagaataaaaggcaatagctattaatccgatcagatatgcaatacacattttttatcagtacatacgttagctcattcctttatttgttttgtttatagccataaaaacaaacttcgtgcatgaaacagtcttaaactctctagaattttattaagaaaaacctccatttcgggcccctttaaattttaggaatgaaaaaacggaggaatagaaaaaacataggattctgataagaatataagtgtaaaacagaggattgcaaaacacaggaaaaacgtaggaatgatcgtttgattggaccacaggaaaaacacaggaattaaatgagagataaagactcaaaggattttttccatgaggttctacctctttgttaaaattcctccaaaacttatataggaagagacatttcataggaatttcataggattccctagggttcattcctttgattcaaagggctttgtaggaaaaaatcctataggaataaaatcctctaaaattactatgaattttctttgaatcaaaggggaccttcaaatggtactcctatacaactgcaatttgatactcctccatgtagaaacctccatttcaaaacagtgatcctattcgaaaacttcacgcctccgacacgtggggcccaccgtccaagtactcacatgccacagcagcccacgtactccgtttcctctccagtccgtccatccatccacaaacggctgacatgcgggccccacccccacccccttgttgtccaggaagctccgcgaacgaacaaactatccgtgggcttccttcctctccagtacgcgtcgccccgccacgtcagcgactggcacgtggggcccacgcgccggccaacctgtcagcgacggacagcgcagtcctcctcccctccaaccacacgcagcgaggggagaggggatgggcccacgtgtcaggttgccctcccgtccagtactctgatactctctctctctctctccctccctcccgtgtccacagtttctctctcttctcttctcttctctctctcagtctcactctcccaatccgcctcggcccgagcgcgcgcgcgctttccccccctcgccgccggcgacgagctcgaggcggcggtgcgctcgcctacctccggagggcggagcggggggatggagcccatgagcgtggacggcggcgggggatgcggcggcctggacacgcagatcgagcagctgatgcagtgtcgcccgctcgccgagcaggaggtgagagcgagcgagcgagatccctctgctgctgctgctgctctggcttttccgcgttctggtctcgccgttcgtcccgccggcgatggctccgcggggggcgcctcgatctggggaatatggtggcgctttgatctgttcctagggttttttttgttcggggatgttgggttggggggttcggatttgccgtgtgatccggtggttcgcgagcgattggcgcgtagtttttgttgtgctgggtgatttggcggtttggagaggggttcgagtgcttgtttgttgtggctggcgagggcaacttggaatttggtg

SEQ ID NO: 66544 - DNA, 13898 bp, Oryza sativa
  unsure (1)..(13898): unsure at all n locations
attgtaacatgaatgacgtcccagtgtcatttaacatgaatgagttgacagcattgctttactagcatttttttatttggtggaataagatatatttcaatattgaaatgcaaatgctaacacattagatattccaatgaaaaaaaaaaaactataaccatagaaatcgtctcacctgagccaacctctcgtcacgcctggcaatcttcctctcacgactggccttgctcttggcacgcttagcctcaaactggtcagagagtgtcttctctcttgccttctcagccttagacttgtggatactttccatgagaacacgcttgttcttgaacatgttacccttgaccttcatgtacatgtcatgatacatgtgcttgtcaatcttcttggcctcacgatacttgcgcagcaaacgcctgagcacacgcatcctcctcatccacaggatcttggtggggagcctagcctccctggtacccctacgcttacctgcaaaatggcagaataaggaatacgcagagacattttcacactaaaataacaatgaacttaattgtacacaacgcaccatagccagagtgacgtcccttctgcttggcctcatgggctctccgtgcacgggacctggagtgaatcttctggggcttcttgataatgaacccatccttgaccaacttacggatgttctgacctgcaagcacaaaggaaaaaaaatcagatagccttccaagaatttcaggcatgtgatatgagtcacagatatatacagggcaacaaacttcagtatctagaacagtaaataattaataggatattttattggttcttgcaggaaatgagttgtgacctattccaataggacattacacaaactcgcttgcagataagctacaccataattcatacgctcagacaggatcataccacagttgtacaaatggtgatgcagaatcaaaatgaaccaatgagctttagaagttggaattgcaattgcaaaactgacaaaaaactgatcctttaatggtaatcatcatttgggcatgaattgccagcatcctaactgatttaggtaacgaataactcaacgaagaagcacaaatgcacatgcatatctaaatgcgccaggcatccccttgtctctttgtatattaatcactatagaggacagttagtcacattcccagaacagcgccttggattagaacccctaacgacaaccttgatcaatcggtaacaacactgcatggtccaatctagatagcatacactccaaggtcaatatactggccatttctctaatgttctcttccaaacaaatacacccagcacaacaacctaacaactcctatagaactgggagcacgcgattcccacgaagcaataaaatattcctaccagaatcgccgggggcaaaaattttcgcgcggattagcagcatggcttcagatctaagcaaatcacgcatcaacaccacacaagtagcaggcacagaacatcatacggtaggggcaaggggagggttatgggggggagggacgaggaggggagttctcacgggagttggccatggagatctcgttgacctcattggggtcgagccagaccttgcccttgccgcatttgagcacgctggaggcgagccgcttctgcagcttgagggaaaccatcgccgccgccgccgccggcttcttacctgtgtggagtgtgtggtgaggggggtgcaagggttggccgcgtgcggcgccgggggtttatatagtgagaggggctagggtttcagcccgagcggggagactcatgggccttgggcccatcagtgtgttggggtttgcagcgggaataagttcactttatgaccctcaaatgtccacgaccttaaattacaaaatcggatatctcgacccccaaactcctaaaaccggtgcatttgactccctggaccgttttgggaggcggttttgctgatgtggcgccgtgcggtgcctacgtggcaatattgaccgagttttcggtccacgtagcgttgacgtagcacctacgtggcggtagaattaaaaaatatgcatgggacccattagtcattcacacaaaaagaaacatgggcccactaacatatgggacctatatcctcaagaactcatgtcgacgatactgtggggacgagggctactagttcctaccgcacgatcggaactgtggcatgctaaataggcgcggctcttacccccagatgggccaagtttgacaagtactccctccttcaaaaaaaaaaaaagacaaaccctgggtttgcgtgtccaactttgactgtccgtcttatatgaaatttttttataattcgtatttttattgttgttagatgataaaacatgattaacactttgtgcgtgacttgtctttttaatttttttcataatttttttaaataagacggacgtcaaatattgggcacgaaaattagggtttgtctttttttgggacggatggagtagtactgctgactttgttagtttgtgctttaatattagcaaaaaagtgtggtctgtggtgtattgcatgggctgttcctaaacatgcatgcacctaattaatctaaatgtactgtgtgggtggatcatttatttgctggtctgatagtttgtttagttcaaaaatgtatctttttttcccttccgataacgtttcgatgcacctttttgattacgattgtcgacgggtgatacccgtagaccggatatagagggtattggggtacgctggtacaaggatctacgtagtacgacatcgagtaatcaaaagacaagaattatactggttcaggccccttgataggtaatagccctaatccagttgatatgggattatatggtggaaaacacaggttacaaaggaaagatggaacttgtcgaatccggcgagattgtagtcgagttgattcgactagctcttgacgacgtggcccctcgcaggctccggcttcgtaggctgtgtgggttgtgttggctctgagattcgatcctctatgccctccccaggggtcccttttatatcgcaggtctggtggtctccgagtaggactcgaacacaccagacccagacccagctcaatacgtaggtaacccagttcttatccgagaaggactcttcccgtctattgatttcgtgaaaggtttccttagatcataaaggaaatatccgcatacgcgtgggtatgccatgtcgatacgtaacgtatatcgaagggtagagggtatgcctgacccgtaaccctgacagtagctcccgacttctgctcaaaatgaactcgtgcgaccattcgcgacttcgggtgtcgagaacgttatcattccaggtacgagaaccacggagatgacgtgtagtcgaacatgccgtttgaagcccaacggtcacgagtgaattttgaacttaagtcaaaaactgccgcgcgtaatggacctagaaatttccggcggggatttctctcagttccttggaattcgcaccgtcgggggtgcgcctatttaaagggattttgggtgcgcattttgaagtccgcccactccatcaagcacacaccgcccgttagcgctcctcgccttctccactgccgtaaagaaccctagcttcgtcagctttaggtccatctctggcgatcttccagcagcgatggatctcggcaagtcggcttccaccagcgcgaccctgaagaagctccaggaggatggcgcccttcctggccgtgaaaacgcggagagggaagcaggaggtacaaatcctcagcccatcttaggtcgcatggttgtgatcgaagattatgttgtctgcgggtttctctcttcaccctccgaattccttctgctggttttgaatttctatgggctttctcttctgcacttgaaccccaattccattgctttccttagtgtctttgtgcatctttgcgaggcctacattggggtagagccctttcttgatctgttccgcttttattacgagttgcgctggatggaacccaatagggtgtctggttgcgtcgggttccgacttcgtgacgggatgaagtcgcgctatgtccccttccagtgtccctcttctcgtagtaaatggcggaacaggtggttttaccttgaaatcaaggattcaaatccgatcctcgttgttcccgaggaacaacaagattctggtctggaccgccaagccccccttgaccccctctctccaatcgtttatcgacatcatcgatgatctccgagaacggggcttatcgggatatgaagtcgttgcagacttcgtcgataggcgaatccagccgctccaggctcgggcccacccggcctataactattccgggccagatgacgcgacccgggtttctcctcggggtatctttctcgcattcattttgatatgcttgtactcgcgttccttttcgacttatcaaaaattgattccttcttgacaggtctgagcagcgaagccgtggagcggcgtgttggtcaggtgatgatcagcggcccgactacggcgagcgacatccccgcacccttttgtgaaaggggagtgacggagcacgacgaagcaatcaatgtgagttcattcgataagcgtccgccttctttgctcaaaatcagcttatgacatgatttagtgtaggcccttcctttgactgatgtcgtcggtccgctcgcggatcatcaggtggcggcatctctgaaagagaaggtcgtcaaggtggcgtctgacgctgccaccactagtggtggcaaagctccgactaaggcgaggaaattctcgtctgtgctcggacaccgccgcaaggcggcgactccctcagtaattttcaccttgtcgtcaggttatgtagcaaggaaggtttgttctcactctatgttggttgttttgtaggcttccgacgtgtctcctccgcctgcgcgacgtaagcgcattgtgacgatcggcgagaagtaagtaaagaaacttttagattctcgtgtcttctgtttgagtggaattttgattcatggcggtttatagggaggcgcgggcgaacgttgctcgggccaagtccgggggaacgtctagcgcgtcccctgtcacggcgtcaacagatgtcgtgcccgtggtcgggagtcgggaggcgacgccaagcggccccgtcagcgatcccgctgggggtcgtggtctgccagaggccgtcctcacctgggaggagctccaagtcgaaatggggcgccttctcgaagccggtgctcgcggcatcggccgcgagatctcagaggcgagggcggagacggcggcggccaacgcgcgtgccgagcgcttggtgcgggaactggctgaggcccgcgaggacctcacgaagatgagggagctggtggccggcaacgagcgccagcgcaaggggctcgaggaccgcatgtcggaactcggggataacctctccgagatccgtggttcgctgcgggtcacctacaccggtctccaccagcttgccgaggagtgcggcatcaagtccacgatcccggcgaaccccgacgagttctcgttgacctcttctcttgcggagctggcgacggcgatggggaaatcccctccaagcatacggccaggatcgcggaggagacgtccaacggcatctataccggggcgtgtcatgtcctcgcgtgtgtgaggttgtcgcgtcctgaactcgatatgcgcgagatcttggatcagggggcggcaagcgacacgcgtaagaaggtgatggaagaagtcgatgacctgggggagtctgtcctccccctttttgaagagtaggacttcttgtattttttgtgacttgtaaatcttgaactctggttgccttcgtgcgtgtgattatcatccttgttcaccgttgatctcggaagttttttcttgtcgactgtagagatgctgatgacgaggatgtccagcagcgcgggcagcccgagtcactggcgataattccggtattcgagtttgaaccacacgtcccacatgacgtcgaggaccaaactcttgatgcggaggtcgaagtgactacaactgcctcaagtgagtagccattctaccttcgagttctacctttgtgttgttttggggatttccagcttgtcttagtggtcgttatgtttagcagatctcaaggatgcccttgcgacccaagatcgtcgtatccaatactggaagacgaaatttgaagtggtggaactcgagagaatcatgctatccgtgaagaaagagcaagccgtggaaacgctccgaggccgcgaggtgtggtttgggtcatacttgaagaattgttgcacctcgatggctagggtatgcagggagcttcgagtagtccgcggcgatcctgaagaatcggcggccgggtacatctcgtggctcaacggggcctgtgcccaactcgatggcatcggcaagcgaatcgacgaagccttgaagcaagagtgtcatcttgcgagccgatatttcggaggacatgtgttagcttgcctgcgagatcaccgcccacgcctggatctcgaattcctccgtgaaggtttttcttgttctcggaggaatccggcggagatagaccaccttgcgaggtcgatgtcgccgttggccgagaagattttccagtcaatggactggcattggctttcttggtagtatttgtaccctgcgaccagatatcttaggggaagatgtaatgcagcgaaatatttatgtacaaactgtaagaaatattttgtgaataaagaaatctatctttaacaaatgtttcttactctggatgtcgtgtgtatgagtgtgttctcagttaatgactttagttagccgtttgagtcgtacactctccctagcccccagctttgtcgtcggaggaattttctcggaggacaaggctcttggacccttgacctgtcttggttgaataagctctgatcctagcacccagccgtgaagttggaaagctcggtttccgattacacgacttggttaatacgcacggcgagaactcttacacgaccagatcttacatggtctttcgtctctaaaggatctgacaaggccttatcggctctaggcgtccccagtcgaagatcccttaggttcctcggaggccttgtcaagacggcgtaaagggacataaggacaggtttcaacgctaggtgtcgtcagagtaagggatcattgggtgaaaacactttggtcgtgacatgtgacttagaaataggctttattgatactgtaagggtgcttacaggtacagtggtattgactcatacatagaatttacgtagttggtcaatgttccacgaatttgctagttcgcgatcgtcgccgtctgcgattttgaatgcgcctggccgcaagacttgtgtgatcgtgtagggtccttcccattttggtgagagtttgttttgccctgcttgggtttgaactcgtctgaggacatagtcgccgatcgaaagtatgcatgctcggatgcgcttctcgtgataacggcggagggcttgttgatagctagctgctcgaacggcaactcgctcacgatgctcctcgagaaggtttacatcgatgtctcgctgtttctcctggttctcgtcggaatgcttctgtactcgtgtactttgatgtcgtaactcgccggggaacatggcttcagagccgtacacgaggaagaagggtgtttccttattggatgttgtcagtgtggtgtgcatggcccatagtactgatgggagttcttcaacccattttttgtcgtgtgacatgagtctgtcgtagacgcgggtttttatcccttgtagtactatgccgtttgccctttcgacttgtccattgctttgagggtgagagaccgaggcgaaacatattttgactcccaagccgatgcagtaatcctggaaatcggcgctgatgaattgagggccgttgttagttatgatgcggtgcggtagtccgtatctgcataatatacctctgatgaacttgatggcgttatcggccttgatttccccagtgggtactgcttcgatccatttggtgaatttgtcgattgctacaaataggaatctgtagccgccctgtcctcgtgggaatggcccaagtatgtctagcccccagcacgagaacggccaagtcagagggattgtctggagtgcttgtgcaggtagctttgtgtgcttgctgtggaattgacaggcttcacatcgctggactatgtcgcatgcatctttaaggtcggttggccagaaaaacccttgtcgaaaggctttgccgaccaatgtccgaccggcggcgtgtgacccgcatatgccttcatgtatgtcgaggaggagttgtctgccgtcgtcggtggagacgcatttgagaagtatcccgtttggcgcttttttgtataaatcgttgccgaccatacagtagatctttgctttacgggttattttctcggcctctgtatcgtcctcgggcaactcctcgctgctgatgaatttgattaatgggatgcgccagtcatctgtggtttcaatgtcagcaacggcgcgttctgcctcggtgacctccaagctgatgtcgggggtactcgggccaacttcaccgctaacttcttttaccgatggctttgtcaggacgtcgagaaaggtgccgggttcgagcggttctcgtctggatgcacgtcgtgctaggtcgtctggctcgatgttgtccttgcgatagacgtgtcggacctcgatcccgtcgaacctcttctcgagcttcctgacttctgcgaggtacttggataactcggggttggtgcatttgtagtctttgtgcacctggtttgcgattagctcagagtcccctttgacgattagtcgcttggccccaagtgcggctgcagctcgtatcccggcaagtagtccttcgtattctgcagtgttattggttgccctgaagttaaggtggattgcgtgcttgaattgatctccggagagagatgtcaagataaatcctgcccttgctccttggctgttgagtgcgccatcgaacgccattgtccatgtctcattgtcaccttggttgtctgacttattatctggcatggtccaatcggccacgaagtcggcgagtatctgagatttgatggctgttcgcggcacaaagtggatatcaaattggcttagctcgactacccatttcgcgatgcggccgacaacgtctttgtttctcacaacttcgccaagggggaaggaggagacaactgtgactctgtgggcttgaaagtagtggcgtagcttccttgatgtcatgatgactgcgtagagcagtttttgaatatgtggatatcttgtctttgcgtcatggagagcttcgctgacgtaataaactggtcgctgtattttctctgtctcgacaacaatgacggtgctaacggaatatggcgtggcggtaatataaaggaataattcttcattaggttggggagcaacgagtacaggggggtttgataggtagcgcttgagtgcaataaatgcctcttcggcttcctgtgtccatacaaatttgtcttgtttcttcaataaggcgaagaaaggctgtcctcgttctcccatcctagcgacgaatctgcttaatgctgcgatgcatccggttagcttctgcacctccttgagtcatgtgggcggcttcatgttctcgattgctttgatcttctcgggattcgcctatattcctctgccagaaacaaggaatccgagtagcttgcccgacggtacttcgaacgtgcacttctctagattgagcatgaggcgatatcgtccgaggttgtcgaacgtttcccgcaggtcgtcaatcaatgagtcacttgtcttggttttgacaacgatgtcgtcgacgtaagcctcgacattgttgccaagctggttgctaagtgcgccctggaccgtacgctggaaagtattcccggtggttatcagtccgaaaggcatcttaacgtagcaaaataccccgaacggcgtgatgaacactgtcttctcttcgttctcttttgccatgctgatttggtggtagccagagtaagcgtcgaggaagcttagaagctcgcaaccggctgttgaatccaccaactgatctattcgagggagaggaaagtgatccttggggcatgccttgttgaggtctgtgaagtcgacacacattctccattttccgttggccttccgcaccataactgggttggctagccactctgggtgaagtacttctctaatgaagccagctttcaaaagtttgtcgagctcttcttgtatggcttgttttcggtctggtgcaaatctccgcagtctttgctttactagcttggcatcgggtcgcaccataagtttgtgctcaatcacctccctggggacccccggcatgtcgcacggctgccaagcgaacacgtcggcattatcgcggaggaatgtgatgaacgcgagttcctatttctcatctagtgtagtcccgattttgatagtcttgtcggggttagcactagagagcggaacgatcttgatggtgccgtctggctttggcgtcttatttggcttgctcactttcttaggtggctcagacgtggcgggtggggtgggcgtttgctcgaccatgtcgaggctccgcttgtcgcactgcaccgccagctttgcgttcccctaaatagtgattgttcccttcggtcccagcatcttgagcacttgatatgcgtagtgggatgtggccatgaacttcacaagtgcagttctcccgatgatggcgttataagctgtatcgaattcagcgacatcgaaggtgatcagggtgcagccccctgccacgtcgaacagacttcacgttccactttcttgtattctcgcttggaggagtacgttgtggaaccaccgaatatgtgtgagacgtggaggtcggagtctgggtacgcagaatccgattcgtgaggaggtgtctccttgttcttctcaacaacgcgtactcgcttgcctttttcaaacgccatgtgcttctcgagcgactttttgaaaacaaggcaatcctccagagaatgtctgtccgttttgtgtatggggcaccatgatttctttgtatcgctgccctgtcggtctgggcgcttgggagggttcgcgtattctgctgcgaggacttccgcttgagctttccttttcccgtttttgcgatttttcttcttgcttgactcagatgcgtctgcggatagtttcttctctcccccagtcttcggcttgtcgttcttgcgtcttagcgcgtcatccacatgggctcaccgctcaacgatctcgaataatcttcgagtagttgtgatgcgtcttgtcgccaactcctgggtagtgtagcgatctctgacaccagacttgaaggcgagaattacagaagcgtcggtaatctcgggaattgtgtttctgcactcgttgaagtgccgaacgtattccctcaatgattcccccgagttctgtgttaacgcatgtaagtcgtcttagatcgcgtggcgcttgtatgttccttggaaattggcgacgaactgttgccacaggtctgcccacgaggagattgagtagggaggaagatgcatcagccatgaacgcgcagaaccctttaacgcggatggtaaatagttcgccaacgcgttgtcatctgctccggcagcataaagcactgtcgagtagacttgaaggaattcttctgggtcggtgctcccatcataattttcaatggctctgggtcggaatctctcaggccatcggacatcacatagggaacgaccgaaagccctacacccagcactgggggcggtggtttgtcggcggtcgcgtgaccttcgtggatgtctgtccaacgatgaagaggacgcggatgatgacgatgacgatgggtcgcttggttctggcgtacgattacgaggatgacgacctggatcccgggcatcctgtcgttgtctctcgctgttgtctcggcgccgatcgccttcgtcgtcgtcgttgcggcgacggccatgaccagtattgtctggcccccgccgttcgcgatcgttgtagtctcggtcctcgtttgggcgatttcctcgatcatggcgtcgtgaagagacatgacgccgggagcgatttgcgtcgtcccatgtgcgtcgtgcttctcggcgatcattgatttgatctcgaagatctccaatgccacgaggtggaggggtagcctgtcgaggtaattccctccgctccggatctttaccattggtgtcgccgatcggtggctgatcttggtgtgctgcggtagcggcttcttcgaacgcattgctgaggttggtcaccgactcccgtaatcgttccgtccaacgctcgaggtcgtcgttcagaacgggatcgtaaggagtttccctctgtatggcttgaacaaccctgatgtgctgggctggagtagtcgattgatttgccgcctctgcattggcttgtgctgacgtgccaacgtcatcgatagccaatacctcccgcgacgcacttgttgtcgatgacccacagtcttcgaggagatgtaagaccgatggttcgtgggggtcgagatcgattaccccaacgaatcgatctgaggctggagtcgctccttgttccttgccgttatccctaacggggacgtatgacttaggagacggagttttcacggcgccgaggagaactttgcagctcgagaggtcgtgattctttgtcttgtggataggacaatagacatcccgagttagagaagtacgctgaattccgcgttctttgcaggcgcgaatttcagcacggacattgatgaatacctagcaatcttgaagggtatgtttcttggttttgtggataggacacaaagaccagataacttcggaagtcatctttgttggcccgtggtttatgtcggagggacaagacttggccgcatcagaatccttcacgagtttggatgtagtcgataatccgttctctgtttcaacgggtggatttttcgacatggagccgtcctggttcatagccactgcgttctcgtttccagtcattggaggaccggttgagatcggcatcgtggtgtaaaccgggaagacgatttcgccgacttgagtccataccagcattattgaagctgagagtgcttgactggagctggtgttgacgttgttgtcgacgaagcttgatggcatagtagtagaaccttgagtaccaagtgcccctacctggcgcgccactgtacgtagactggatatagagggtattggggtacgctggtacaaggatctacgtagtacgacatcaagtaatcaaaagacaagaattatactggttcaggccccttgacaggtaatagccctaatccatttgatatgggattatatggtggaaaacacaggttacaaaggaaagatggaacttgtcgaatccggcgagattaaagtcgagttgattcgactagctcttgacgacgtggcccctcgcaggctccggcttcgtaggctgtgtgggttgtgttggctctgagattcgatcctctatgccctccccggggggtcccttttatatcgcaggtctggtggtctccgagtaggactcgaacacaccagacccagctcaatacgtaggtaacccagttcttatccgagaaggactcttcccgtctattgatttcgtgaaaggtttccttagatcataaaggaaatatccgcgtacgcgtgggtatgccatgttgatacgtaacgtatatcgaagggtagagggtatgcttgacccgtaaccccgacaacgattgagatttagtcatcgacgagtgagaggcggattggcacaccctgaaantctcctcccaacctaaattggatttataaatgggtcccaagaaaaaatcggtgttaa

SEQ ID NO: 66545 - DNA, 8939 bp, Oryza sativa
ttacgtaaattttttgaataagacgaatggtcaaacatgtgagaaaaagtcaacggcgtcatctattaaaaaatggagggagtatcttttactgaccaagaaacccaaatctaacaactgacgaggttaggcagtcacctgaagaacaatgtctgagcatgccttcgcgctcactaaagcaaatacaaccaaagctatcgcatataaaccaagatttgccacctgcattttccatttgtagtgactggtgagcatcttcctcatgagaacaatgattgcagtggtacaagacacaggagactaaacaagtaggaattatttttgaagcacatatcaggccaccttcaatcagataaaagatggcagtaaaagaatactaccatctttggtatagaaacaatgcactttgtcatgtgcaaaaggttattataataacaagagttcagtggaagaaatttcccggagataccttaagtaaaaaaagagtattctagtaataatatgtttccatgctaaaactgtagtacttaccatagtgaacgcatttctgcagcttgctaaggctacccggcttgtggaattcagtgtcatgcagttcaccattgacctgagaggaagaaaaccatgtcactatgccaagccagagcccaaacatattgcaaattagatagaagcttctgtcaaagttcaagtgatcaaatttacatgtgtgaaacttgtgtggccgcccagccgatgttgaagacggcagcgaagaagctgtaaccaatggttctcacaaggtaggaatcggtccccaggacggtgcagagaagacatccaccgaagacagaggagaaggagatgccgactaggattgatcctccgatgtgccacagcttgaagtgcccaaatcggtcgatctgatcagataccacatacattgctcacagatcagttactgtattttgctaatcagcgcgcattcagcaatagcaaacggtttctcaatttatttagtaccatctcgcctgcaagaatcgtcattaggccatctgcaacctggccagaaagcatcacaatagctgcatccctgcaagaaattgaacacaagccatgattaataaactgagctgctgcagcaacattactttgcttcagacaaatcgaaattccacacagaccactagtgtgattgtgagctgttgtctacgtgggtttaattaattaattagcaatgattaccttggagcaagcccgatttcttgcaagaagaggagcaggtaagtgaaccagcaggcagacgtgatgtcattcagcatgtggccgacaccgtaggacaggatcggccaccgtcccagaggcatctgtccctccgccaacacctcgtcgcccttcgcgtcagccatggcgatcgatcgatcgatcgatcgcagaggcaggcagtacaccagtttcccaatgtgtaatcttcagctacgatctctgaatatgcagaggtgattgcacacattagcaacagacagggaataattccacgcctcatgagatgcatgacaaaaaggaaaaagcgacttttatttgatggcgatcatgcgtaagcttgcgttcacgccagccggcgccgccgcgcgcgcgcgggatcaccgcacgcgagcgacgcgtgccgccccgcgccgcgcgtgcagccgcgtcccctccgctcaactcgccgccgtcctgcgcccgcgctagccgcgctagggctacacgttgccgcgccgcggccgccgtcgtaaaatccccccaagaaaaacggcaatgcatatgaacccgcggcacggcgacgccggcggcaacagcagcaaaaggaatgcgagaatcgggagggaatttcagaatctcattcgcgaatttcgcacgcgtaccgagatgagagcgcgcgcgcttgctgttcgtcgaggaggggaggagagagcgcgggacgaggcgaggcggatccggcggcgaggtatatataggggacgagaccgcgagcgagacggtggtgatggtggtggtggaggtaggctagggcatgatagaggcggcgctacaggacaaggaaagacgaagaaggaaaacgccaagtccgcaaaattgaaaagtggaattgggtgatttttgcgtccttttcgttagtttcctattcttttacggcaaacaaatcgcgctttcagacttcagaccgcatactaaagatgatttaataattaatgcaccaaaatatatttttaactacttttttattttccgaattatcatacaacaaagtttccttttataaatactagcaaaaatgcccgtgcgttgcaacgggtaaaaaaaataatccaatgacaatagacatttttcaagcgtacccatatcaatgataatgtttctatggatcgttgtagctaacacaattagaaaattagagcatctttatgtaatgacccaaactcgatgatggcaatctttttaccaatgcttgctttaactaaaataattggattattcatataacaatatacatataataaaaaaatattctttcaatattattcttgcaaccaataataggttaatcaaatcctacactcaggatcaagtctacacaaaatagtcaccgtgcactcttctctaaataacaattaaaaatatgtttatttttaatactattttcatataatatgttattaaaaaaagtctgataatgataattgcatacaaaaagtgcagggattagatgaggaaacaaatgatgtgtaggagatggaaaaatatcgatggatcttatccgacccaagcgtccatcaattttatctcgctttgagtcggacggtttctcggagcggttctttttataaacggcggttttttttctcgcattgagttggatggtttcctctattttttttttcgaaatgatggtttttttctcgcattaagtcggacggttttctcgaaccttattttgaaacatcggtttttttcgcgtgttgagtccgtttgttttttttggatctgttattttataaacagtgtttcatcggttagttttttcagagcggcttttttttataaacagtttttttttcttgtgtggttttttgaaaccatttttttagaaatggtgtatttctttctgatagtttttaatagcattttttttgtttttttcagacgaaggaaaccgtatttttcccgcgcatttttttggaaattatttttttcttgcgcatttttttcctttttaacggatgatggaaacttctctttctaaaaagttagattagattgatagattagattagagttaaagagatatatacggataacaaggggcgactttaagtttggtcgggtcgttttttcctccttttctttttacggagtttgagttagatgtttttttttctttttttttattacggacgagaaaacctctttttcacgagtcggacttttttttttctctacgggagtcggtccttttttttctttttttacgacagaaggttttttagagatagatatttatttttaattaggtatttattcacgcgtgtttcccttcggatagaaactttttttttcgcactattctttccttttgtaggaagatggaaactcttttgtcgctcggaattttttttatttggaatcggacagaaactatttttgtgggtaatttttttataattaaaaacggaaatttctttaccggttttttttggatcggacaaactggtttttttcgcccggttttttttcacccggtttttttgacggacgatggaagcacctcttatttttttttttaagtagtagtagatttaaggtttgtttagttgaaaacttgtcaaagaccagtgccaaaaaacaaacccatgacatatggcaatatgggacaatgagttagccaagcgtgatttatcatagttatagcaacttactaaacatctactcctacctaatggcatgtttaacatgtggcatgataaactgtaacaatgaaccgtacatgcccgaaaagttgttgttaagcttaacatcaacatttctctctcatttcccctatctatgctatttcaacatttcccctccctcttctatttcaacatttcccctctctcttatatttcagcaaatttacctgattaacgacactaaaagttaactattaattgacgttgtacatgtgaagtggcccataacctagtacctgcagtgatcttagtagcacctcgtgtcgtgagttcaaatccttggggagcgaatttccccctagtcggcatgtgtttcccacactggccaagttttttttaaaaaaaattgatgttgtatatgacttgtggctatggttagattttcaactggagtgaagttgtaacaaggttgccgtactaagaagatgcgattggatcaccattcttgaacccacaaacacaagatgtgtatcatgttctaaaatatggatatccccttatattatgatatttttctcgacaataaatactagcatgttgggtaagcacaatcctcgcatggagaaatgctattcctttgctgggttctctaaccataataaaggacgccatgaacgtggccttaagattgtggatgaattagttcgaataatttatcaaaaaatgcatacatttaatttgttgtcaaactttggtaaatacataagaaatcctatcaaaattttaacaatattgttaacttgccaaaaataatatggccacttgtgtcaccaccttgtcatgagctctccctgcacatcatctaatcaaaagttgcatgctattgctcatttcatatcagcttttcgcctctggttctttgtttcaggcaacagagaagctgaagctgtgtctcgctgtttctgagtcaaaagaaataatgtgaattcaagagcaaatcattttgtcaaaaggtcaaatttgtctctcaaaagtcatggagggcttggtcatccgagaaagcaggaaataagcagcctgccttgaattccaaacgtactaaatatagattaattatcataaggccccttgtcataatcttctcggaaaatcgtgatttgtcaggtcttggtaaagctaatcagaccggcgaaagggagtgctatgcattatttccttcttcgccagtagagtagctttcgtgtgatgtaatattatctgaacttaataatactactacttataagtcaaatcgttggtaaaaacaacggtaatgacgtattgtatactctgatcaatcttaaatagagaccactgtccttagggtagtatttttagtaataatttttttcagttaagctaattttataattcatggttatttatcccgtaaactttgtaataattgggtaaagcttctctgaagtaaagtccaaaataaattgtattattaaaaagagttagttactagctaaactaggtagctaatgtcatttcattactgcgaaaacagtctacctaaatacctaatgcagaatcaattatcaggcatgtgattttgcagcaatcacgcagaggattttatcaggaatcacaaatatcgccagccgaaatcaatgttcatccagcagagaaaaaaaaatatgccaagttgtcaaacacatggaacaagttgggtagcgacaagcatccaagttttcttccttctcagatggatccaattaagggcctctctaaccagatagggtcagtgttctaacctgctgacactcattagccgcccatagtatgttcttgagagtttgacaatgaagggcatcatactgggttagcagccactgacttgtgcagttctttccctggctttgacttgcatgcgagcagagaggatcagcgtgacaatgaaaatgaaaatatcatcattgacgtcatctcctgaaaatgatcttcaaacggccaatcgatttctccataatttgccatgtgctggatgtgatgatattatctgtactatctttcctgggctgatgtttatcagcaattctctgtagctttcatgcatttgttagccactagtgcatttgatagtacctataacggcttctgcatcagtgcatcacaatgctcaaataaagaaaaatgatgagattcgcccacagcaacagagttcaaaggacatacttcctcatttatttttaatatttagcgcagttgacttttaaatatatatttaataatttatcttattaaattttgtgcaaatatatatatatatatatatatatatatataataagtcatgtttaaaataactttaacaacaaaataagtcacaataaaataaatgataactacataactttactcaaatgtatatcgaaaagttaatggtgttaaatattaaagaaagcaaagggagtatttgatacatgcctatgaaatcttcttcagacataacatccttaaatccaccaaccagattccaaaactgttctggtgcataacaaacaggcaaggattttataaagcataaacagttgaacaaaacatttattcatttgttactctagtcggctgatacgatcatacaacacagtttgacatgcctaataagccgaaagaaagatagacatgatgattaggatgaaggtggaccaccttcctatccgaaaatgtagaacatgacagccgccaatgcaaccattactgccgtatcatcagcagtatcagctcaaccccaaaccaggaagcatcagcacactgaaatcatgaataccactggacaaaccaccgatgctatggaatatttcttactctcacaccccaaaaaatttcaccttggtttatagacaaccgaagctcccacttcctctcctgcatggctgcatccagcagccagcatgagatttttccggtaccggagagattgagtaggaacgagatcgctagatgttcattcaggcaacagaccatctctttgctggagttctggcacccatttcagcttccgattgatcggccctttcaaaatttgagaatgttcccagtttccaacttcacatggagccatgctcaaacttggagcacttggcaatggataatgtgagtcttgaaattacgacccgcaatggtgaaccacaagtttgctatgaaagacctgtgctggcccttccgagcaaaaacatcccacatgtgagcattgttaatctcgataactgttggtgtgtttgagacatcgacaagagtgatgctcatattgttgcggataatgcagatctttccatttagggagaccagagctgcagcttcaaaagctcgtgaattgcccagatggcgcctgctgtccatgaatctggtccacgatcgtgtgtccctatcatagactctaagcttgcatccgtcccggcattctgctgaataaagacgtccattaaagcaaatgcttggattccgccagcccgtaaccatttcatcagcagtgactgaccatacgttggatgttggcatatagacctcactcacaacctgacgatgagaatcaagccctttcaggaaccatttgccatcatatacaactccaataaaaggtaccattcccgtgctcatttcactgatgtaagaccatctattcctgtttgggtcgtaaaattcagcagatcttagagttctttgtatcccttcacactccccaccagcaacatagaggcggttgtttatgacacaggaaccaaagcagtgacgcttttgtagcatatctggggctcggagccacttgtttatccgagcattgtaaaatacaacacgcctcatagaccctcggactgggtctttgccaccaaacaggtacagatagcagccactaagaacagcacagccaaagcccacggcctctgaatactctgctggaactggagggagtgacttccacacctggtgaactgggtcaaaggcatgccaagaaatcttccgatcacggtcccttttgaagacaaaaacccattcttctgccatgccaagtttcttacgcaaggaataataatagttcccagataacagtcggttccaccgtttacagactaaccgaagatttgtgtgctcaagtcgagggacccgcatgaggcaggtaatagctaggtcgtcaggaaggccaggtagaagtggtgcctgagttcggcacctctctttgtgtgagctccttgacttgcgcttgtttggtttaatgtcagggtgcatgcacagctttgcaccagggacaaacttcctagcactcacaacagttttaagacctccatctaccctgcagtaacaagacacagactctacctgcaaatgcattggtaaatgaagttaggatatgcttatactaacctgaatgtggaacagcataagtgaaacaaaaccacagttacaagacacagactctacctgcaaatgcattggtaaatgaagttaggatatgcttatactaacccgaatgtggaacagcataagtgaaacaaaaccacaagaagtaactcttctaaagacacaaacgtatctttctgtccaggcactagcaaaatagtgtgacgattgcattgcatgatgtttatctttcttatatatctagcaaaatacccatgcgttagcaacagattccacaaaagtataccgtaagtttctaaactcgaaaattatatgtatattaatcaggggggaatatatataacttgcaaccgagcatcaatccacaaatagccaaaccatgtgcataagtgatctatttgttcactcgcataagatcccaccaactctggaggtgatggtgggatagcaggctcatcatcgtcactattcactatgatcgctctactgtataggaacggaattggagaatgtcttttgctaacttatggatacaaggactagatgttaaaggtacaggctttggtttatcctttctccattaaactccttgtataagccatttttaagtgtgacatgagcact

SEQ ID NO: 66546 - DNA, 1887 bp, Oryza sativa
tttaatctaacggcttataatattggacacaccaatttatgtggaaattaagggatatatgttttgttttttttctcaaattttgtagcatttggtaacttgagagcgttttgaggaactttaatggacatacgtcgtatcgtttggttgagacacttatataaggacaatattaaccggagaacatccagcacgttttgtccctaaattgttttcgtcagttttgctttttataattttgtaacataatagttatctttatactatattgtatttatgtaatacatagaagcaattatttataatgttattcatcaactgtaaagaatggtaggcttattttctttaaaaaagcatgcatactaaattaagtgttaaatgaaaattaagacttttttaattggatataggttattgttttctattaatggatgaattgggtggacatgaaagtccactaaatgcattggttatatagtctaatatgatttggtgtagttcgagatgcggcccaggaatccaagaattgagaatttttttacggtggattaattgttttttggattttaatatttgtatgttaaaattcagcagctatcagtgagatggagtaacctcagttttgtatttttcttcagaacagaagaattaaacattggtgctaattacgtctaaatagaaaaaagtacatttagttctaataacaatgattaaaagaagcaatattaaacacataccacataactgttgatcttcgttctttctgccccataatgttttcttgtctgtaaactcaaagtagtagtccgagaaacattcttttttgcttcgacctattttattattgtatcgtgataaaaaaagattttgagatatctttcggtacacagtacttatcatgttccataactttgattatttttaaaaaatgtataatgagtttatcttaatttttggcctaaagtggtttgccaattgctttgggattgaggcatgtattgagttgcctcgaagaaaatagtatttacataatagaacaatatattaaatgacatgtttgcaacaatcataccttgcatctagtagactcatctgtataccatagaactcacagccattgtaagattaaccgcatcctatagcctaatcactcttactttaattatacacaatacttatcatgttccataactttggaacttttaaaaatatataatgagtttatcttaatttttggcctaaagtggtttgccaattgctttgggattgcggcatgtattgagttgccccgaagaaaatagtatttacataatagaacaatatattaaatgatatgtttgcaacaatgataccttgcgtcaagtagaatcatctgtataccatagaactcatcagccattgtaggattaatcgcatcccattgcctaatcactcttaatttaattgtccacctatcattttttctgtgttaacgcagtaatcaaattgtaaagtaccatgttatctgcaaatgttcatatgcaatataatatatacatttatgttattcaatagatgcaatatagtgtagccttaattaatacaggatagcattattgtgttcttctataggtgcacgattaccttcttttgccaaatatgagcagcctgaattgactaatgtcaccaaacacctcttatgccaagatgagtcgccagatagagtcgtgtattgtagagattaaaataccatctggtcgtggtgttgctgaaggagataacactggtggagaaaccctttgtagtcccggttcgtaacccccctttagtcccggtttccaaaccgggagtaccatccgggactaaagatcgctatctttagtcccgggtgaaataaccgggagtaaa

SEQ ID NO: 66547 - DNA, 599 bp, Oryza sativa
accttggagaggtcgaggagggcgttctcccgcagcgcggggtcgcagaggtcgagcacgagctgctccgcggacgccatcttccggtccttggcggcccccggagccgccgccgccgccgccgacgacgacgaggaggcgccaggcgagggcggcgggggcgagggcgcggcgaaggaggcggcgccgatggagagcgacggcggcagattcgccatttcgcggaggcggcggcggcggtggagtggagaggggagacaggacaggaggaaccgagcaaggccgagagagtgtatatacgaggagacaaagccggcttttttactaactacaccctccactaaagtagttttgttgtttttagaggtacgttttagacaaaataatatggagtattttgtagtaaggattgtaaaaatattgttacactaagtgtttggcttagggtgtcaacaatggcatgatgttagggtatacgagtaggtgacacaagtaagaacttttacgtaaagggaagttttgttgtttagagggtacattttagacaaaataatatggagtattttgtagtaaggattgtaaaatattattactaagtg

SEQ ID NO: 66548 - DNA, 2111 bp, Oryza sativa
gcgaaacaagcattatcttaatcttaattaattaaaataaaaccaaagatatttattttgagatgtaaattttgaaaaggctaaaaataaagatgctccaatcttatagaactcaaacaagaaccggatataaaacttgtcacaaaagattttctctaatattttaaaattttaaaattgaaatggttgaataggaagggaaagaaatacaaatgattaaaatagatgggggaaaaacaaataggactttagccccaaaatatttagcatggatttttgatggttcgataataggctaaaggagatttggatttttgaataaaggaattgaaaatgggtttcttagctcaagagcaatcactcaagtatttgtgataatattgttctttgtgccaaggatgtgatcaagccatatagattatataggtggtgtgatcaaaatagaaacttgaccacataatggatggtagcatattttggttgaaggggaagtgaagattttggggggaaatataggaattaatattttatgtactccagagatgtcggagaatgatatttcatgtgctctggagatagttgggtgagatcaaaagggtatttgtggatgttggagatgttagggaatggattcaaaggaaatataatttagagccaatgttagggatttaaataaaataaatggagaggttttgtaaaatttaaaagagaacaattaactttgcaaataaagttttagatccaagataaaagaaaaggttaaatgcaagattgctccaacgtaagaatcgacaaaagcatgacttaaaatatttcgcaaaaaaaaaatcctgaaattttgagtccgttacacgtacacatgggaaatatgtcatttttgacatatgtgaatgattaacctctcccttttgcaaacatttgaactgtgacaactgacaatcaaatgtggagagtactagctttaacgtgttaatttggttcccatgttgacttaccaaagttttgatgaaatctacaagcacaaaaacatgttgcgtcaaaaaatcaggtcagcatctgtattatttcgcggagggacttgataagaaaatcatgaatgaaggccgtaaacacaaaaatttggactatatatgactatcagatcacattgtcactgatcctgaatgatagaccacctgagaccctgtgattttctctcttttctgttcctccattcttattgcttgtccgtttcaagtttctatatttggttgcaaaaacttgatgcgattcattgcaatgcgttctacggatatctattatctagctcttcaaatgctttaaattcgtgtcggtgaggaagtcctcgcatttgtgcaaatatggtgaagcatgtgtctgcaccaacgtcatcacatatttatcctttatggagaagacatagtgtcattatccgaaatattacaaatgcgatccaaaatagtttaaaagacaaagaatgaaaatggaggagaaaaatttgcttcatgtatgcactctaagaaatattgcttcatgcaggtggtaaagctccactccacatatgttgttggactaaactctaactgcaatacattcttattcatctataccgctagcgaacatgtacatgtgtatatgtgctgacttctgaatattcatgcgtcgaaaagcatctagctgcatcatcattcagctgaagattttcaagagtcagagcagcaaatgagtctgtaatgatgtggcatgctgtgcgagaacttggtttctatcagtggtcagagagaaacaatctgtactgacttgggagacttcaggttggtgtggagcctcctaagagatttgtttgagtacagtgatgagataatttcttcacaagttcacatattcccttatgcctcctatccatatcgcattatatgctaatttggttttagatagatgatccatgccactacacctaggggtgtatcacaatgtagtgtacaccatgaaacgttcgatctctctctctcctccttcctgttccaaagtctttgttggatgcctggttcttgctagttgctatagttagaatgtgttggtgtggtggcaagggctgctgcatgcatgct

SEQ ID NO: 66549 - DNA, 540 bp, Oryza sativa
tttaccatgctttctagttttgcgtaacactgttcttttagtttttttacggctcctttggaatgcaagaatttaacaggttttggatcaatttccgtgaaatctctgtaaattccattcacttgaaaagagaccttagtgctgtatagcgtcagatttcagatcttgttgggattgtgctgaggcacgttaacgtttgtggtggcgttaggtgattaaacagaaaaacagctcatgtaatctactagatacaagacaaagcatgtgggtgtcataaaatcgcaagggtagttcagagtttgtatattttgtatcaggaggatttagatttgcttcagcttgatctgaataacgtcattcaccaaacacaacgtggctggctgctgctggtgaattttgatcaccaatggtcggaaactctgaatgggccaaagcatagctcagcaacaaatgcaggtatttcatgactctcagacatttttctctgaagatttagtgagatcagataagagtgccatttccttcattctaaaatatagc

SEQ ID NO: 66550 - DNA, 1300 bp, Oryza sativa
gtttttgtcagctttccttcctctttgtacagtcgttgttagctttatcactgcttaattctagttgtatcacatcaaatggtaaaaaaaaatatcgaatataataaaaagcaaaggaataatgacaatggaggaaattttatttttatgtgtcacatttgttcaatcttaagaaaatatttgcttggcacttaacactttttttagaaacacattacatacacagatgtccacaacgcacgtacagtcacctctatgaacgcacacacgcacatcgtaccttgcatatcactgaaagaataattatccgtaaatgggagcatccgtgttaaatctaaaatttgaacccgggtggattggttccaccacaaggaacctaactagttaaactatgctcacttcgcgcttcgaacttaacacttagttgactcatccatctaattaaaatatactttttattcatatgcaaagtacagctaatgaacatgtacacgcatatgagctatactcgcctatataggttcacttccgaatattcaggtgtgtctaaatagcctggtcgatctctttcatttgcagatttcatccttgattacactgggaaagtgcaccgaataccattttcaactatgctcttactatatttagtagaattgttatatgacacatggttttatttatgggagaactacgtcctcgagcctgaggtctgaatttattcataatagtactcctattgacttcggctttagtgatgaacaaatttgctttgtcgaaatccttataatgagtagcatttgctgctgccgaataaaccaactttaagatgggataagatgctcgataaggcatgaggtttaatatcataacagtttcttcgtagtaacaccaacaaatctcatccataactctttgtactttgaaaacggacatgtggatgtgttttcgtgctttgaaaaccctcgtacttaagtagacgatcggttggtatacttttcttctgagtttctttggcccactcttcttcttctttatcctaggggtatactttaacagtttgaaacttgtcataaataagattattccccgcttacctatttcttttttttaacacatttgtttcgttatagactagccatcacaccatcatcaacaaggaatcaaaagccttctcataaccaagcctcgtcctgatcttgtggtcttatgaacttaacatgcagctagccggacatctttcattgcacaaattcttagaagaacataagtatgtacccttgaatgccaattctggaaatat

SEQ ID NO: 66551 - DNA, 602 bp, Oryza sativa
caatcacaatgtgacacctcatatgtgtaaaaagtttataaaaatagtttagtacgcatatcgtttcccttctcctgttagaaagcggggatggttaaaattgatcttcataggaaataaatactccttattagtactaattattccatacatggatggtaattatgtagaaaagatgttgcgatggagctctggtggccacacaacttatgtggagttggctccgcgctgcgcttgcgcatccatcacattgttcacatggtttcgctctacctgtgcccgatccggcctattgccatcaaaaaaacaaaggaagaaaactatatgatctgcggtaggagtatgtcaaaaaaccataattacaccttgtttagatcctacctcaaaattttacaccatatcacatcgaatgtttgaacacatatataaagtatttaatatagattaaaataataactaattgcacatattgcgactaatttgcgagatgaatcttttaagcctaattgctccatgatttgacaatgtggtgctacagtaaacatttgctaatgatggattaattaggcttaataaatttgtctcacggtttactgacagat

SEQ ID NO: 66552 - DNA, 8837 bp, Oryza sativa
gtgtttctgtatcaaacgtttgaccgttcgtcttatttgaaaaaattatgattgtttttaaaaaaataagtcatgcataaactactattcatattttatcatctaataacaattagaatactatttataaaaatatttcaaataaaacggacggtcaaatgttgagcactaaaacccacaactgcacttattatgggacgggggaagtagaacttatgcgattgctatttcatgtattattatattagttcgtgcagtccaaatatatactccactcatttcatattatctgtcattctacttttgttgtaagtcaaacattatatttctaaccatccatttttacatatttatatagtttaacatttagattcaacatgagaaataatttcataatttatagttcgtactccctccgtaaaaaaaaatacaacttctagctaacaatttacacataagctatgctcagattcgtagtcataagttcaactctctctctatatatatgtgcgcgcacgcgcgtgaaaactgctaggaattgacagttaaagctgaaaggatgagtggtttgtagcagagggagcagtggaagattaatccacatgtgagaaaagatttcttacaatgaaagaagattggtgaggtttcctagttcctttggaagtagtccagatagtggattgaaagataatgaccttgagatgattagcaataattaaaaaaaaacaacgaccaatagatggaacatgatctagaacaaacatgtaactcatacaagtattgcattgaagtaaattttccgatgaacgacggaatgggaccagtcaagtaattacggaataagttcctgaaaagatcacaaaaataaactagaacaattagccaacacaaaaataatgatgaatacctgacaagcatttgttggtgttcacagaaagaaccatgggattgaatttatattttgtgcaaacccttgatctataaattattagtacaagactctttagtagtgccacaccctgattttgtttcaggaatttataaattatttaataaaatacttctagaatttatattaaagtgtacattaattaagaaaatgaattaaagtgggaaataaagtttcctaaataaaacattgctggatttaatttttattatattctccatgattagtttacactctctagaattttttcggatttttcagagctcaattactaattttaacaatacaaacatcaattcaatggttatttaaatataaaataaattagaaacccctccaaagttctgggtcgaattgagcccatgtctctctctccgcgctcagcgcagctagcgctaggccgctagcctaagtcaccagcccaccgcctccctcctctcactcctgccaacatgtgggatctggtcccacatgttagtgttgtccccagcatccagccagaatcacactgtctgcgttcctctccaaatccagccgcctctctagatcttttccaaaattagttgaggccgtttgttccctatctcctctttcctttccccatgaaatccccaaaaatatctaagtaaatcgtgtggaatcgagctcgaactcggacactctctatccggtagaaccctagtttttcccagcgctgccatagccgtcttaggcccggatacattatctcgtggctacaaacaggatccccctccctctcctctttccgctgccaccctcgcctgcacaaatcggagcctgtagccctagcttcgccgctagcccatagcatcagcactgctgccaccttccagtcggatcacgtcgttgctctactcgtcgccgctctacttgtcgccttcgcccactgtcaccttcgccgggtgcgcaaggaggaggcgcatttcatctgccggtcctccatcaccctatactgccagaacaccgctattgacgatgacccgagctacaccgtcatttccacctcgtcgccttcaccgtccgtcgtcgcaacgcctctcgatgagttcggctcgtcacactcaacctctcggtaccctccgttcatgctgccgtgcctgattcgccggcgatctttgggttccgagcaggtcgtcgccggtgaggtgacatcatcaccacgccattgctattgtgttatcaccaaaagttggtaaggttccttagtggatttggttgaaggacaaatttgatcaaccaatggaagtctatccagaagataccgaattcaaaaaggattgtgaagaccatggcatggcatattaattctatctgttgatttagtaactttcctttaatctttaggaagttttatctaatgtctgattaagacttgtattttttccttttatgtttagcaaacctatgtcttgtctgattaggacttgcatcaacctgaggagataaatatgtaccacagggtctttgtaaactttctccacatattaatacaattactttcggcgcattgcaaccttttgttctagcaagttcttactttgagttgggctgcattggttttgatctccaatgaggaagtaatttctatcaacttttcatgtatcgccgtggcaagaactttctcgattaagtcaggtattctttttgggttgacgcaagcattacatatccgatatattgattctatctttaactgcattgccgtttagagttgcatcgacttagttaggactttcttggttaggtccgatattctgatttagttgatatttctctaattatactattgttttagatagatttgttatatccatcacgtctgtgtagatttatcggataaataggttttttaggggcaattgcttatttgaccatgtttaaaagcataactactaatttgaccctacaattttcagtttgcttatttgaccctgttcatcaaaatcaaatgaaccgtctgaccctgttccgttaaggcgggttaacactgttaaataagaggcaaatagtcccttttgcccttgcttatttggccctcttgtatccaaacattcatacaaatggatcttttaacaaatcagaatcaatttgacaaatttaatacacagtagctggaggttgatgctgggtgccgccgccgaccaccctttgcacgccactgctccccgcgacagcgccgctgcggacaaaccgatgcctccacaagcgaattaaacggcccatcgaatgaactcgcgagggaattcttatactcttgcatgcccccttcacttgtagagaaacgtctaggcgcagcaaattaatcaagtgctctgataatcaatatctcatcaaggttatccaagtagtagccagatcaatatctcgataataatccggaacacgttcaccatggtcgtcggcgcacccaccgtggcgttcttcttgagagacctgagtaggtcgtcaacgaaacgctccatcctcctccacttctgccgcggtcggccgctgatgcgacacgggaattccgagatacctacacgcatcgcgtgatgccgcggccgctccgtcgcgcaatggcgtttgcgccgacctccctatccgtgcggcagccgccgcttccccatgcgctgccgacgctgctgctccctacctccacgcatcggcggtgctgctagccactccctcgacgcaccgccgccaccgcagatccatttctccatgtgccgcttgtaagagatgagagagacaaggtgggatggatagggttgaagtgccttgatggtattttggtcagtttaaatagtaaatagattttttttctttttctagaagaaaccctaatgatgtagtggaaagagggtcagacggagtgttcaatttaaaaaagtcaaataagcaaactaagaaaaacatagtcagattagaagttaggcttcaaaacagggtcaaataagcaattatcccattttttatcatcttcaatcttatactgtctcgtttaggtttgatttattagattgttgctaatatgtaattatattctactaagccgataagtttttatgcaacattttattagagttctagccaattagttatcttgttactacttctaagtgttgtatcgtcttatactcaaacttgtataatcaatagttaaatatctctttatcaacttcaatatcataccgtctcgattaattaggtctgatctatcaagattatctttgattaggaatggtttattgacgattgatgaaaaccttatatacatcggctagccttgctacatcacatcagcctattggctgatcggctctttgatcttatacaatccatctatctatcttcttaattgtacgatcaaactaaccgccacgccctacacccgattgatacgacgagctatgtggatctctcaggccttcgtgtgcgacaaatttcacgtcaacatgttgccacgtggttccatctaaaccctagattgaatcggtttgagccgtcagatcttggttaactcttggttaactcttggtcaagatcaatctcggttgtccatctcagtgaacatgtggtcaatctctgtggacctactctacggtggactgattgctgatgacatcataatttatctttttcttctttaaaataattataaattatgtaataaatctatttaatccttttaaataggctttagttgaattaaatcttgtaaaattcattactaattcatatgaagtcgaaatgaggcagttcataattcatctaaaataaagctctaaatgtttgtttactttttatgtattgtttatttggtttttattagtcttttttctcgttttgcatgttagcttgtagtttccatcctttttatatattgtttaattgattattgtaaggcatgtcacacatgtcccaaacaatccctttgagcatgttgataaaatatttaaattcttcttttattttaaatgtgcatttaatttcgaatgtcattaggtggtgggaacctttcctttgaatagctagtttgtattgataatcctgttccttgatatcttgggatataatttgactagcttgagccatatatattggttcgactagatattagtgtaattgcttagccatgctaagaaacattagtatcattttacatgcaataactaatgattcactcatgattaatgatggttaattaatggtatgttgtgatgtttggtcatggttgattaataatatgctaactaaaacttgactaatggtaggttttgagcacatggatgtgatgatcatgctcatcacaattaaggaccggttttgtatagcatgattcatcatggagcaccacactaagaagtggtagagataggcccatgtgggtcactgcggagtctattccgggctatggaaagacgatgatccgggaacggtgaactactttgagttgagctatgcgaagagtcacaattttgcacgtggtgacatattaagcgtgggcacacgataacatggtgacatgttgtggaattgtcttgtgggtatattggtacacatctgactagagtaaaacttttcaaatagccatacatgcggttattggcaagcctagcaatgtttttttggtgattagtcacacactactcattaatcataaataaattggtcataacaatttgtttgcattttgtatggactttagatctgtgtagtcgggtttggttgtttagagatggttgggcctacgcagcataggtatgctattcagagttgattttaaattgattaattactctcaactatttactgaatgttgcttttgcaaatgaaccctactataccttcctttgtatccccatgcacctgcattttttctatgtggcttacggagtattctatttactcaccttgcaataatcatcaaatctcagttgaagaaagttttcgaaggagaagacatgtggcttatacctcagttgaactgtctgtgagagtggagctgaagctaatgttagattgtttgttacctgttgttttcttttcatttataagtaatatctaacgtaattataatattggatctgtatattcaattgtcaattttagtatctcagctaattagtagatgagtgtattatatgcacaacttagttcggaaattactagtgaatttccgaatgtgacaggtagcaagataaattaagaagagaagtcttcgataccgtacaggtccactagatgggtgagattctgtagctccgcaggtatttgaccaactacatccaaataagttaccctcctacataacaaacaagtaataattctgataagagaactatgttcaggatacatatatacagccggaggaccaaatgaatacctccgtttgggtccagcagatatgtacaatttttctttagggaagatctgtaccaaatttaggatagacttttctgattcctctatatgcagccttggagatactaattaatatcaataatctggtgtgtgtctatatatatatacacatatatatgtatgtatgtgtgtgtgtgtctatatatatatatatatatatatatcttaatttgcatacttgcatatacgtgtatatgggctagcacacacgatgaaaccacgataaagataaagagagtgtgcgtacagtctcgtaatgtggcagagggtgttgttgttgaatgtgcaatcgcacttgatgaacgggttgatgtcgcggtagttatcccaatcggttttatcagctgcgaaaccgctgcagagctcaccgctgatgttccactccggtgatgccttcttgccccatctccctagtatcgtgttcagagcagccgctgcatggttaatttattaactcaccattagtaatcatgcggatgaaagctacgcaatagtgaaatcagacttcatgaaactcacgggttgctgcgtaagttttatacagtaataatagaaataacatataatcagtaggcataacattatataatttcatctttatcgactgcagaaaaaaaactatatacaattaggatgttatttataataatttaaactagattggccatttaaaatcacaacaatagtgatgtggctaagtacatcatcttaaatataaaacaaaggtgatacggcttaataacaaaagaaaacgtgagagataatttgaacaatatacctatctcaactatcatagggataaagaaacaatttagatgatgtggcttaataagaaaagatataaatagcattaataaccactgtagaaatgaactttatataaatatataggatttctctaactctttggtttcaacgcggcaagagcggacacactatcaaagttattatcaaccacaaattagtactcctgcgatcaaagtacatggagggaaaccaaacaagagagacatgcatgcgtggaagcctgccaatggtttgaaatccaatccacaaccagcccaaaccaaagcagtaagctacacaagtccaaaccactctaattcatttgtcttctcttagaatccaaaccaatccaacccatatcatatttcaacccaaatcaacccaacccatttcatctatatggattcagttcacttttccagtccatttcaccccattccaaatcgacaccaaccacatgtcggcgacgaggtgggcgaggagcatcggcggcgagccgaggaagtcgcagcgcgactccgagcaggagcagggcgcgtgcgggcaggcgcgctggtggccggcgacgtcgtaataggcgacgtagctccagcagccgaacaggtcgttggggcacaggatcttggcggcgccgccgcacgcgtggcactgcttgccgggacgtcgccatggcagctgctgcacgccaagtgccccgccgcggactgcacgccaagaaattgccactagccgagccctcacgaatcgaatgaaagaacaacaacaagaagaagaatgtcagatggattggatgaacagctaggaaggaggcagatagggcaacggagcacggccaagtcgatccgcttttcttcttcttctccggctccggctgcagctccctcgccgcgcgccgcttccaccgccttttctcgcttcacttggccgttgggcgacaccacccacgccgccttcttggcgccgctctgctcgtcgtgctgcctgtacgccgcactgttcgcgctcaacttggccacgtggttcggcgacggcgtggacggcgagctcgtcggcgccatgcgcgccgtgcagcaggagttccctccgcttcctcccccgcgcccgcgtcttctccaccttccagaaggcggcgggcggcggcggcggaagctctccgacggcgaacctagtgcggcggccggacatccaaacgcggctgcgcggcgaggtcgaggcggccgagggcggtggtgatggagtgcctctgtgtctgagacgacatcatctgctatttggggatgaatccaattgaaatccatggactccatccattttagacccaaaaattatgactaaaaaccaatccaatccaacccaaccatccctcatccaagctgctccaatccattagttatctcaacccgtttacacccataccaagtgaatccaaattgaaaaccaatccattagacccattccaatccaacccattggcaggctacatatacgtacgcgtgcattcttaattaccttcgactggatcagtttttggtgcttgttgatcctgagcagctgcaacccgccatgagcacaaattagcaccagccacgccagatggtggcgaatgacacctctgatgctgcaagaacgcatatctctccctctctctctctctatctaacaacactgtgtgcat

SEQ ID NO: 66553 - DNA, 644 bp, Oryza sativa
aattaactaacaccattgcggtggcaccaatccaaagctatgctcatagtcaaagtctatgtaataatgtgatccccatgtgtgtgctagttgaactaagcatggctaagcatttcctaaaccaacatctagtcattttgatacccaagttatcaatggcataaggtaaacaataaatggctgagtattaggacccatcccacatgacattgtaaaaggatgcaacatttaatagaaatgcgggatatttgtaaattgggtacaatatgatcaaacgtattgcatgacttgccttgctctcgcactgacgagacctcagcaacgtcttcgagaaaccgtggatcgacgaaacggccgaaacctacgcgacaaacaaagcacacaagcaaaacatgctataagactactgaaacaggaaacaaaactatttttaatggattctttgcatttttcttgatttactgagacttgaatggacttaaacagagctcggatgaattacttatgaattttagaagataaactgtgtttttactaataaagaaaagcccttaatcaatttattgcgcaataaagcccagggctgacgtcagcgaggggagggggtggcgccgacaggcgggccccactggtcagcggcacta

SEQ ID NO: 66554 - DNA, 7932 bp, Oryza sativa
ggggagaaaccctccttctcctctccctccgccgccggccgtgacgacgacgactaccgtgacgccgacgcttgggtcccaccgctgactgcgacgacgacgccgccatcgcctggatccgctggagggagaggccgtcgacgccgccaacggattaggtggtggcgccggattttttttttgttagttgaaaatattttcacaggcgggtggatctactgcctgcgaaaatagatgccgcctgtaaaaatgattttcgcaagcgggctattttcgtagtcgtttgtctacaggcagtccttccccctgcctggaaaaactattttttaccgcctacaaaaatgcttttagtgttggagcatctattgcacctgctcttacggccctcttctctaggatttgaaccatgatgattggagttatatagccacgactttactgccacactattgatgttaccccctcttttcttatttctctttcttcgttaattagtttgctttttaaaaagatactaaatttttacgtaggattttaatttatatgattttttttctgttattttttttcagatttcaggattcgggtcgtctgtcaatttggagcagaattgcacataggctgacatatttgacgcaatgcaacactgttgtataatacaacacttctgtttttattccttaacttgctgcaaatggcacgtgaatttatggatgaatttcttaaaacgaaaggcaagacagcaccaatgatttacgtatccatatatatttatattaaggtaatatccattggtaagaggagactgaacattattatctaggcttaattaagaaataaaattgatgcttagttgcttacatcccagtcatagggattagataatgtaattattcacatgattattgttgatatttcttaacgacattactagaaatataatttccaacaatgaagcccgaaatgttactcggtattctttacggatacagttataatccgcaagcacgcggatataccgttgtattccaaggtatctatttatttaatcccaagggaagatatgataagagagtattatgctaataattttatcgcttgtatagatcaaagtctaacgcaggggttaatcaattcgagtatagggtaggttgacacatagaagaaactaatcataatactctcattcaaaaaatattctaaactaagtggagaaagaataagaaaagaatcatttctgcacttctaatatataattattttaatctacacttgctattgtacaattatgcagccaataccccctaactatgccctcctagtatatcttgaagccacccctaattgccgagtttcttacgacaacccgtcacagccatccaactggtaaagaatacggaggagtacccacaccaggaaattctcttagtattatatatgcacgtggaggaatactcgtactgagttgtcaccattagtgacctacctctacagacatgtggcatataacagcttttaatggtatctaataatctaagcactgcgcttacattactaaatactactctacatctctgcagatgacatagagcaatcatataaatgaacattaaaccaataccattgcatatctctagtaagcttgctacataattattacgatttacgagacaagtataagcaaaagtcggtactcgaataattatataagtaaagtaaagtaccaaagctatataaataagaatattcattattgaataaagtcttacaagaggtagaagggatactagagccatacccgaaatcttcggaagacttgaagaactaagaaactattctaattctactccactagtactagaacaaagtaaataaactaaagagaattcttgatttcttcttcttggtttgtgttgaagtggataaggtgaactccttaaacaggctgccaatgatggttgtggcggttggaattgtcagaaatgccccgcaaccatcattggggagtgatcagggatgtccacgtgtacggccaggatgaaagggcctgatggcggttcagccaaaccctaggccccacctcctggcctatcctttggccaggaggctgactggtgggtccttatggcgttatgatagttatgacccattttgtggtggtttcacctgacttgtgggcccttcaatccttatactcgcgcctgattggtcggaggtgtgtctttgataatattttccattattcttctccatttgtatgaagatctctatatacaaataaagttccaagtacaagtggaaatatattattgttagacaaatatgcatgcaagcattgctagttctccttgatttccgaatatattgatagtcgaaattggtctataatatccgtcaacaattatctcatagttcttaagttgtaattgtgatatttgtgttcttcttttagtgtaggctattgtggatattgagttcgattgatgtattatgccgattctgaccatcttctccggatttttaatattacctacttcatcatgctagaaaaaaccactattatcagtgggtttctttgttttggtaaacatttttattgcttcctatttgttgttatacatcgtcatctttaagttaagttattgatattaaaatttttccttaaggatttctatttagtactagaaaaatgcccatgcttatttgaatattatgttaattacttgattcaaacaaatattgactattacataatatcagaaaatatcaagaactaatttgtaaaacatgtaaaatagtggtggtagagtggtagactgatgatagaaccaccaccactattatccttataatcctttatagtagtatagataatattgcgtgagaatttgatatgattgatgtaactcagacttgcattgtcgactcaacttggctcgagagccaatcgttttatcatttagcttgcacccctatggtggcctaccaacaggagacccattaccaaggccatctccaggaatttgggaccttgggatgaaatgcaaattggaccctaaattttcaaaattttatatgtctaatataaacaatataaacaaggcatagtttcactcaattatataacttcaatatgtgttattttcatacaaaaatatatcaaatattaacgctaaaattgtcaatgtagtgctaacctcatgttctacagaaaagcaccatttgtctattattttttaaaataaaatattaaattatatgtacgtaattaatctactccgagacatcattttcaatttctattgttgccaatccatcgagtctttcttatatcatagtacaacgacttgggtttagaaaagctcctttccatagatgcaacggtcacagcctcacatgaatggctaataaaactttgtatgcaataatagcattaggataaaaggggcgctccttcaaaactttaaaatatcaaagaacacccttttgagattgaattgcttcttctggtctttgcctcttctttcgcttttcagcaccagaatcgtacttcctatttctagctgacataatgaggattgaggaaataagtgtcttcctatttcataaacaaaagaaaagtaatttgagtcaaacagtcacatcactatttaagttttgattcaatcgatagtttgattcatattacatctactatttgatacgagactcaatgtctcaactcttaagtctaaaagtaactttccaatgctgcacaaaggtagtagtcagggacacgaagataagtggatgagaggcactgacaaaggtagccggccaaccgcttggcattgatggcgcttgcccgttggtcgctcgctgcctcgtgttgggctggggtcgggactttgcaggcatcgtcatttcatcgtcgaatttgaaatcgagattgactccagtcacacgacatgactacacaacagtgtgacttgatctcgttcgcctctcagcctccaatgcacctgatggcagatgggcctctctaatcgattcacaggtagaagcaggattgtggctcggctatgcattaatgtgcgcctctccgattaacttgggtgccccaaaaaaattgggggacactctatcatcgccaatgtcgcacacaaccttcgacaggcttgcccattagtgtgacactcctgcccacatcactgctccattgtcatccatcaccttgtcgaccattgtggtgtgccaaaccgcggctgtcgtctgtttgtgattttgtagtctgcttgtactccctctggaagtgtttttgttcgtcggtttacgagagatggcttgacctcaagaactagcctagacaagcaacactttagctcgtgatcctaactaaaccgagctgagcgtctctttcatcaagcttccacaatgcaagccaaaccaagctccgcgcttagctcatttccgcccctattttagggttgggccatatatggctgtgaagttgttcatggaacaaaacaaacaaatccatccattaattgcttggagttttcctttccactaatgttttgccttggttttacaacagagaaaacttttcttgacaaatagttccatagagcatatgtgatctttgctagcaaattcttggtaaaggattttaggtgcactgcagatagcaaaggtaaaaaatccataacacaataatatttacaaggatatttgtggccctgtggcaggacaatcatcaacatagttttgccacactattacatgagttcatatacatcacaatactgatagcatccggaagaacacttaatttatttacaaagcatccacaagtgagcgaacactgcacatttttttggacataaaacacacgctataaaggtattagtcaaacacacacagtaacacaaacttcaggcaacatacaagttagagtgccatgaaacacatacacacatcggcacccacagttagtcattcgatggagagcggctagtaagttgtaaactatagtaagcacacacagtagtagtaataccataattaccttttcattagatgtcttcatcctcaattgcatcaatctttttagtatttagaaaatcattagacaatgagctttttgatgcgtctttccgcaatgattttgacatggggacgttgagagagaatatcaaattccttgagaatatgaagcgcaccttgctctatctcaatagttttcagcgttgttggtacatcaagcttgatcttcttcagactaacaaatccaattgaagagaataaaagatgctcgtccttgtatgactcagaatataaggcaagggtttcaagagatgggagttcagcaagctttgaaatgaatccctgagatacctttgttttctccaatgaaagcatgctgagattaggaaggcatacatccataccagttatctcatataaaaattttagtttcccttgtaacttcatggacttgaggcggcgaagcgagattgtgatgaacacggttgatggaataatgtggccatgcaaggccaaattcctaagattctctagcttgctcagagcagcaaacaaagcctccatattaccagttgtaatgttccaaacaaataaattttctagatggaccatctttccaactgtcccaatcaaatccttctcacagttgtcaagctctattgagtcaagtgtctgcatatgcttcatgctgccaatttgtttaggcaatttgagggtaaaaccaaatacatgccttagtgtcttgatcatcaaccaaaagttcagtgggagcttccgaacattagtttctctgacatccaatgtctgtagaccactcaggcttccaatggacggagggatcactgtcaatgaacaagatgtaattccaaggtactgcagatgcacaacactacctattgcatgtggcaactcatcaccaatctcaatcccttgtaggtcaatgacacggaggaactctgatccttgtagcaatccttttatgtgagatctgatgtctttctgcttcttgttggttatccactgttgaggtggtgtgcaacattgtctagtttggtctcctttgggctcttgttcctttggctcttgctcaaactgagagaagatggatcgtagctttggcaatggattagctagggccgcatacttgtctgtgtaattctgtagagagaggcgacgagcacttgtcaaagtagggatgtcatcaccactatgcacctccaagaaacttgcctcatgcgcttcagattgcaaaaactcatgtactttgttttggatggagatgaacatagtcccggtagtagaattatcatctacaagaacaagattgactagattcctggaaatcagctcattcaggaagatgtagcccaccttctccaatgtctttccaactctaggtgttagaaatccctctgccatccacatacacaccaagttgcgtgcctcgaccactacattgggaggaaatgcagcaaagtatagatagcaacatttcagttcgtgtggaagatcatcaaaacacagggacagtagattgtcgagccgctttgatttcttggaactaagatacttgaatacttctgtccactcatggggaaactctttggtttggacaagacctgataaaagaacaacagccagaggcaacccttccgtgattttgcatatgtcttcacggtattcttcaagtttttgatattgtgcatcaaattggagtagtttcttcaacttcaataccattggacctccggcatcaccttgcttgtcttggtttcgtaatcgcttgtggaacaatttcatgacaacattattttcaagaggttctaaccgaatgtgatgatgataatagagagacgactgttctggtctgtcaaatctgatatgcactattctattaccagtagaaccgactgcaagggtagtgagcatagtgataatgttcttccattcagttctgctaacttcaccatctatcaccagtaagtatttcttatctctcaacgctgtagccaacatttcatggaccatgcttctaggacaattcttgttgtcttctgtaagctgctgaacaatttgatgtaggatgttgggggctgttaaatgaggtgcaaaactctccatagcatgaacatcaaaacaattcttcttcttcattatattgtacacatttctcacaagagttgtcttgccaaccccactctttccagatacagagaccacaattggacgattatcatttttctgtagttcttgatctgttggagtaagggctttctcaagttcctcttggtgctcttcatataatgtcaaatttccttgttgtaaatcatccctgtagttaaaacattatacagttagtacattaaagagtaaatttgcataatgccaaagtgcagtgtattgagaatcagtatcaagtttgaaccatctagctgccttttccccaaatattggtaattcagaatcttgtgtacatatataagcccaaaacccgtttatgtaactttatgaaggagaagagattactgatgaggcatgcactttatgtacatgtatttttttcgtatttcagtataatttttatcttaaccactagcatttatgcaatgctagtcatgaagcagctagtaggtgcatgctagtaatttcaaaaaacaaactttttctagtaaatttaaaaggtaaatttaagtctatctatttctgattagtttgagagcttttctactttgtacctaatatccacacggttcatcatacagacctaaaatttgataatatatggtgtatatttcaacataccttgggcaaatttcaaagttgttttgcataacgtggcagtaacatggcccaagtaaaaatatttttaaacatctactacctccgttttttaatagatgacgccgg

SEQ ID NO: 66555 - DNA, 4402 bp, Oryza sativa
tacacataatcccatatcagcatcttccaaaagaatcctcatagaacttgtttttattacacatgtcttccttagtacacgaatacaaggccctgccttaaacaaaaagggaaggtgcttaacatcggtacattgcatcctcaacatgaatcttccataaacataacaagctcattgtttaaaatcatgaatatatttatttattacatgattgctgcaaactttcgattacacaatgataagtagcaaacggaaaaccacaaacgtggctactcattttgattctggagagatatagctggtattgttctagtgactgcatcctggattggttctgtgatgatgtgttattactgcatattgctatcattcacaggagaagcttccttctgattgctagttgaagcggataatggtcttctgcttcgtatcgccctcctgaggttgattgccctttgctcggcctagagtaggtcggggagagacacaacttcttccatcaacgacaattctttgctgaggctgtcggtgcagagaatggttggtgctgaaggtattattgctatgatttattgcagagtcaggtgcagcaggaggagcattggtgttgtggatgatatcgtcgatgttgctgttggagctgactagctgatgagacaaccgtagagttgttcgttggatttctgcggtcttggtcaacaacacactaagttggcaatccttgggcacatggtttgtaccttcgcacagaaaacatgtgaccttgcgggtgggacactcccctggtggatggtcttcttcacaatgagggcagagtgtgagacacatgctagcaatgtgtccaatttctccgcaacgggtgcatgcctttgattccatctcttcctcgccgacatgtcggggagactcatcttcatcatccgaggagacttgatctgacccttcactatcagatactctgccaccatggcttagaaggtgctgggtcaactgtcgggcacctcgaaaggtatttcctctttgacgtctaggaatagttatccctgctggaggccattcggtgctggtaatagtcatcttacgtacttcttcttcagttcgcatcggtgcttttctcttctgattcttactcttcttgactttggcttgcttagtacgtgaccccacgtgatacgaaaggctaggaggaaagcatttcccgggattccatggattctctccattgggctctctactttgcacactaggctgcaagcttgacttggtgtgaggaggctggtttagcgatgtctgccctgctaaaccaaaggaaggggcttctttgacatatacccatggacaattcagggcatagtgtccttgttctctacaatcatgacaaaaggggacatcctcttctggcattggaagctcattgacctgggtggcaaatgttcgatcaaacacatactgattttggtcttgacttccaaccaatggtagctgtgaaccaagcagcatgctcggaatggaccaagggtgtgcccttgttaactctcttgaggccagtggtggattgagttgaaaacttgagttacttgaggcatacccgctgacattctttcctttttctctgttaaacatctgttacagggattgaggtgagagaggaaacaagctaggaaagaatagaccagaactagagacaggaccttaaaggaactaactctttttgttgttgtgttgtttgtttcacttattctgcaagttgattaagcaaacaacctagcatggttacatcacaacccaccgatgcaaaccacacactacacacacaagcaaggaaacacacgacaaacgaaacactagagggtggcttatgttctgcgacgggttcccaagatcttcactccttcacagctggcttcactgcttcctccacttcgctagcggaccctgcggtcttccggaccttcggcgaacaattggcgacatcttcttcttcgcaaaactaaccaactagtactagttgaaatttgaagaaggaagaaaagggtataccttttgcaaatagcattaggggaaggagaaaaagaggaactttcgcaaatagttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaaggggggagaaagatagagcaagaatgagtacaaccacagtactcagcaagccacaccggagatgcataattaatgcaagggagtacaaggggataataatataggggttaagttttgcagtaaacagcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggcagacaggattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccaatttggggattttgaatagaaggagcggtgtgaagccaaatccacaataaccaaaccattccatagtgtccaggtgatatgaatattcccaaagtctagagttgtaaaaccacctaatgttacctaattaaattgcgaagcatctacctaaaattaaactagtggtgccatgagtagagtgtccactagttggggttttgtttactctagggtgaacaaggaaataataacaataacaataataaggtcataacaaaggtaaataggcatggctagataaaacagtgataacgcaggaatttaaataaagcgataatgcaataatttaaatcaacataattttataaactgggattcaatatgttcaaggatgatgtgacttgccttgctcgctttcccaaacgtcggcttcaacttccacgaagagcggatcttccgaagctgcagcgtctacacgaccgacggaaaagaaaaggcttttactctactaaaccccatataacaagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaatttaaaatcggatttattgcgtcagccgaggggaggggcgcgcggaccgggtccacgggagtggggcccacgcggcagcctctcggtccacggtggaccgggcgcacgcggcttgcgctggccggcgccgtgggtcccacgcgtcagccgcacccgagggcgcgggcggctgacggccgggccccacatggcagacgcggggcgcgcccgaaggcggcctcgccggcacggccgacgggaggcggtgcgcccgcgccccgattgtcgccggcggcgaacttcggcgcgactgagcggcgccccagagaggggagggaaagaggaaacgagatggcggtcctcggctcaccccgggttgacggcgacgaccgaaaccgcgaccgaagccgaaaaaggcgcggtcctgttcggt

SEQ ID NO: 66556 - DNA, 16177 bp, Oryza sativa
agtcaacggcgtcatctattaaaaaatggaggtagtatgattttacagaccagagacttacctccatgtacaatagtatacttgttactaagttgttcgtatatttatctgcagtaccgttggatagcgtacgtttcaatttttgtgggatgctgcttcctagtggtgttctatgctggaacaaaggagccgacgtatgtttttcttttttcagcgtagaataatgcattagacttttttttgggccgtgaagggtgttttctgaaagggagtgaatttggttttgcagtttgcagtcgggatctgactgcaagaaatcggctaggatttcctggggctactggttcaagaaggccttgtactaccaagtcgctctgttgtatatgcttgcaagattgatcacaaatgtctctcaggttgacatcgtccccactcagaatagaaaatattcttaattactactagcaacatgaaaatgcacattgcatactctaccatatctgttccactgtgacactgattgccaaatacgcatttcgctccctaagttttctctcaagtctgaacattagtctaaaagaatttttttttcagtctctcatcgcgttctacgtcactagagacttgaagatgaatgagtactccaaagcgattgtgagttttcaaacctttttggttaacctctgtccttagaagataccaatcatctaattctctaatttttgacctgcatatatgcagataccagccatcatattttgctgcagcttcctcgtctctgttgttctccaggtctactcctgtcagttaacccacttatactagaactagaatataacaagttaagttttttctcacgtattttgcaagtaaaatgcaggagataaagtggaacagccgccgcctgaagtcgctcctcaccatcggagcaatactctgggtgatcgctggagccgccgtcttcgtcctcccgagtcagatgcacaaccttatgtaccctctcgctatggtcatcggagctgcaaacgccctcgtcatggtaaagaacaacaagaactgcacttctcatttagagaacaagaactgcaattgtcatttttgcgtgatgggacgaatgatcttcgagttctgcttatgctcatgtgtgctgatttcctgatcaggtgaccacaattgggctagagagcgcgctggtaggagacgacttgaacggctgcgccttcgtctacggctcgctcagcttcctggacaagatgtcgtgtggaatcgccttgtttgttctagaatcatacgaaggtatccgctgtaaaaatggcatatttcagcgcattaaccacctaaattcaggatgctttggtttgtggatacaattgatgatcactcattgaaattatgtttctctcttattgcagattcgattagctgcggcgagacgagggggctgtacacggtgagcaggtttgggacaggtctgatcccctcgtgctttgcagtcttcgcgctgctggtcacctcaaccctgaagctccaggacaccaacccgagagctgccgccgctgcactggaagctccactcctcgtctgaagcacgcctccgagtgtgcttctcttaaactacaggacaccagaaaaatcgactgtatgtatcactgtatgtatcacgggaagaagaagaagaacatacataagatgaaattgcattgcagaaccctcttcagttcggtctgaagaggtaagctgcagtctgaagaggtaagctgcagcgtgatagtgtctagtaagattcagaattctggcccgaatcttaaaccttcgatgcttgtaggcagttagaaatgatctaatcagctctgttactgcttcttttcaattagatttgaaaaggtccaatgcttgtagcaatctgtaccagtgttgtatcaaagattcagtttcgagtgaggtttccgtggaaaacagcaaaagattcagttttgagtgaagtttcagtgggaaaaacacagtaacttgtttcaaacaagttctctacagaatacaaacaagttctctacagaaagatcacattattgtacaaaatgcaacagcatacagaaaacggcatcgtgtggagagctacagcaaacacactgaaaaacatcactgaaaagtgctatgttgacatgggctaatcggtgtccgtacgccggcggctagctcagagctcgtcgaccgtgcggggcttttgcttgccgtcgacgtggcggtggtgatgcttcttctccttgccgtgatcggcggcgtcgtcggcgccggtgacgcgctccttcacctcctccaccttctccttcgccttctccttcaccttctcgtacccctcgttcgccttctccctcgccgcctccgccgtctcccacgcggcgtccttcgccgcctccgccttctcccacgccgcgtccttcgccgcgccggccttccccttcgccgcctccttggactgcctcgccttctcgccggccgcctccgccttctcccgcgccgcgtccttcgccgccccggccttctccgccgcggcgtccttcgccgagcttgtcttctcccacgccgcgtccttcgccgacccggccttctccgccgcggcgtccttcgccgagctggtcctctcccacgcgctgtccttcgccgccccggccttctccgcggcggcgtcggtggattgccggagcgtctcctgcgccttgccggccttgtccctggcggcgtcggtggattgccggagagtctcctgcgccttgccggccttgtccttggcggcgtcggtggattgccggagagtctcctgcgccttgccggccttgtccttggcggcgtcgtacccctcgccggccttctccttggccgtctcttcgaccttggccttgccctgcttcgactgctcgtgcacctcggcgcccctctcgccggccgcctcggcggcctccttggtcttgtgcttggcctgctccgctctcctggtcgcctcgccggcggcgcccttcgccgcctccttcgtcttctcctttgcctgctcagccttgctcgacgcgcccgacgccgtcgcctccgccgcctccttcgcgtccccggccttcttgctcgtctgcctccctgcctctgcacagtcgcgcgcacacacacacacacacacacacacacccacatgttaattagctccaacacacgatggcatcaggcatggcaagatgccgccggcgagcgcgcgcggcggcgcgcggcgagtttcgacgtaccggaggcggtgtgctgggcggacttggcggcgtggccggccttgcgcgcggcgtcctcctcctcgtcgacgtcggcgacgtggtgcttcagcccgagcccctcggtgatcttctccttggcccagcccgtccacgactcgtcctccttgctcgccgcgtcctccgtgccagcctccgccttcgtcgccacggcggccgccgccaccacagcaaacagcagcagcagcagcgtcaccgccagcctcctcgaccgcgacacgatcgccattgctcgtgacgtacgtgaactcctccaaacaagaacagataatcgctttcgcgtgctagagaatacgagaagtcgcgaacccaacagtgcggtgatcacgctggggtttatggggttttatgggggagatgggtgaggacgcgtggagaggttggcgatggcgaggcgggtggccgcgcgacgggtgtccgtctcgggtggcacgtcgtccgccgcgggctggcacgtacgcagcgcgagtagaagcttttttgggttgggcaacttggaatttggatgatgaagagggttctaggcgtttcggctcgacccctttgacgttgcgtgtcgcggaggaggcagcacgtgtggtccgattttgggtcggccggtgtccgatggtgtgatggttttggtttggtatctcctttggttgccaacgcacgcagggagatggtatggtagtagtaaagaaatggagcatgttgaagcatgtttgtcgtcatggagcatcgtcagcacatcacggcaccaggctagaaaagtgattcgtatcactcgatcgtaaatcgtaatattagatatcttaatcttaattattttaatattttatttgttttatattataaatcgctttgaattttcttaagttcaacttcttcaagtatgattaagtttatgaaaaaatttagtaatatctacaacacaaaattagtttcgttcaaactaacatttaatatttaatcttttttataatatgtttgttttgtgtcaaaaatattgctaaattttctataaatttgagtaaatttaacataagtttgattaggaaaaatattcaaaatgacttataatatgaaaaagagagtagttgatatcttgacttcctagttcctaactatcgaaataattggggttaagattttcggtattgatatggaagtagttcaagtgaacttattccgctgggctagggggaagtaggacggcccggttcgttcagtccgtatcagcccagattccattgtggggccgaagttgtacattttatgatgggccgtgccccctgataagttgggccaaattctaactagcccatttctcctccaacaaaaaaagctggtccaaaacgtgacacggcgcgaggccgaccgaccgaacctgactgcgaagcgtgccgaactcagctactcctattacccaccgcggtagaaagatctgccacgagttgccgtgtccacgttccactcttctcttctcccgattttactcccaactttttttttcctctctctctctctctcgattttctcatctccactgctccacgcttccagggaagaacgtagaaatggcagcttgcttgccatccctctcaccgccgccgcatcaggcgccggtgccggcggcgacgaccgcgctggcggggaacctgacctcgtccctcctctccctgcccccgccgctgccccgcctcgccgtctcgcaccgcagggcggtggtcgccgcggcctcgtcccggcccccgcccccgccatcgcgggaggggggtgatggtggtggtgaggaggaggaggaggtggagagggcgatggggatggacggcggcatccctggcacctccggcgagttcctgcgccgcgtctcctcccgcgcgtacggcatgcggcgccacctcatggaatcgctcgactccctcgcctacgatggtaagagttgtcggatcctcaccctcttttcgtggatcgtatccgttcttgatcgattattaaggagtaaaagaaaaaaaatcttcgatcgatttaggggttttagtttttactagggggtttaccgagatcgctcgataaactgcgttctccatactcttgaagtgtccgaagatttcatctttatctgtttgatttggcatcagcaccaacgacgtgaggcttgtacgtgcacgcgtacataccgtatttcgtgatatacgtgtgattcgaggtttgcctagttaagacttaagagcatgcgtgtacgtgacaattaacagtaacaatctctagctgtttccacagtttttggctctgctcaatgtatcgagatttgaatgttgacatgtcattgtaacaaagtgctgaattgacatgtatgctgtagtaaaacataccatcctgcattcagtagtatcagaaacactgatccccactccctagttaagctttatattttaacactttgatttttcaatcaaagatcggttagaaatggtgttcaaaagatttatgcttttagaaatgctgttttctttgtatgctttgctaaactgttttacaagcatggcagtctgaaattttactaactggtgtttttcttctggttcagtgttggagacaaacccatggagagaagactccaaaccagtctatgtactggctagaagagataaccatctatggacaatgaaaacccgtaggagtcgcaggttagagttattttgctgctgttgcgcttacacgtgtaattttgctgttactgaacattctgaacaagtcatgttatctctattttcttcagtgaagttgaaagggaacttggaatgctcttaaagggagggggttcaggagttgggactaaatcaaaatactctggttccaagtttaacatgcttgttgaagatatcagagagggaatactggtgagtagttaaagagaggggttaaattttgtggatgatttctttgagaaccgactaggtgtcctgcttttcctctgggttttcagttgtttacatagctacttgcttgacattctcttgaatcatatcatcctttgtctcaggtatttgaagacgaggacgatgctgcaaaatactgtgacattctacagggtggcggccaaggttgtgaggggattgcagagatagaggcatcatcggtaagaaatttggtggacatgggccttcatagtaccaatttgtggttggcaattgatcatagtagtagtacttatgtaccgggttacactcgttcttgtctgcaggttttcaacatctgccataaaatgaaagctcttgccgtccttttccgtcgtggtaggacccctccattgcctcaaagccttgagcgcgacttaagggcaagaaagagatcattggaagactagagtctttctgatacatagtatagaacttctaattgtatattcgtctagctgttgaagcaaaggccctaggccctgtatactacgtggtatgtagatccacaatagcacgtggtacatacatccacaatagcctaagaggaaaggaagtcaaatctgacagaaaacatgtccaatagctcgagatattaacaatctcagtaaattgattattcttgccattatgtacattctaaatgcttcagtttacaatgaataaatgagatctgttaagttattctctccatcttttcttgaggcttgatgaacaatacaattatgttgccatcatgctgaattgctgatgatcagatgagctccaaacaatttggtgtagtgactgccatctctattactactggcagtgaatgcttggaaaagatcttctatttttgaaatgaaatgcttgaaaaaactttcagggtgtagtcttcttttcagttagcttctccctcctgtacctcttgaaatcggctgccaggccattgtcgaaatcctgcttcatctgcagtgctagctgcctcagcacctgcaccatgatcatcataaacaatcaaagacagaatgttaagattttgcaaagcagtatatatatgttgactgttgttaaattatttaaagcttttcattactctttggatagtttttgaacaaccaaagaaacatccactcgagggatcaaaatagctttccaataaaaaattcagatacccatcagctagggataaaaacagttctccaataaaaaaaattcagctacccatcagctaggatgagtcttttgacatgggtcacttacatgcgggccttttggaaatgtgggacccatataccagtcactcaaaatcagaggacagagtcgtgtagaggatctttccagtttccatgataccatctctttctgcttgcacaaaagcagcgaaggtgctgaaaaatgctcaccgtctcgccgacgcctctgatgacgccctccggcaccagcgcgagcaccggcggcaggttgaagccgacgctcatctcgacgtggcccctcaggctcttcctcccctccggccgcgggtacagcgacccgcggacggtcagggcgaggtgcgacggcatcgcgttgctgtccagcccgtccagcttgtagtccgtctgctcccccgccatagcagcgtttcagagctttcagagttctgaactttctctgacagaaaatgcaggaagagaaaaataaaatgggcggcgaattgttaccacttccatgagcaggaggctggttgccttgacggggacgtgcggcgggtactccttgccgccggatttgcttacgaaccgcatcacgatcaccggcgacgccgacaggaacaggaactggatcggcagaagctgcacgctccattcttcctgcagaaaaaaaaagaactctcttttagcctcgcagaaatagaaaaagctgatcatccttgcagaaatgaagccatgatcgccggagagaaattgttgctgacgacgagacaaaaaaaagagagcaaagcttcaacattttgcatgctttgcagtttgcacaaagtgaagttgagaaaaggaaattggggaagaaatggtgatgtgcaactgaactcacatcactgagcttggttctcttgcgcttatcagggaacacggctccaacaatcctgggcctgttctgaaggtactcatcgatggatgcctgcatcaggaaattcccagggaagagtcagatcatctcaaagagtgttaactgatcatctcccaaatcttacatgctacatgcatcaggcaagaaacctacccctggagtctcggtcatggggatgtcagtgttgaatctgtaggagaaggtgaacatgtctctcggattgatcttctccttcgacttcgacttgttgccataggaaggagtcttgagagtacatgtcgtgagcatcctcgacgacggtgaaacacccagaggaagatcatttcttgatcttgatcttgatatttctcccactgatctggatggtgtcaccctggtgcagatgcactgcatgctcctgctactacctgcaacacactacttgcactgttacattgctctcgtgtattcaagtgtaagtagcatgctgttagaatattgtttccttgaaacggaggagagttaggcacctggatggatggcatgatgagatgagctgacacttagcaatgccatcttcttccctgtaatggtatcctttctcttctttttcttcagagatggaagttgtgagctacacttgttggttgctgggccaataagtaaactccaacgaggtgtgcagaatttgcagagttgagtattcttgcaagtaaacgcaaacggagtctgtaggccctacagggcgtttatttcttccggggtttgttaggagtttctgaattttgtcttggtttttacggcatgtggggcttcgactttcaacttcagtgtttcatttcaactgcggccttctcttctctgacgaggtttgccggcttcagtatttcaggcttgtaactctgaaaacgaccaaagggaaaaataacgaaccgaggcgaatgaaatttcaagatgcctgcataaaactgaaacaggtctaaaaatttgctcttttaaaatttttatttccctttttttcttggctgaagatcatatgtgaacgtgtaaggttacggcctttgtttcatattataagtcttttgaattttttttcttagtcaaccttctctaagttgttattaagtttttagagaaatattagtaacatttccaatatgaaacaaacattgtatcaagtttattcaatgttaaatataataaaactaatttggtgttatagatgttgctagttttttatgtaatattgatcaaacctaaataacattgactaagaaaaatttttttttctttctcgcccccttgtagagaatcagaaaagaaatatattttctcagcataatcaaactctttcttgaggaaaatgaggtgtgtgcaattgtaatctaggacaaacgaaggctaaattgagtcgataaattgtttccaaaagataggctctttcagatattttaacgagtcttcggcgtgcacgtaagctcgaacacgacaaccatccaaaaacactattacacgtactatgtaatagtatgcccgggcataacacatgctaaaatcatgtattgatttcttacttcagatctcctaaaccatagatgcagtctttgtgcccattctatgcagatcatcaaataaacctctagaaacataaaggaatcttccgactagctccgtaagacaagatggtggggctagccagcctaagtttaaagctacactccgggtatttatgtttttctttttcaaataaacctctactacaagcttacttgggtacattctagttatgtagttgtcaagagtattctcagtataattatatcaccttaagtaattgattggattcaataaaaatttccataaccttaaaaaaaacgagcttagttcaagcgatcatatcagacttcagacatccccatgtgatggcctaagtcttgacagtaatagtaggtgaactgccatatttcaatggaagatcccaaagaaaatttgtgcactccactattgccacaggacttgcagtaccacggttattgctacaggaatagcagtaccaaacaatatcggagacaatagatgaaagcgataggcctagacttcacaacggcgagatcacacgtaacgtaacccagtagagattagaagagcagcattaccagcgtccgtttagataagaagaaagcaaacaagtgaggaaatttcgctacaatgaccaaaggaaaagaaaatggcactacagtttacaaatcatataactgcacggcacaactctgaatttacttgcaaaaggtcaaaatctgccatgtgaccttggccattgttacagatgtttttttttgtgcttttttttggaaggaattaaggaattgcattaagctaaaaatggtgtcaactgcagtggttggaaatttgtattttcagcaatctgtttgagttactccattatccgtttctgaagattttctgttgttcagagctcgattcttttaccaaatatgccgaaaaaaaatatcatactgctgttgatcatctcctatggctatacacaccccaccacggcaccacccgccgttcgccttggcggcggcggcggcggcgacgacgacgcagagggagcatcgtggtggcgcagccgcgtgctgggcgcgccggctgggtgattgataaaatggcgaaaaggaaggtttccgatgggagcagatcttaatcccttgagggacgttactttgttatttacatgtctcttaaatatctctgtaaaattttaagaaaatatattaacatgtgatttatcactcacaaatatgtaagttcaaattcatcatctacatctcgcaaaaaaaaacaaatttgagtgtgaatatacgctaactagctgtagtttaatttattttttgttgcaaaatgtagaaattaaatataaacttacatctttgtggagtgatatatcacatattaatacatctttttaatttttttcataaccatttgagtcacgtgcaaatagaggagacatccctcgggagatcaaaatagtttcccgtttctgattgggctgggctattgtctgggccacactgatcacctgagaagttttactgggccgcaggccgcgacgccgcgtgctcccaccgtccctccctccggcgccgccctcatcttccccgccgccgcggcttcctccactcccccctcccgccgccgtcgcgcatcctcctcccctcccccatctccaaagcgccgcatctcctcccaatctccaccgcattagtcgcgggctcgtggcggctgaggcgtcgatgtggcggatgaaggagcggaaagccccgtgagtcggggtctcgccggcggaataccccgtgagttgcctgcgtgggatgattaatccgataatttagatgggcatcccctgctactgctctctcgattaagcaacttagtttttctcttcctcaaaattttcaattatcttagattgattgattggtacaaacgtcagactgcataatcgtgtccatttttatccaggatactgtgatttccaaccagtttagaacttccctgaagtacctaattttactcttaagcaatagaaaaaaatgttatgcatcagtgtcaacaaaaaatggtttgtatagcagtttcaatagatgaactttcaatttttcatccaacatttgtaagtctgttgtacgtagtaccttggtaattgacgttatacagatatactgaacgtgtagagccagttgcgttatacagaattttcttcctctgaactctattaagtagtcatatctttagataggattcttctaaacatagaagggtgtagttcataatgtgatctagattctattaagaaataattaatcatgttgaattcaagttgtggcatgttaattgcttctgcatgttgtcactaggtacagtatatcgcaaggtttactgcttcttataataggatgatgaaatgaaggattcagtggtttggcaaaagtattgcacgctacagcaaatagcatagtattgaaaggtgatcaaatgcttctactcaaaattactgctgtagtgttgtattttactactaccagttgcttttgaccaaatttaagtaatgaagaatccaggattggttgacgatttactcaaagtttagagcaagttcaatagtatagcccactgctagctccaatttatctatagccaatctaatagtcaattcatacaatagttgcttactatattattaatatatggtcccacatgtcatacatacattgcgtcttggagtccgtgctgcagctggctacagatctgtagcccgctgctcttctctcttatcgtttatctcattaaaatatgtttatagctggctagtagtctgctattgtacctgctcttatgatagtatgcccatctctgaattttatctgctgattaaaataaccttccattagacagaagagaggacaactgtgttttttagctaatctgacgctatgttggctggcatagctgcttatgctgctgagttaattttctgcataactgtcagattgtattagagatatcaatatgcagaaagttaagcatggattgttgttagctgcacacagtggatttttttatatctaattcagattcagtatgggaatcatatgatgccaatttaacagtcattgtaccaaattgttctctatgttaccggtcaagactgcagtttgtagttgaagaagaattctaacaagttggaaccttgaataattgatgcctagctctaatcgatgagctcatgagattgttttactgttgacttgcagttctgggcactttgtatttagtttgtttgaactgctgccgattttatttaaatcaagatatattttaacgtcacctttctcgtttgctgctcattttgcttacaaatctcgctagtcattttgtttcggattcatgacttcattctcctcatgtaagttttgtgctgtacattttctacaggttcatggtcatgtttttattgtgcaatttattccattatgctgaattaaacatagaaacgccagtaaacagaaaagaatgataatggtaagaactttatgtcaatcaagattcagtaatctggggtgtagcaacaagcaccccaaatttctctatttatactctgacacagccatacaggtagaagtgttgctctgctacccagtaaccaaacaacatcctacaaggttaagaaatccaggtacattctacaaagctctcaagcaggcctttagggagtagttgattagatgcgctgtgtggcttcttgttcagtgacaggagctttgatcggattagatgtggaagactttgcagttatgcagctcaatccatctccggcggcatctaaggtgagagtgcgctttctagttcaagaactgcatggttgttcctattggtacatgtacactaagtatttcttcttatatgcatgtcaattcccttctgatcgtcaggcaagaacctaagataatatgccatggttatgctaatggtgcttcagagctgaattccaacgcaaggagcttgttgaaaggtgaaatctgctacactgggaagaagaaagagagcatctctgtttccagttcaaacatcgctgtctcttcacagggcattggatttagtttggagcaaagaactggagagaagtgcttagccaattcccatttggatgtaaagctgtgcactggaattgtaaagctggttatagataagtgctcttatatttttaagagtaaagggggcatctttgatgggaactgcagattgcaagatgttcttaagcttggtttctggctctcaccagagacactccgcccattttggcgtgcttcagagctgaagcctgatgatttccttaacatcttgattggctttgggccagatgctgcagaagtgaagaaggcaatatttttgtggaatttgtactggtgggcttcgtggcagagcaaggcattccaacatcttccaaggtcgaatgaaattatggtgtcaatacttgcaaatgctcatatgcttagccaagcggaatcattgcttctcttgttggatggcaacagggttctggctgatgcaggtaaactgtttagtcaggttatccaagcgtatgcagaagctggcaaccttggtaagtcaatttcaatttatgactgtgcacaggataggtgtctgattccttcaggctcatgctaccaggtacttcttcatctactgatggaaaggagaaaaaatgacttagttttaagagtatatttggacatgcttggagctggattaggttcttacacggaaggagatattcttgatattgttgtcaaggctttaatcaagaaagacaaatttttgcaagctattggtataattcggcagttaaaggatttgaacattcaaatgagtaagggatccttatcagctgtcacacaagaattttgcaagaagaaggatattggagatatgatgaatttcttagaagagtggaggtatctacctgacttgcttctcagcaatagaattattgcctctttatgtgcaaatattggtactgatgaggcatggttggttttccaaagattggaagtcttagggtttgtgccagatgcaactacttttggaatcttcatacgttacagctgtagagaattgaagctgaaggctgcatttctatatttatctgagtgcttttctagacatattaaccctaaagtttgtgcttataatgctattataggtggtatttttaaggagggattatacaggcatgcaaagtatgtctttgaagacatggctgaaagaaaaattattccagaactgttaacatacaagatacttttggcaggatattgcagatataggcagtttgatgaaatagaacaaaccttgaggactatggaaaccaatggcataaatgatatcccgtctggaaattgtgtgctttctaaggccttatcattcttggggctagaccacctaggggtgaaagtcaagagagataatgctgcaggctatccaaaggctgagtttttcgattcagtaggtaatggtctatatttggacactgattccacaaagtttgaggcttcattggtacagattatcgattatgctctttacccagatattagcttgaatctagtcagggcatgtcggcaaggtgatatcgcaagtgctcttgtactcaaagatgaaacttttcaatggggacatgacatttctacagctagctactcagaactattaaaggccttaagcgcgagccctgctcgtgcaatggatgccattaaccttattgacgagatggcagatacacctgacaaatttgatgctcaaaatctaaatctggctgtccaaacattgagtaggaatgggaggtcagcttgtgcaaggttggctttcgacagattgcttaaagatggcttccctgctagtcaagatacctatacttatttgatgatagggttctgcatagaaagggacatagcaggattttgggaatgttggagtctggcaacaaagcatggatggtcacctggtagcagggatgtgatcccccttatcagtcacttgagcaaatggggggtaatcgaggaagccttggagtttatcagcgtgttgctggactgttaccctagtttgtttttcagtgcatactgccaacttctcgaacagttatgcatgactggttgcacaagtgttgcatgtgccatgcttgaggctctcatacaaaagggtgtggctgcggatccttccctaattcgtaatgtgatggaagggtttctaaaggagcataacatcgctgaaacaattggaatgtatgacatg

SEQ ID NO: 66557 - DNA, 8414 bp, Oryza sativa
cttctccatcatggctcgtttgaagttggctcgcacaagtatcccacccgcaagcagggcgtgaccttaatcaaggacagtgcacaaaaacttaaggtcaataggccgcaccaccctattccatgtgttagtattcacatccacttcctttgatagattgtgacggattcgactagctagtcaccacttatcgagcaaatccctgcgacggtgcatgcatactgtcaccagacacgtgcgtcccatgacatctccgcctcctctcgtattgactgcaaaattttacatatcatagatagaaacaacacttcaagattcccataggctccaccaatcgattgcaaggaaaacaaagtcctggtggaaagggatgggtcggaagaagagctaaggtgaaggagaaggtggctgaagtggttggctttatgggagggtgctgagagttatacatggatgcactttatttccggggggaatgacccgttagtgaaatggttcaatattttctttcttcaataaattctcctaaatctgggaggtgatagatatcgtttggttggtttggattaatattatttacttgttttataatgacaattttaagttgaacaatcaatgcctaaaggtgaaccacatgcaagtatgtttatgtgaatgccattattcttcagtgaaataaaagtgtgggttattttttagtagaatggtagtaattactgacttattaatatgtaatttgtttggttagtacccaaacctagccaagccaaaattttagaaatgcaaaaaaaatatagtcatgtgtgatttgtagcaaagaatttggccatgcaaagcaagtgaatatctagccaactttttggtagcaaagcaagtaaatgtctagccaacttttgtaaaaaatggcaagtgaatatctagccaatttttggttaaaaaaattcaatggtcaattattgccatttccaacaaattggaaaggcggaatggttatgaaacaaacatgccctaattgtgcctagaaatagaggataaaacgaacaagctcttaaacggctttcccgggccacgcgtggaaaacccaaaggttaatgggccgcaccaaacctatgtcacactttcacgctgtgatagatcgcgattagcgacctgccgctaggggtggaaaaaaagctcaggctcgtgagctcagctcgggcttggctcgagcttggttggcttggctcggctcgtaagccaaacgagccaagcccaagcctccttttcagctcattgctgaaatgagccaagccgagctagctcgcgagccgcttgttttggctcgcgagcctaagccattatgtgtttatatcgattattttattttatatggcgttattatttgtcaacttcaaatttaccattaagattttgaaggcttgaatatataaagttaatttaattttacatgttaataatttgttcttgttttttttaataattacaaaatatatatgaagaggtatttcaacaggaaggcttgcaagccagctcgagctggctcgagccaagaaacgagccgagccgagctcaagttttagcttgttttcctaaccaagccgagccaagccaagccaagtttgttgcgagccactacaagccgagccgagctaggcttggctcggctcgtttccaccactacctgccactgagccaatccttgcgacgacacgcatcccgtgacatctcctccgccgccgacccacgagtcactcaccaacgagacttttgtggttggcgatttgccgtcgtctcaaactccaaatctccaatgcggtgggacaacttagcaaacataacataggataggctgtgtttagtgggtacacctaatgggtgggtgatcgctccctcctctccccccttcctcctcccctttttctcttcctactacaccataaatatttaaatttaaattcagaattgaaacgggtatgtgaacttttgacttataaactttgggtcaataaactaatatttgaattcaaattcaaatttgaatcgggtaggtaaacttttgacttataaactttgggtctacaaactttaggtgtataaactttagatgtatagaaatactatatataaaaaatatttgaattcaaatttaaatttgaatcggatataattcaaattcaaatttgaatcgggtatgtaaacttttgacttataaactctgggtctataaactttaggtgtataaactttagatgtatctaaatactatatataaaaaatatttgaattcaaattcaaatttgaatcgtatatatttcaaattcaaatttgaattgggtatataaacttttgatttataaactttgggtctataaattttagatgtataaattttaaacgtatagaaatactatatatatcaaaaatatttgaattcaaatttaaatttaaatcggatatataaacttttgatttataaactttgggtctctaaactttagatgtgtaaacttgaggtgtacaaactttaagtgcataaatttactaaaataggaaagtaatgcggtgccaaaaaaggaaactaggtggagggagggaattgaatcggatcgcccctagcactcaatcgctaggtagcattcccggtgtttagttcgtgtgctaatttttttttgaagtatacagacacacatttgaagtattaaacgtagactaataacaaaacaaattacaggttccgcatgtaaactgcaagacgaatttattaagcctaattaatccgtcattagcaaatatttaccgtaccatcacattgtcaaatcatggcgtaattaggctcaaaaggttcgtctcgcgatttacatgcaaactgtgcaattgatttttttttccttccacatttactgctctatgcatgtgtccaaacatttgatgtgacggaaaagttgaaagtttgaagaaaaaattttgaatctaaacacggccatacatgtaaaaactgggatgtattatctctttgtattgactgcaaaattttagaatatatcatagaaacagtgtatgattctgtcatcaaaagaaaggaaattttacaggatcggtgattgtcccatcgaggaaaagacgaggaactaaccagtcagttagacagttgtttgctgtcaaaacacaaaactgaagggggaaaaatttacagtacaacagaggttaccaaaacaacttgtggtattattagttgtagactctttatcatggttaagaccgtcctgatctgggattctcgtcttctggggaagggcatctatacacatgctgttgtactaactccgatcgattctgtgaccttgacgggaatcatcaggttttcagttgagcaaccttttctgagacctcatcagctgtttcgtccatgctctctgtaagggaatcctcctgctgagaaatagactatcttatgtcaaaattttattttaaatcttacgtaaataaaaaattagatagactagaacatatattgtttccttcctcgacaaacaggaaccgtcctgacatgtgtggtgcaggaatgagatactacacttacatctctgtcttgctttgggttttcaccaatacacttggaagcgcttatgctttcactcttcaacaagctccgagcactcatgagcggtttgctaatgccgtctgtcactgatgcatggcatggcttctcgcctacattcagctttgcgtggtactcgtcatctccatgcttgttaccaattgctctttccctggaaaaagacgcagaaaaatgttaattccaagggcacagaagagtgattttcaacttataggtcttctgattactcctgagatgcgcatcactcttttgtactcttggaattaacattttctagttcttgtttgccttcttcccatcatttttccttttcaaggcatgtaaatgtaacatattaactatcctggcttaataaaaagatacacaaatcctatatgtattcctgaaaaaagaactcctgagatgcacagaaaacattgaactcaataccatgccatctagtcatatgctacatgcctaaacaatcaatgcccctgccttgttggaataaaaaacttccttaagaagatgttggtaaaagacaaacaattcagctcagaagtctccagtcggaaaggctgattcgcgatcaatcgccagggccaactggtagcgatcagttcccccctccctccacctggtttccttttttggcaccgcattactttcctattttagtaaatttatgcacataaagtttatacacctcaagtttatacatctaaagtttagagaccaaaagtttataagtcaaaagtttatatatccgattcaaatttgaatttgaattcaaatattttttatatatagtatttctatacatctaaagtttatagacctaaagtttatagatctaaagtttatagacctaaagtttataagtcaaaagtttatatacccgtttcaaatttgaattgaattatatctgatttaaatttggatttgaattcaaatattttctatatatagtatttctatacatctaaagtttatacacctactttagatccaaagtttataagtcaaaagtttacatacctgattcaaatttgaatttgaattcaaatttttttatatataatatttctttacataaatttttctaacttttgttttttaaaaacaattttgtggtgtactgtagtagggaagagaaaaaagggaggaggaagggggagaagagggacgtataggggaggggggtgcgggtgattggtcccagcgatcacccgcgcattagcagtccccgtctccagttgctatctggctcactacatatacaaagacatatttcaggggtgattgtatattaccttggtaagaaagcattctgccgaagctgtggactggatttttcaccctttaaaactccttcctccaaatgagcgaattgacgcttgaagcgatccaccccactgtcaagatccaacatatataaacagacatcagaattaccacttgaatatgtccttgacctaacgtgtagcaattttttttgtgtgattatttagcataagtcactaatttaatacagcatattgatttatgtttgtgggatgcaacaatacagaacagtgaattagttaccataaaatatgccaacaggtgatcaacttcgtaaaagaaatactggagttacctaggatacatgaaactcatctggtctcccccgcgcaaatattcttgcagcatatggggatgatactctaaaatctaaagagatttaacaagtatattagtacagtaaagagtcaagtggcagctctgtcgtaatattcacaaaagaattcatcagtggcacctctcggtaaattaattcccggacatcatctttggccaatttcctcttctcgaactcaaactcaagctttgagataggctgtgctattggttcgcgttcagagtttgctagcccattaaagtaggggtctgtcagggccttgaataataattccatatctcagtattcaggatagcaatgtatccaacatttcaaagctggaatgtctttacaatcaacataagttggctgtgaacactcctacctcttctgcacttggacgatctttgggatcaaaagcaagaaggcgttcaagcaaatggagagccataggatccacacctggaaattttttagtaaaaggaacccgaggctttttcctcatgttgctcaggtatcgtcgagctttctcattccgtatctgcaacccattcaataaatgaatgtaaagcacatcaatatgcattatttctacaatttacacctcgtttttttacaacaaatacatggaagaaaatagagtctgtccttgtgcactatgaatgcaatatgaagtcgctcaggaaaatataccactcaaaacagtacattaataactatatgaactatatgattcactgttagtgattttggaggaaatttgtacagaaatatgaaacagaggctgatgccaagcttaaatattaaatatagttgcgaagaattctgcataaagaagtgaacacacagactagtgaggagtcaatacattgcacttgagtgaaggcacaagcttgcaaggattgaatataccttagcaagggattctgctgaaggagtgccaagtagatcagtcatgagatccaattgatgcacaacatttttccctggaaagagtggctttcctgtaagcagctctgcaaatatacatcctacactccaaatatcaattgcaggggtgtactgcaaaagccaatgacaaaatataaatcaagatatcacctaatgcgacaatgtctaagagaacattctcaaaacactgttgctacattgatccaaacatatcatagtaatataacaatgttggaagaaaaaataatatagccatcaccatgttaaatggaaattcccttacctttgaaaaaaaggagccacacaactctggggcacgataccatctagttgccacataatcctagaacgaagcatggaaaattcattagatgccaagatatggctgttcattgttaagaaatatcttctcaacattaataaatgcctaaccgtccagaatatggctgatggggtatcgttaaatgacactcgggcaaggccgaaatcgcaaaccttcagcttgcaatcagcattggctagaatattcttgggcttaagatcccgatggaaaacacttgctgcaaagagaaaccagaaagtgagcgtgtcaaccacataagcaaaagaaattaccgatttcctactatatggaatctactacctgcatgaatgtacttcattccccggagcagctgatacaagaaaaactggtgatgctctggtgtgagatcatcatttgcttttattacctgatggagatctgactccattagctcaaagattacataaatgtccctgaattccctccttgaaggaggaagcattatgtgcttgatctcaactatgtctgggtgacgcagcaaccggagcaacttaatctccctaaggatgcgggtggcatcagagacatgatcgaaaacatcattgatcttcttgatcgccactcgctcgccggtctgggtgtcgacagcggcagccacaacaccataactccctttgccaatgacttcactgactttataccggtttgcttcaccatattcagtgaagaagtcaggttcctggaatggaagaaggtaaagttcactatagtaacagtactgaatgctaggtggtatgaacgggttgatgacatatttcttgggaacgaaaccttgtgccttgaaaacacccgggtacaaacaatgtgatgtgcaacagataagaaaaggaacttcaagggcattaggactactgtaaaatgtactaaagacatgcagatttagattgcattagatatgtaaattagatagtgaccgagcatcaataaattttgcaatctgattcttccaagtacagtgacaaaccttatctgtacgcccttccccccccccccccccccctttttttttctgaaagaacgaaaataaatctgtacattgtgaaaagtcaaaataaaagcagctgttactgaattttggtttttcccaaacgagacagaagcaagaaaagcagtaggccccattttccaatatgaactactgcccgcagaattatgcctttagtttccgtaaagctctacctttatctggaataaagggttcctgaattggcatacttggttatcttggattcatacttagttatcctgaattgacatactcggttatcttggattcctgaattgacagcactcatgtaagtactatatcagcatcacatcagcaatgattccgcgcgttggcttatgtaagcatgtgaatgaacatgccatggattgcaaacgtatcgttcaaatgagagatggaaccagatccacactaaccggcaacaacgcaatctcatgaaacagagatcgcaactccatgtagagcatttaccattcattcatgcagtaaacagttactactagtaaataacagttcagaggaatccaagaaaccacaagaatccaagaaaagcattcaggggagaagagaagagaaggccatccccaccttcttgctcggatccatgcgtcgcggctccgtgcgcaccggcaggtgcgtgcccgcgtcctccgacaccaacgcaatgtactcctcggggtcggactcggggccctcgtggacctcctcccacccgtcgcccttcgcgttctctcgccgcgggtcgtggagatccttgacggtgtcgtcaccggtggtggtcagatggaaggaagaggaggagacgcggcgggagcggtggtgaccgagccagcgt

SEQ ID NO: 66558 - DNA, 22247 bp, Oryza sativa
cccccattggcagggcgatcgatcgcccattaggactgcccttcttctcttcctactacagtgcaccacacaatttttttttaaaaaataaaaggttagaaaaatttatgtatagaaatactatataaaaaaatttgaattcaaattcaaatttgaatcagttattttaacttttggcttataaaattcaaattcaaatttgaatcaggtatgtaaacttttgccttataaactttagatctataaactttaggtgtataaactttagatgcataaaaatattatatatagaaaatatttgaattcaaattcaaatttgaatcaaatataattcaaattcaaatttgaaacgggtatgtaaacttttgacttataaactttgggtctatatactttaggtgtataaactttagatgtatagaaatactatatataaaaaaatttttgaatcggatatataaacttttgactaataaactttgggtctctaaactttagatgtgtaaacttgaggtgtatggcaatgtttggctaatgggaaatagaaatgatttcccacccacaaaaatacatctttaaatcctaaccattcattctccatctttcatttaatcctaacccttcattcatttcccaattccaatcccaccctccatttcccattatccaaacacaccttataaactttaggtgcataaatttgctaagatagaaaagtaatgcggtgccaaaaaaggaaaccagttggagggagagagagggggaggggggaggagatctgatcgctacccgatgggtcgggcgatcgatcacccattagagcaggtacaataacgtgattaagctggctcaaattttctctcaccttcccaatcctagattaagctagcaaaattgaagagagagaaacgagcaggcgcttaacttggcgccgggcgctagcgcttcatccgacgccgtatcgctcgcatgcagcccacgaaggcttttaacgctcgcatgcaactcactacagctggtatattcctacacgtatttaatgcttctgtgctttaaccaaggcagcttatagccaacttatagctagcttgttgtatgagttggctcttaagttagctctacctcagttgacaaaattttggagatatctgctagctacactattgactttcgctgattgatagataaaaatcagatcaagggagtcttactagactttttccttgagaaaccagcaaaactaattcctcagtccaccacgctgcatccttttaagactcccgtggtagccagctatgggtcataaaacgctcaacaatgtccagctatgggtctgtaagcgggctctaaattaatgtggaatatgtaggtatgcacgaatccacttgggtgttaaataagggtcctcgaaaacggaacagtccattagcacgtgattaattaagtattagctgttttttaaataaattaatcaatatgatttaatatgattttttttaaataactttcgtacagaaactttaaaaaaacgcagcatttagtagtttgaaaggcgtgcgcgtggaaaacgagggagatgagttgggaaaattgtgataagaacacaacctaagtgggtaacccgtagtcctcatgtcgtgatttggcttgccacatttagggatacaagtgggtcaacccgtaaacttatttataggagcatctatccatttgtcgggtgattactaataacccgtaggataccaactaattttacttatatgtgggttcgcgggttggtccacttacatcccttggaatacggcccatctatcggcttgcgtgaagattatactatctccgtcccaaaaataagtgcaaccgtagaaatccgtgtccaacgtttgatcgtccgtcttatttgaaaaatttatgaattttttttaaaaaatagtcacacataaagtactattcatgttttatcatctaataacaataaaaatagtaatcataatttttttaaataagacaaacggtcaaatgttggagatgaatagtgcaaaacttcacttattttgggacggagggagtagtacacatgtcctccactctaaaataagttcattatttatccagcatctcacaagaaatagatcataatactcttagtttcttaaataatgtaattagtttcctctttatttatttttaatatatttatttttcatttttataaatctcaatacaataattacttagataaatttattttgggataaccggttaaacggttagagctaaaagtgaacttattagtgtacgtgattctcctgtgaacacgagcaccagtataaatgtgtttagttcacgttaaaattaaaagtttgattaaaattggaacgatgtgacggaaaagttagaagtttgtgtgtgtaggaagttttgatgtgatgaaaaagttgaaagtttgaagaaaaagttaataactaattaaaccagtccttcgaattaggtacgacagaatcagtggcgaattggcggcgttttacgctgcccgattggcctgggggttcgagtacaaatatgtacctgacaagtttacaataacgaaccacaagtccaaccgcgatcgcacgtacaatgcaaaacgcatgtaacccttgcacgcgtattaattagtgcattttgcttctttaaacaggaggcaccgccacgccacaaaaaggtgatataacctgacgaaaattccatcacggacgccgtgcgatggccgtggttccgtccaaacaccggagccccaaaacgtcaaaacctgcgtctgattgccatgacccggaagccttttaattttctgtactctcgtcggccaacgcagccagttagacccacgtcagcgccattcaagtccattcctccgtcaccatgtttgcacctgctagctgagattaacaaacgtgaaacgtgtacagtgtactcgagtctatggcaaatcgtgcacaattttttaaggtgagtgatgcatgcgtcgtcagttttaatttgagcatttgaaacacaagctgctgacctgatccctaaacctgaatactcaactctcaacttttcagtgaacagattattcggcgatgatgactcctggtatttgtctgaccacgtgcataatgcattagtaattcggaacgtcactaatactttgaccaccaattctagatgtcatccagttctgataatgcacgcgcgaaccatccaggtaatatcaaatgtgataacacaagacttttccaagtagtttcagctgaccattagtcacaaacaaagtgaaattaaacaagcaagagaatctttccatcgttcaaactaccactaattcaagctactgcgttctagtcttctagacgttcaacgtacaccacatccctttcccgttaacttgggccatgcagcgatgcagtagacggcgccgtgggcgagacaacgaccaccacgccacagcgcgaactcgcttacgtgcccttctccacgacgcgacgcgacacgagcgaacgaatccccacctcgtcgcgctcgtctcgttactgcgcgctcctactccccaccaaccacgcccccactcctctccgctgcataaaaaccaagcccgcctcgccgtttcaccaaccaaacccaaaaacccaaaccaaacgcgcgacgcctcagctttctcctgctcctcctgccactcaccaacccaacgcaaagcatcgcggccgcgaggtcgtcgacctcgtcgtcgtcgtcgatggaggtggaggcgttcccgatacggttcacgaggggaatacggtcgcactgggggaggcgcaagtaccagcggctggaggcggcgaacggcggcgggaagacgagggcgacgcagcagctgggcggcgcgcgccgcggcggtgcggggtgggggctgcggctgcggcggctgctccgcgtccgcgtgcgcgtggcgagggcgtggctgtcgtccccggcgcggctgctggcgcggatccgcgacgcgtacgtgggcggcatgctcgccgtgtcgaggaaggcgtcgggcatgtcgctgccgaacgcgcccgaggggctgtggcccaggcgcgtgccgcgccggaagcagctcccggcggcgcggccaggccagctcaccgacttcgagcagaggctcgtcgtcgagatatacaagtccatcgtcgcctccaaggagctcaccaccatgctccaccactccaccgcgcacctgccgcagcagcacaacacggcggcgccggcgtccagtggccagctgctagtcaattagcgtgctgtctgtatccaccatcgacatggaaactgaaccgcgagagctcctgcaagttcgtttgctcgatcgctgctcatgttgatgattattactactgctgtttcttccttgtaatttgtaagaagtattagttaggacaagatgatgatgtacacttcaatttctacctggtgcaaatcaccatgccgccgcgagtatgtttaatttcgtaaccaagaaatcgatcaagcaaagttcgtgcctccgcgcaccttgttcttgttcttcttgcatcttgtgtgcttgttacttaaacccaatcctcggccatctcagagggttgatcaccatagtggaaaaaaaagagagataatgtcactgtcattgtaaaccctaccagtatcactggtttcgtcgctgcagcctctgcggtcaaacttcaacacatcaaaaaatcatgtgttttgaaaaaaatgagacgtggaaattacagacgaaaattctctgtgaccaaaacatgctattggaaaattttggagcaaatgcttacctgttggctcatgatcttttttttttaatctaaagtttcttcaccgtcaacgcatgcacgtgggattcctcatgttctaatgttacaagtaaaatatggccgctcgcttgttcatctagaagctttaatcaagacttgactcaactgaggctagacaattattctatcatgcgtcacgcagttcgtcaggcctttgtttatttgatcggtgcagttcgttaggctggtttgcctccatccgtttttcaatagattagctgaagatgctaatcgaaacgtcaggtctacctagagcaacatagattgattcttttgtcctgtcaggcgaggcaatctgctttcaccatacggtcagcctctaatttgtcgttcctccaactattgctcacggaattactgctaaaatcttacttcctccctcccaaaatataagcatatgtggactctgacacggtctccgagatattactttgaccaataatacatataaaagtaagatgttttaaataaagagagttacatattatgataatctgtttaatgataagtctaataacatcaattttatacgattgatcttttttttttttgctattaatagtcaaagttgaaaatgtttgacttgtcactatgctaaaaatacttatattttgggacggagggagtagtgtaaaatcacagcgttttaaacgggtggcacataaattttgcagcattttggttgcaatgccctgaataataccctaaggttataagtttaaattttcacagatgcgaatttcagattgagttatttgcggggctaaattctcaatttaaatggctgcatatatccgctttgatgtaaaggctaggtaacaaatacttttctataaaaaaaacgaatttggcagcattttgacacaaatccttagctttggaggtctggtctagtcatagaagaacatggctacatttgctacggcccatttgtcttctgtcatgggccctgataattgagaaacaaagccgagtctgaattccaacccgtccaatttacccacaaggcgaatttttttcatttttcattttaattttttaatatttacataaatattataccatctaaaatatttacacaaatagcccctgccgcccaagtggagagaggcaaggtgtgcgtattttgcatttaggtcccttgccgcactctacaaggctgaagggggtaaatgcaatttttgctctgccaaaaatgcatttttctattttttttcaacttgtccgtccctcaagtcaccctgccgccctcccagggtctacttctgtaaatatttttaccggtacaatatttctgtaaatattaaaaaataaaaatttaaaaatgaaaaaaaaatccccacaaggctacgacgtcaagtagtcaacactggctgctatcgcctatcggggaccattaacgtggaagaaagaaggaagtgagctcatcggtcaatccccatcaaagctgggagctcaagctgccttgctgggacagtgtcacagtgaacacgatgggcggcgaggcggcgcagctcacaccggccaggatcgacttctccggcgtggacccggcggcgccggggaccgggcggtgggcggaggtgcgcgccgaggtgatgggcgcgctcaccacccacggctggttcgacgcgcactacccgcagctcacgccggagctccgcgccggcctgttcgacgccgccgtccggccgctcttcgcgctccccgtcgacgccaagcgccgcaactaccacggccccgagaagcccttccacggctacctcggcggcctcccgggcctcgactcctacgagagcctcgccatcgttgacggcctcaagcccgagagcgtccgcgccttcgccgacctcgtgttgccccgcggcgccaacgacgacgacggcttctggtaataatcaaaccaatatatccccatcccattctcctcaaatcttgatttaatttggtcgatttgctctgcgacgacacacacacagcgagatcgtcaatggcgcggcgaagcgcatcgcggatctggaggggatggtgcggcggatgatcctggaagggctcggcgtggcggagcaccacgaggcgcagggcgagtccttctggcacctgttccggatgtccgagtacagggcgcccaattccgacgagaaggtgaccgggtacatcgcccatcagggggggaattgcatatgtaccattgcaaaagaatgacttcactagaatgctatccttaaaacagtttcagtaaaataccacgttcaacgaagacggcttcgccgaaatgccatcctggatgatattacccttggctccacttcttcctcctccatgagccggaggagctcaccggcgacgactatgtgccatggccaacactagctgtagcattggagaggagatgcagccacgacggtaaaccacgatggtcagcagccaattcattgaggacaagcagagccaattcgtccttctcaaccagcaagcaaacaagcagaacaagcagcctcaaacagccacaggtcaaccacgacgccatcgacggctccgccgcctcgtcgtccatcacggcaatttttcgctgtcttccacagtggctccaagtctgggtccccgcatcaccagctactaccgctcgccgccgtctcattgtcctccatcgtcaattgcagcgctgcccttccgtcgtggtcatcagctgccgctcatcctcacccgccagcaccagatctggtagcatgcctcgacggtgatggcagcggtggtcgttgtcatcgcgcccgcggctggcgagagcacgtggtgggcgtgcatgcacaacgcgactgcgcacggcctcgtctcctccgcttcccgagtccgaccttgccccgagccggagtcgcctcctcctcgcgcgcagcgcacggccggtgccaagcaggttttggaccgagggcggacggacgcgggcacggaacttgctccctccactagcatatgtacctgctgctgcaataggcgggtgccatggccgccggtgagctacaggaagatggaagaggtgccgaagggtggaagaagatgcccaagggcaaattagtccagtagggcattcgggcgaagccatcttcgttgaacgtggtattttaccgaagcctgttttaaggatggtattctagcgaatccattcttttgcaatggtacatatgcaattttctccccatcaggacaccaactggctcagcatcgtgtgccagaacgaggtgaatgggaacgagatgcagaccagggacggcgagtgggtcctcgtcgagccgtcgccgacgtcgctcatcgtcaacgtcggcaatgccctccgggtaagcatcagtgtaaattctaccatgtgacactgataatgctgtacaaaaaaaaagtttgtttccccatcattttggatcgaggatttggtggattggcggtcacagatagtagctaagtgagacgatgttgtggatatcgaatgtgtaagcaacattcttagtccgtagttaatgttgcttacacattgttagcccggcgaagaatgtgtaagcaatattaattatggactaattgaattcctgaaattcagcaaaatgactagagcaaacattctgaaaaaaaaacattgtaaaacaccgtagtagatgtcaattggcccgttcctaacaaattacagaatgtgactcttctgctgctagctgcaacctttttgagtttcaggcatttcatgtttgatagacaagaaatgtagggatagtttgtacgagtattcatatacacacttcaacactcacctgataattgatgcttgtccttaattgttcaagagaagcaaatcgcacacttaattttcgaattttcgcaatcttcaggcatggacaaacgaccgtctgcacgcgccatttcatcggataatggtgagcgggcatgccacgaggtacacctgcatgctcttctcctcccccaatttcatgatccaggtacctaacgagctcgtcgacgagtgccaccctccccgtttcaagacgcatgacaacgacgatttcattcgcttctgcgtttctgaagaaggagctcgccacgaggataaactcaaggccttctgtggcttatagcctataggcaacatcagaatctgcagctggttgatccccaataaggtgcactatcaaacaaagtaaccctggacatcttgcacaggccaaataggatatcggttttgtgctgcgttttgtacttcgggaagagttcattaccgtggcgtgctgtatgtgaactttgttcggctatacttgtacttcatcgtcaggtcaaacaaacaccttgcttccccaaccatcttgcagcatagcagcagccttgtgatgaacatgaccacagcattgtctatttcgtccaacacctggctggcatgtccaatgaggcccatcatatatagaagtatagatcgatcaactagctctggctgctgacaaaaacaaccccaagtcgcagtacctgaaataaaggggagttgggattttgtccccttttattactcattttgatatatttttatctttacatttttttcaataaacttgtacttgtgtgtcttatgacataaagccagatatataatctattttcattatctaaaaagtcgtagtacctgacagcagggttaactggtttgtaaagccgatcggtattaactggttttcgtacaacgttgattgaaagttgtcagtttttaccgactttcagtttttacttaaaaaacgaaaaaggtaaaccctgcctggcagcgcgcctgcctgcccagaaccagaaggcggtcaccggcgcgaccatgaccgtgccggagcgagttatccggcttggcctgacgctcttctcctggagcaagcaacgcgcggtaagcctcgccgcccggcagaacaactgtccagggtccacccatcacaatactcatcgaaaattcacaaggcaccaaatctccgaagtttacgcattgccagtatcacaagctttgtccgcagaaagcaacgaaaaatactcccattgcaatgcatttatacacaggtacaggcataaagtagaaagtagaaacagaatggcatcaggcaccgaagcttcacatcatcttcagtagtgtagcactgaagagtgaagacatctgaacaaatgtcataagacgcaggatgcaaataacaacaaagtgcatacttaactatccatcatagacagcaagatcttaagtccttgtctgccttagttaaagacgacagacaaatcaccaggcagcacacacaccaggcaatgcagtcatacactgacaggcttcaattcaagttcatcaaatcaaaagtatataattcattacatgaatgagcatagacaaaatggcaccaatgcttcaattcaagttcaccaaaaagtataattcattacttcaactgctcataaaacattacaactgaagaatgaagatgcctgaacagtgaaccctcaccatacaagtgttccaacacatcaatcaaattgcaaataacagccttcaggcactttcatagcgtacaagtgttccatacataattcagatatccaaataacagccttacttacatgagtccaacaatttgtcacccggtttgcttaaaacgaaacaaggaaacaagatcataataacctatataacaatatgaaccataggacaaataacccccaatgtaataactcacatatctgaccacaacttaatagctataactctctagtattcacatttcgcctgtgtgctaattgtataattcagttctcatttgctttgtgcaactaaatagtataccttatttacggcctcttctttttttccccctcttttcatgtcattatcaaagagagaggagattaggagggagtgagagagtggcgatcggtgatggactgacacgtatgatcaatggccgaaggagaagcggtcggcgggggtgatggagtggcggaagtggcagcggtggccgtaggggcagacgccgccggcgagcaccatgcggcagacctgggtcttgtagcgagggtggcggatgacggggcggagctccgcgacgccgtgggcgaactggcactggtcgccgtaggggcaagccccggtctcctcccacttgttgcacagctccgtcttgaacatgccctggttgtacacctcgaactccagcccacccatgggcggctcctccttcttcacaccaactttgtgctcgcctccctccgcgccgtcaatgcccacgaacacgcgctgctgcttgcattgtcgcatcaagaacatcgtactagttaggattgggattttggattcagcacaggagtcagtgcgctgcaagagtgggagccagacacaacacaatggaggaattgggggatttggtctcaccgagccgacgttcaccggcttcgacacgcgatgcttgccgccctggttcagcttctggtatccggtcgaacggatggagatgctcttcggaagaacagcctgcttctcggggacggcgacgggattcatcagtgcggccggcggagactgcggcggaggaggaagagctggcacggtctgctccttggggaggcggaggcggcggaggtcaccggcgagggcgatggcggagctctgccttccgccgaacttggcgatgcggcatgcgaggtcgttgttggcgacgcggagctcggcgttctcctgacggagcgcggccgcctcgtccgcggcatcggcgaggtgggagaggcagagctcgaagcggttggccatctcctggtactggagcgcgaggtgggcgaggtggaggcggtgctcggtcgctgccgctgcccccgcaccatctccgtcgtcgacgacggagtcggaggaggacgagcagtgggagaacgaggcggcgcgccgcggcggcggcggcgagagcacgcgggtagggctgaagggggagtagcagccgtagaagagatctccaccgttggtcagcaggttgggcgaggagagccgttgatctccgctgccgaacggcttcgggccaaagtccgagtagaagcggcctggatgagccggaggtagaagagcttcctgcatagcggcgatctccgcgaacaactaatccctgcaagtaaacggatcaaaatgtcaatgaaaattccaacaaaaatcacactaaattctccacacgaagcgaaccaaaataaaaaaaaagtagagatgctttccacagaatctagctctgagaacaggaaaatcgtatcatggaagcaatcaaaaatcgcattcgaagacgcgatctcatccactgtaacagtgagaacaagtaatcaactagtttctaaatcgagaaccagactgattccacaccaaaaaacgggacaaaaacgctaagaaaaaacggaaccggacgcctgatcgcgaagaaaacgctgaatccacgaacaaaaactagtttctcaccaatgcagcacgagaaacagcaagcttaaaaaataaaaaagcaaaatcgatcaaactcgcatcccaagtggagcagaacagcacgcccaacccccaactatccactgattaactaactagtggcgcaagcgcaactaaatcaccaagcggttaaccccaagtgtagattggatcaagcagcacacctctcgattagcgctcaccacccggagcctttgattttgagaaggatgatttgggggagaaggggatagggagaggaggaggagggtgtcgtggggctcgcggctctgcctctgaatctctctggcaatctgaagaatgcaagtgctctgcacctgcgcatatataggccgccattccgtgcggtggattcggtggggccggtacgcagtacacacgctccgcgaaatggaagtacgtactgtgttgtacgagaaatggatcgcgcgcggcgaactgtttcttgccgcgcgtgggcgtggcggacgacggtgtttgggatttgggaattgggcgctgtgaccgcgggtgtttttgcacccctctcatcccgctacgcgtacgcgcacaccagcgaatacacctcttaacacacgctcaaatagagatgaaggccaacagtacttgttaatatcctattgaaaacacacccatcggcttgtgtattatatttatgagtaaattttactttcagtcacttttattatcggtatgtctatctgaatcactctttaaccaatatttttgttttagatcggataatcttatctttgttgtattttggaccaccctaactttcttatatatgaacaatctcagctatacttactcttacccgtcaatgaattcccaacctattttcttgacatatgagatgtagatcaatagatggataatataaaggatgtaagagtggtccaaagtgtcacaaagttacgattattggttaaaaggtgatctaatatgaaacaccagtaataaaagatgactcaaagtaagattcactctatattttggatatatcctagtgggtgaagttctgtacccaagatttcacctcagcatcgttggtgctttccattattcctaactattttcagtacgttaatgcaatatatcattattacaaggtccatggtcaattctcaacttgaaaaaaaataaacaagcagcatgcctaacatattcttaactcgatgcttcataacaaacaaatcgtcgagggtccactctgcaaacaaataatccaggtagctgagctactagcaaaatatatcccttgcacgttagacacacgacacacaacaacggtatgctaatatgctactcctatctagtgcggttcttgatgcaagggatcattacaaagcttcgcttgcttgctttgcttttacgggtccgtccctctctcggactccgattgatcaagcgagctaaccaacgccgtctcgggaaagatagttaaccaacacatgtacagaaaaaagaattaagccgtcaccttcccttttaacgttgcttccttgatacagctttaactaacttgccccacccatctcaagccatgccatgccatgcacacgtacgaacgaactacacacatcaccaaccccgacctccagctgctaaaaaaatactggggatttttttttttttggctcctgctgcctcgcgatatgatctcccgtggccgcgacgcccaaacgaattcgtgaggctttttaggtgcgtcgtctctgctttcgtttggcggcgacggcaaccgggatcaggtcggctagcttacacacatgtgctcggcgatccaaatcaatcagattagttatggacttgtttgttggtacgtgcgggtgaagacatgcacgcacgcgatggcgagcgcactgatgtgcaggttggacctgaaattaattcaaggggatatgcattagtatttcttttcaatgttattttgtttttcaagttccctggattggtagtgtactattgtccctctgctcaaattaagcatggttatttggacatcgatttcgtgccgaagatttcaaatcatgcacttgaaacgggtaattatgtgccggtacgatgtacggatatgtccatgagaaacttgttggagctgaaccatcattgtagcgagcttacaggctttgttatgggcctggcctgcttacgtgggctggtcgatgtcaatcgtgggccacgaccagagccacagcgatacggcataggaaaaagtacaccgaaggtccctcaacttgttatcgaattacaaaatcgtcccccaaccgtaaaaccagatatatgacatctcttaacttacaaaaccgttcgttttacatccttcggtggttttcacccggttttattcgacgtggcgggtgagtcagcatgggacccatgtgggtcccacatgtcaggacgccacgtcatcaggctctctcttccccctcctctcccttcctctctctctctcactcatctccctaggcaggctggtcggcagaaatctttacaaaaatagaccctgcggccctccatttaggcggcaagctgacgtggcacacggcgtcgtgacgtgccgtgtgcgcattttgagcttagacccttggggctaaatgtaatttttttccatgctaaaaaaacaattgactagttctttttgcatctgggctccttgccgcccttgcgaattttgcacggaggctccttgccgcccagacagagggcggcaagggggccacgtgtcgtagccccccaaaacgaccgtcctgcaccgtgtgccacgtcagcttttcgctgatataatatttttgtaaatattaaaaaataaatctaaaaatgaaaaaaatcagtgttcaacagctactctgaaacagagccaaatatttcctgtagtgccaaatatttcctgcatccttcgtacggcccacagctaaatatattttctccactacaaaatgttggtacctagaatgaaatttagacaacgaatctggataaacttttatccagattcgttgtcgaatctgtacataatttctatccaggttagttgttctagtatggattaaatctcattttatattacaacattttaagacgatggtaccttcagaatagacaaaatgccaggtaaaacctcaataatataaaactcgaaaatgtaaatgaagtctgctctgccttgtgaggctacgctgttcagggaagcaggaaccaagtcaagcatggactgtaacatatccatcgtggcatccaaaaagcatgaatgaacaggacaatctgcagagtgcagttatcaaagatacagggtatctcaactccccaacgttgagatgcattgcaactctgcaagttcagtaaaatttaaaagaagcttagcatgaagatttattatcacatattggcagaaaaggtgtcaactgtaaggccttagttgtatttctgcataatctgacctttaaggctgtcataaatagaacagtatctcagtgccttataattaatggagagctcataagataatcacacctcacaatccatgcacgtaaactcggttcatacaagtgaaactctcatccatcagaaatgtctaaaactattatcccatttacaagtggtcctatttattattattattattattattattattattattattattattattattattattattattattattattattattattattattattattattattattagtagtagtagtgattgttctttcgtgtaaacaccatatagtatgaagactaggttaatgtaccacatgagtaaataccaaccttagtactgttccgtgagtctttttaccgggtttaaccgttgagagagtcgttatacccaattttttttacgattgaggcgaacgatgatcgtacagagtcaaactagactttatttaaagcttttatcgatcgtagtaggccagggcaaaatcacttctctatcattgcccagctcttgatccgcaagtacgttcggcccaattcctagcaactttgattgtttaggcccatatttcttgcaggatactggatttcgctctcggtctatcccgtcttcgtcttcacgcgcggggactcggggaggctcaaaatttgccgttgcgaagtgtccctccttgtcgccggcgccggcataggcgaacaccatatttgtcttgagacccagactgtgcctgtgacgtcgttgcgttgaggacaagaaaacaacatgggccatgtcctgatcgatcgatccagaaataagttcactttaggttccttactttgatggtgtttgaatcttctgaagatgaagattaagcgttaaacgaggtagaaataacgtttgaataattaagttttaattattataaacttgaaaaatggattaatctgatattttagaacaactttcctatagaaagtttttacacgaaacgcaccatttagcagtttgaaaagcgtgccactttgatccaaaatttaatccactatttttagtggattcgaacagggcctttatcaacgagtatgaaatttatccctaaaccaaaataccaaatataacgagtcttccaattcacaaaaccgaatcactcgaggttctagacagtattatgggcatgttcactttgatgcaaaaaaaaaaaccttaccaaattttggcattgtcaaaattttggcaagatttcttatacagttaccaaaatttggtagcaaactaaatgtagtcacttttttgataattttaccaaaatttggtaaggttgaaaatggcatcaaagtgaacaggccctatgtctggttttaattgacatggcaagctgagtctgcgtgggatccacacgggccccacatgttaattgaaacactttcttccacctctcacttctctcccctcccttcctcatcctcaccgcggatcttctcaccggcttcttcccagccacacccctcccctcctaggtggtcgtgcggccgtgtgccgctgttgccctcaaaaccattgtcccacctacgtcggtgataaaatagtagagagaaacggagagagggaggagaggatgggtcactaatgtgtagggttcgccaaatgctattttttttatttagactgaattgccctgacacgtggatctcacactgactcagcttgttacgtcagctaaaaccggatataatactacctaagacctcgggtgatccaattttacaaattgaggaacccgttatatctaatattgcggttcatggacgaatttcggatttgccgataaattaagggacctaaagtgaacttattccatcgatcgagcatgagcagcaaggaaggccctggccggctgctcctcgttgggccttgttcttcttcgaaggtctctccaatccaacccgtgtcagctccttccctcccattcgaatgcgcctgcaagtgccagctatataacacaccaccttcttcttccttccgctccatctccgccttgctcccaatccctcctcttcctcgtcctcttcctcctcctcttgcagtgcgagctctcccaccgccccatcccctatccatggcgaccaaagcggcgctccgatcgttgtggtcggccttcgacaagcaagcgtcatccatcattgacaagctcgtgtggccttggctgatgccagcggacgataccgaggagggcgcgaagaggcgcgcggaggagattactgaggagctcgcgcagctggagaagaccaggatgacgacgtgggcgcgatcggtggtggagagcttcgacacggcgcctcctccttcccctccgccgctgagcgctactacgcctcatcctcctcctccgtcgcctgcgaccagcagcagcaggacggcgacggcgacggcgacggcgacgccgacctcaccgacaccgacacctcccccgacctcggccactttgctgtggccccggcctcgcccgacgaaggaggaggagggggagggcctgcagcgacgcacggacgcggtgctcgtgaagaggctgaggagggcccgcttcgcggcgtggacgagtgcggcgctgcacaagttcgacttcgacgacgccgcccccacggtgcctcctccgccgccggccaccatgatacctcccccgacggtgacggctacgatcacgccgctgtggcctccgcctcccccgacgaagaaggaggagcatgagggcctccagcgacgcacggacgcggtggtcgtgctcgtgcggatgcagaggagggcccgcttcgcggcatggacgaatgcggcgctgcacaagttcgactttggggccgctccccccacggcgcctcctcctcggcagccgctgcctgttgggaatagtcccacattgaaagtttagggggagtggcaccaacttaaaaggggaggggtcccttacctcatgagctagcttttggggtgtagaaaggctttctcccggttgggccaacgtctaccggttttgggccaacaagtggtatcagagctcaggtgccatgtctggagatggtgtgtacacgccgccaccgccgccaccgatccgtcgcagcagcggtggcggtggcagcagcagcggcaatggagatggtgtgtacacgccgccaccgatccgtcgcggcagcggtggcggtggcagcagcagcggcaacggcggggatggcagcctaggcggccatgagctcgtcgtgcagcaagtgaaggaggcgggggtgacgttacgctaccccatgctcggggagaacaactacggcgtttgggcggtgaaaatgaaaatttttatgcgtgcacaaggtgtgtgggctgccgtggagggcaacgcagccgatgagaagatggatcaaatggctctcgccgccattgtccaagctgtgcctgaggccatggtgatggccatatccgagaaggaaacggcgagggaggcgtgggacgccctcaagcagatgaacatgggtgaagagcgtgtcaagaaggcccgagtacaaactctcaagagagtgcttcatggtatgtacatgggtaatagtgagaaaattaatgattttgctttgaaggttaccacgatcgtgaacgagattcattctctcggcacgaaagtggaggagaccaccgtcgtggagaagctcttgcattccgttcccgacaagttccaatccctcataagcaccatcgagcagtggggggatgtgtcggagatgacggtgacggagacaattagacgtttgcgggcgttcgaggagtcctccaaggggcgacgtcgtgaaaacgcaggggaggagcagctgcttattgcaggggctgagcaacggctcacacgcactgagtgggaggccattgttgctaaagagaagaagagtgatgaggcctctggcaatggtgagaagaagttccgcggcaagttcaacaaatcgaagattgagtgccgcaggtgtggcaagttcggacacttcgctgacgagtgtgatgagccgcggaagatggccaaggcagtgacgcagcttgtcatcgcggacgcggatgatgagccaacgttgctgtgaaaccggttgtggaggtggagaataaaatccaacaagattagagggtgattgttagagttaatcttgttgtttatgttttcattatattcagtcatgtatacgtagtggtctgagtccaaattagctagtgtgttgcgtggcatggtgagctgatcagccgttagtgaaagcacaaagtggtgcagcactacactggccaaggtcacctgtgacgggcccaaaccctcatctttgacgacttcgcgcatggtcagtgatcagtggtcactggtgagtccagtcacctttgacgggtggccggccgtcacaggtgacacccacctctgacgggcaagttactagaaggccgtcagaggtgttggtctccgctagccttgagcgagttaggacccgtcacaggtgactcatctctgacggccctttaaataaaggccgtcagaggttggggtctccgtagttagaagctgtcacaggtgatctacctgtgacggccccaaaagtaaaggcccgtcacaggtaggtcacctctgacgggcctttatttgctagtccgtcacaggttatgttacctttgacggatttttgttccgacccgtcactgatgagttaattccagaaaaaaaataaatgctaaatattggctagcctcaggatttgctagccatgccctctgaaaaatagaaacatcacagatatattccagtcacagatccatcacagatacatcacccccccaatataacatcacagatccccaacaacacatatatgcagttcaaatgccacaattttgcacagcaaattcacaccccttgaaagccacaatttcgatcgttgctcatagaaccgcatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcgggggggttgatgggtgagatcttgaagccagctctacatttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcattcttgccctccttgtgcctaccacccttttccacatatgggcctcaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatagcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactcctcgaccttccccttgccgcgttcacgcttctggcccttgacaagtggtggggagctatcggcctttcttgtggtctttattggagc

SEQ ID NO: 66559 - DNA, 21637 bp, Oryza sativa
catatgttagtgctggttgggagttgactggcgcaagttgatttttttcttgtaaattttggcccaaagattacgactgtttgtatgtgaaaatggttaaggtgctctcatgcttatgatcaaacagtattcccaacctgctgaaataaaaacaaatgataaatatatgtgtgtggtttattaaattagacaatcttttctttaggttttctagtacttctttaagcaaagctatcattttcctaaccaacctggtggtaggaaatttgggtactgatgtcatgatgtgattcttgaaatctctatacttacctaacattttatttaattgtacagagcagctcatatctgatcaggtctaactgtttgaatgttagatcaatgtgccattgataattgattagttaattggttaattgcttcatttaggccacccattagcataggacctagttgactagttagcagaagtttcaccaatctcacttcagaattccaaaaggttttaccaaatctctgtagagaaagctaagaaattatcatggatggcctaaataaaaaattgtttctgttgatgtctcattttctcgttgaggagcagcatatgtagcttgtctcttagctctttgtactatagtactttgtacaaggcgttttgctcaagagagtagtgaatttatatttatctgcatattgtcccctgtcccgtgccaacaaactaaggagcactgaatgttcttaattctgacctaaatacagatgctagcacaacccaaataattaattcactggtagattgccattccccttactccttacccaaatttcatttcagagtggaatacctgaagattctgaattttcctccattttcagaaaacggggtgaaaatctctccagacataaatacctgaacacttgaattaatgccgtaactttgattttgcttgaatatctcgcagtgctgttgtactggactattatgaaattccccaacattgctggtccaaatgcaccaaacacatgtataatgtagtatgccaactctgctgtgcagagctatccactggcaagctattaattccaattaaattcctactaatataattataatctttatgatatttcattagtgtacgtgcacagctagccatgctaccttgtcaaaatttccatattccaagaagtgtaacacagtagtatacacttttcacccatggaaattttagctcatttactacaccattaaccccagaataagtttatttttcacccatttacacatactagtagtaaatcaaaatgaatttattcttcttggctattctcaatgaaatttctcaataattactcttcttggctattttaaatcatttctctttttatctattctcaatgaatttattttttacttttacaaattccgatacaataattactcaaaaataaacttattttaagataaatgattatgaaactaaaaatgcatttattctagggcagagggtgtacattttactgtaaaactaatgatgggtttgtgcgtgataggggttggatccggtgacgatcgcggcgatcttctcgacggcggagcacgccggcgagaagctggtggacggcgaggactgcttcgtgctgcggctggacgtggggccgtcggtgctgtcgagctggagcgacggcacggcggaggtgatccggcacggcctgacggggttcttcagccagcggagcggcctcctcgtccgcctcgaggactcgcagctcacgcggatccagtcccccggcgccgccgccatgtactgggagaccaccatctcctccagcctcgccgactaccgcgccgtcgacggcggcggcggcgtccacgtcgcgcactccggccgctccacggcgcacctcgcccgcttcggcgtcggcgttcgcgccgcccgcgtcgtgacgcggatggaggagtcgtggaccatcgacgacgtggcgttcaacgtgcccgggctcggccccgacgccttcatcccgcccgaggaggtcaggaggagccgcttctacgacgccatggccgccggcaagtgagatcgatcaacctgttcaagaagagagaaatggtgtaacacgtagagagttagcttcggctgtgtcaacggtcaaccacccagctctgcttgtgtttgtgcatcgaaattcgtgcatgtacatatgtgtaccaacctgaggtaattactccatccgtttcaggttataagactttctagcatatatatatatgttaatgaatctacgcatacatatatgtctagattcattaatatacatatgaatgtagacaatgctagaaagtcttataatataaaatggaggaagtacctaagtgatgagtaataaatagttacacaattcttaaacctgtattctgagtagttctgacttctgagaagataaaaactactgaactgactttgcacagattgtagatacctgcttagccttactacatgtctctaggttattgcgaagtgtttttgacaatcttaatcttcctgtcttcttggaagtatatactactacatgtgagttgcatttgtctgaaactttgtagctacttctgcagaagctctaggcaagactgaaatcatgtgctgctttttgtaacttgtatgttgttttctgccttggtatgtgatctgcatggagatgctatgcgtgctagtacataaacagtgttattcatatgcatgcctagcagaaaccagtggcaactttggaaattggaagttgttcagcatggttcttgaacatgtatgccacttgacaatgtctgcaaatgagcaacactagcaagctgtttgttttttttcccgttgcagaagctttgcaatttacaggtgtgcattgcatttgccctcatcactgtaaaaagtctgcaacttctttgtttgcatctccctgtcctgaacatgtgtcccttgtggtgtggcatcagcacttgctcatgtttctagtgcgatcacgtcacaaaaagttggaggtcacattgggtgtggcctgttcatggatgcctcttgtcttcttcagctgcatatgcatcggcaaaatgcgcagagtttgcaccaatctgtgaagactgttaaccacttgtttaatttgtcctgtccattgttaacttttgcagtattctaactcgcacttccaactgtacatgtaactaactattgcatgctactctctctaaggaggatgtgtcacatcacatcccaccaaaatcccttatattatgggacggagggagtaaaatataagcattttttgaactagatacgggtaactagggaaaatgttttgattggtcggttggttgagaagagaaagtaaatagagaaattaaatagagaattattatgattggttgagatacaaaagtaggtgaagaaatagctttattttgagacaaggcttaagtggtagaaatagttttgttttgaaagggagtattgatcatagagcatcttcatctgaaacggataaggggttaggtccatgcattttccagcttgttgaatctagatgaatatggtaccacttgttgctgctgtctggcggtgaactgaactttgataataagcagtagattttcatgcggcgatgttcctaatatccacatggggttcttcagaaatctgctccgatctgtactcaccatgttctcatcaaggaccacattccctgaaatatacaagcatatcagcaacttaacctcaccaaagggaccaaatttttaacatgcatgaatgatcaatcactacattcaagtactggccatgaagaaggcatcatgacctgatctaccctgtccatgcccttgcattgactctgaatcagggacagattgttgttgttcatccaggacttggctaggctacattgcacatgtctgtcctttgcattcaaaagcaacaatgtactataaggtgaccatgttttactgtcgtctccaacagttgaaagaagcgagagatggatcatctgtcgagcttgacgggtcccttttgattgatgtgtcctaggagatgtgtctcataatgcctgcaatttcttgatttgcatgagctgtaatactgagttgcagtgaaaagatcaccaccaaccactgtcctcttgcgaagaaagcatcactgttgcatgcagaaatattagttaaggttaattaatactctgtttaagtgtttataatacgctcgtgtgatccttcctatggtcccagggaatcgaagtgagatcatgcagtgccaaattggcaatggtaatggcaatgcaacgctggagaggggattaaacaaaagggtacagtctgtgttgaggccctgcactgcaatatgctactgtacaatatgtataccatcaaatcacaaagtgatgtcacaagcaaataagcaatgatatgactaagttggtgatgaactagctatggtttgtttagtaatagtagtagtagtagtatcctactttccaatgggatcattatactgttctgctttgtcccctggttccatggatctctcgtttggattctagtaaagcgagctgcattttctgttgaatacttcaagtgaaaatgactaccttttctttttgtttaaaagagttagctgagaaatgtcgtagtaaggaaaagttttgcttttttaaaataataataataataataatggcatgcatgccttgggagttcaactgtagtagttgtcattctgacattctgatggctgcattttcttctggtgaccggcagtctccttaaactggttagacctgcatggcttcatttctttgattgattaattaattcctaaagtggatagagattaggaccagaagaggatttaatcttttggcatttagactctgatcacaaatggaaactcaggaagtacaggagaatccattacgatattatccctaaccgctgaatattcagaaagctggttgtcttctgttagagcagagtgtccttttgtcgtgaaaaacataatttaagacggcattcaaggctaattccagccatatgttttgcatagcagaatcattaaaataagctagccaatgagcttgtagtgtaacaataacctaaaaggagggggtgactggaacgtctaaaccaatactaacaataaattagttggataaaaggactctaattcgaaaggaaacacgggtgtttggtttcttggaccaaggacagtgagcagaaaaaacaggtggcatgctgacgagagcgctcaaccaaaaagggtcagtgctgctcgcgatgttaatcctgcacctaatcgttcaacaattttgaattagatgcaactaaccatgcacacgatacgtcgtggtcagattcagaccggacatgactgatttcatggtacgaaatgaaagagaaaaaacagacatttactcgcaaaaagaagtttaaaaagggttcagtttcaggcaacttgtttgtcactctctcggagtcagctcagagctggtcatctttttaacttgtggtcttgtttagtgctgttcttcagagttcagacagtgtctactacccagggttcacgtttccgttcgaaaactcgaggttttgatgcgggacgaaagaagattttcaaggcaacttcgaattgttctcgagaaattcaaatctaaaacagtattttcgaatgaaatttagtcgaaatttaccgaaaactgtcgtaccgccggggtcaggatccctctaaagtctaaagcccgaacctgttgtcttcctccctgacgcggaacgaactggacgcccatttctcttgtgtcattgggcccatttgggagacaattagcgggccgaatctcgtaggcccatgtgaaaatcagacaaaacgcggcccgtggggtttccccttctgtggagattaaaactgggccaaaacattatgaagcccaacttctatgctgagttaaacataatgacagaatcaacgatggatgttccgtgtaaagcttgagaatatccattcggaatttcggattatccaatgtacgcctatactaatacagtactctcactactcactatatattttatgcgatttaactcttgtagctgttttgtttttgcataggtttatattcattttttaaactcaatattcctagctacataaatctttaaatttagagataacattaaatgaattattttgtttttctttataaaaagtacttcctctatttcacaatgtaagtcattttagcattttccatattcatattgatgttaatgaatctaaatagatatgtatgtctagatacatttattagaaatgctagaatgacttacattgtgaaacggatggagtaaaactttccacctatataattgaacttacaacttacatcctttaaatatgacgtagatcagagatatgacgacgtatcaaatacaacctagtattattaccaaattaaaagttcagcgagataaacgtatcttaactggttagattttttctgatgaaaccaattataaaaccctaaactcagcacgtgtacttccgtgataggtgtttagaaaaataaataatagtgccagtaatcagtgcagactgagctaaaactcgagaaaagaaagcgataatgattaaagaaaaggaaaaaagttccgatttttggaggcgcacggagacttctcgcagcagtttgttggcggccggataaacgagacgaggcgaggcgaacgcgaaagctccccatctccctccctccctccctcattattgattgattgattcgcagattcgccgctgccaccgcatcccgcccacccaccgcgcgccaccgcctccgccgccgacgagcccccgcggccaccgccaccgccacctcatcttctctcccaccaccgctccacagccgccctcccttacatggaagtcgacgtctccatcgccacgcccgcaccgcaggtccgaccacgattccccttcctctagagctttcttcttcttccgttctcgtcaatatcccgtgaaagctccgacctttccccctcctaggttttcttttctttttttttctttctactgccctagtcgctgcgaccgcgatggatgcgatggctgtatgctgctctggttacctggtgatccgatccggcttttcgcgttcgatattacctggggattagacgcgcttgttttttttttttttgtgccttcgatctgttgcttcctgtcttaggtttccgctggtggagctgagtagtattacatcgttttctccaatatatcactctagttgactcgctgagagaataatctgtgcgttcttgtttttgttcgtgccttcgatctgttgcttcctgtcttaggtttcggctggtggagctgagtagtatagtacatcgttttccccgatatatcactccttttgacttgctgagagaataatctgtgcgtacctctttaaaaagatactacttttatcgtaccactgatgatacttgattaggactcagggatggtatctttttggatgcccagttcaggagaaatagggatcctttgttgcgtcatagcttttcgtgattcctgagattaggaccagacctttgggtctcctgatatttgtttatttcgtcctaattctctccactcagtagacctattctccaattgtttcttagtactacgtagttagggaagatacctcctctggggctttatttcttaggagaatcatcattgcttgtcaagtaccatcttaacattgtttcttttccaaccattagaggcattaagagtaaatttttgttttggaaaacaagttaccatgtagtatttcttttttgttggtttacttgtttttgcgttgctcagtagtatgtactattccagggtctttctgtgcgaaagccctactctttggcttaatgttagttgacaggatcttgacgattgtcggttttcattgcaggaatcttagctgattggtgctttggactgcaggtctggacacgttgtccgtttcctgcttgtgcagacgtaggtttggagtctttctgagtgttaaggtggctttcctttttgtccttccatggttgaaatttgtatgaacaaccttgactttctcgaagatctgtgttggtcgataagatgaatcgaagaagaacaatgctattgcttatctgtctctgtgcaacattttgcctcatgactcagttaggagctgcaaatgtagtgctgatggggacaaatctgactttgtcgtttgatgatgttgaggcaagttttggtaagttctggacatcttatcatattagttttgttatagtagagtactaatagattctatttgtcgggatctcagtctccctacctgtgaaactttattacctaaaatttcacataccttgtaagccagttgcctatggtcattttggtcttaatgttttggttttcaaaaccttgtagttgtgctactgttttatttatggtagtgtgcgaatctgttgctgtatttcctattatatctttgtgttagctctctgactagaattagcttcgattttatcccattgattgtgccatgctgcattttcttgaaaggttcttttcttctacttcccattttcctaagtctatattgtcttgtcagaaagattcattatgctgtttattcaattggtttgcagctccaggagtgaaaggttcaggttttgaaggcgttgtttatactgctgaacctttggacgcctgcagtccgttaacaagtaaagcagaaaagggtccaccatctccatttgcactgatcataagaggcgggtgcacatttgatgaaaaagtaaaaaatgcacaggatgctggattcaaagctgcaatagtatacgacaatgaaaatagcggggttctgatttcaagtaatgtaccttatcactcccacttgttttttttttctgcaacatcttagttccactgtcagggttgggcatcatacgctccattcatggcataatagattataattatgtttcttttgtctttatattctcccttatgtccatatttgaggacctgtatatgtggcatgcattaagaagagatggggccatgtgagaggcacaagagaatgcttttcaaacttttccttgagaacggatgaaacaaaaatactgtctaggctgaaactttccaaaataagtaaaaaaatatgaaaaaaatagaaattgatacttttaaaagtcataccactttgatgcttttcactagttcatttagcattgtttagactttgggggcatatggttctgcattatctaactttgaagtttacagtggctggaagctcaggtggtattcacatttatgcggtgttcatctcgaaggcctcaggggaggtgttgaagaaattttcaggccatactgatgtagaggtgtggatactacctgcgtttgagaactcagcctggtcaatcatggcaatttcattcatatctctgcttgccatgtctgcggttctagctacttgtttctttgtgagaagacatcatataaggcgggaccggcctagaattccagaagcccgagaattccatggaatgagcagtcaattagtcaaggcaatgccaagccttatcttcacgaaggtgcaagaggacaactgcacatcatcaatgtgtgccatttgcttggaagactacaatgtcggagaaaaattaagagtgttgccttgccgtcacagtatgtttttctatctctgcaacaccacaactaccttttctagttcaaattgatacgttgaggacattcccatagcctattggttttaggaaagaaaatagtcatgttcagttgctaacttaactcttcaatccttggatttggaactgaaaacattctatgcaagtttttttagtctgtcatcacaattttgtgtaaagtactacaccactctgcatttttgttttatttgtttttgaatgtctggactaagtatgggtttgtgtatttcacacacaattagtacttttgtgtagtatccactttctgaaccttggaaattccacagtggcgttcactattgcagatgttttaactggacatttaagttatacttatgcacaattgattatttgaagagagatatgtgttgaataaacttgtataccttatatacaatctgctatctgaataatggtattccagtactctgatatttgtgcatattactttgcagagttccatgcagcttgtgtggacctttggctcacaacttggagaactttttgccctgtatgcaaacgtgatgcaagtactggaataccagatcctccagcctcagagactacaccattgctttcttctgcagttcgtttgccttctcagtcatcttcgttccggtcaagcgtggcagcatcgcctccaagaccaataagtcgacgaccttcatcacagtccatatctcggattatgctgcttctggtacccccaactctcctaaccccataaggtctttcacaaactcaactgccatgagcataagtagaagcaatgtggacttatcaaacatgtcttcccgccctcgcgcctcacacctcgcctccgcacattctttggttggcagtcacttgtctccaccaatcaatataaggtacgcatcgccgcatatgtcccactctggctatgcatcacctagtccacatgttagctcatcctatgtctccaactctgggtatggatcttcaagctactatctcggttcatccagccagcatcggtcatacctaaggcgctgtggggaatcagggcctagcttgtctaccatggcccctcagtcgccgcaacagtcccagttacgtcatggcggcgaatccgacttaaatctagcaggagcatcctcaggccagtctttccggcaatcctacctgagacactgtgctgattcagaggtaaatctagcaggagcatcctcaggccagtctttccggcaatcctatctgagacactgtgctgattcagatgcaagcttatctgccatggcatcagctcaatccttgccaggatgctgatttctctgggatcagatcagcttctgtctgtactaagacctggcgtgacttgtgtatacatttgaggcatgtactataggctattggttgagagaaaatggtcgtatttgtttgtgtttctcctgctgccctgcccttttggttgtagtgattgttagcgctctatttgtttcaccctagagtgtatagtacaattgtacagcaactttcttttaaactaagcaatatcatccgcgcgttgcccataaattggatccattgccattactaatttgtccgtttcaaaaaataccattaataaaccgaggctgtttagattgttgtcaaaataaaacttaacaaattttgttaagttggcaatattactaaaattttagcatgattttttatgtattttttaaagtttggcaaaaaaaactatatttatgcacatttttgacaacttaaaaaaatggtatagtttgacatggcatcaacctgaacaaacccctatatgtttggacccatatgtcattatttacccctatgatgtatttgtcaaattattattttttaccatattcctcttcttcctttctcctctcctttcttcccgttggtggagcggtgggtggtgttgttcacttcggcagctcctccccctctacttaccccgatgaggttgggtctcatggttctctcttcgtcttcccaatttactcactccggcggtggcgagtagtgaggtagggctaatggttcccttctcttcctttctcccttcggcagctcctccccctctacttacccccacgaggttgggtctcatggttctctcttcgtctccccaatttactcactccggtggtggcgagcaatgaggttggaccaatggttcccttctcttcctttctcccctcatctcttcctttccctctcctgtcacttcgggcgtagctaaattgacgttctcgcagccgtaggacctctccactattggatctgcctttcgtcccgacctttgccttcgtccctgatggttagcccacctacacccgcttgacaactgtggcgtctggagtcaagacaaaatcggtgtccggttgaagaggaatgagggaggtggccgagcgagactgacctcaacctttgtcccctttccccaatgcatgcgccaaaggaggaggcgcggggaagcatgtggcattggtgaggtacttaggggaaattggaggtgcagagggtggccggactcattggaaataggtgagaggagagaggggaaaggagaggaagaaggataaaatggtccaaaaaattttaatgattgcactgaaaagataagtagtggtatctccaataactataaagtaatgatatggttctaattaaccctatagttctattgtcaatgaattttacagtactctataagtacatgaaattgtgtacaactatcaatgaatatcttgtagatatgtaagcaataaaagttcccaatattagtgaatatcttgtagatatgtaagcattaaaagttcccgatattattagacttgtaagcatctaataattgaggaatgatgtgaacgcttctatgacgtaggggtagggcattgggggatacagccatatatttcttcatctagaacacacatcacctcaaattacgaaccgtattatggctgtgtttacttccattcaaactttaaacttttccgacgtatcaaatgtttggacacatgtatggaccattaaatgtggatgaaaaaaaacaattgcacaatttgcatgtaaattgtgagacgaatcttttgagcttaattatgccatgatttaacaatgtggtgctacagtaaacatttgctaatgatggattaattagacttgatagattcgtcttgcagtttacaggcgaaatctgtaatttgttttgttattagtctacgtttaatacttcaaatgtgtgtccgtatacgtcaatttttttttaccaaaacaactaaacacggtttatgtagagacaggaacaaataatccatgacaataatatagtgaaatagttgaaaagaacatgaccttgaagttcaagtacaagtgttatgtctccactatttactctttagcttatcaaccgcaactaagatttaaatttcaaaacctattatacttatttttagagttgatttaatgttttattatcatacttcattgcgatttccataataagatggttgctatcatcaacaagcaactttgggccgccccagggaactgaatcttttgcatgaaccactgcatttccaagaagtgcacgagctttgcatgccataagcccaaaagactcagcagcttagcgtcccttattataaattgcttcactgaccagcggcaaaaagatggcctcctcctgcaatctgcaagactgaagctaagcagctttaaatcctcctgcgtcatttaaccccctctctgcctctctgagctctgagctgctcagctacagctccctagctgttctgttcgattaattcagcttcgctttgcttggattaatttgtaggtgactaactcgatcacagctcaggtgattggcagtttgatcacaaggcaggaaggaagtagaagtagattgctgtagcacacgctcacctaccaagcttctacactcgcagccaagctttgatcgtttgcttgctttgcattgcttgggctttgtgggcaagaacgtgtctatcttcttcttgttcgtctcgtcaggcggccatggggatgagttcatgcgtgaacctatcccgtgtcgccgccgccgccgcagggagacggccgggatttgccggtgagctgggaggtcgccgtggtcatggcagaagcgtgcttccggttgttgctgcactgccggtgaggaggaagggaagcggttgtggcgtggcgtgctgcgtctcctcctcgtcttcctcctccgtgcacggcaagaactcggcggcggcggcggagggtcacgccggcggcattgggatcgcggagttcctcggcggcaagaacttcctcatcaccggcggaaccgggttcctggcaaaaggtagtaaatctatcttcttcctctcttaaatttggatcatccaacgtacgtagctcgcgtctcttcttgattttgcttgatcatctggatcagttctcatcgagaagatattgcggacgaatcccgacgttggcaagatctacgtgctgatcaaggcgaaggacggtgacgcagcactgaaaagattgcacaacgaggttctacttgcgatcattgttcgatccatttcagagaaacatttgttagtacctatctgttcatctgtttgactgtatttttccttttgttttaactgtgtgatgtgcaggttgtggacacagaattgttcagtcgtttgcaggaaatccatggcaaggattaccacagcttcgcggcaagaaagctggtgcctgtagtcggagatgtcagagaagccaacgttggcatcgcccctgagcttgccggcgtgatcgccgacgaggtcgacatcatcgtcaactcagcagcaaacaccactttcgacgagaggttttgtcattctctgaactgcagtgttgctccaaagatgagttcttaattggatcacttcatgtataataagcatatgaattgatcactgttgctgcatttggttcgattttgcaggtacgatgttgcaatggacatcaacaccgtagggccattcaggataatgagcttcgcgcagcggtttcggaggctgaagctgttcttgcaagtgtcaacaggtcagaaatgcatgtcaaatgaaaagctcttgtgctgaaaacttgcactgaaattacctccaaaaaccttagatatatctctctactgtggattttgaatttcatgtttggcaatcagcatatgtgaacggacagaggcaaggtgtggtgctagagaagccatttcgcttgggggacaccatagccaaggagttaggatctccagattcttcacaacacaagaacaccatgcttgacatcgaggcagagatcaagctggcttttgaccacaggagacacggtgatgattcagcctctttctctgaagaaatgaaagagttaggattagagaggtatacacgcaatgccagaaacgtttcaagtctgaatgtgcagtggcaagattatgcaattgcacacatgaaacagcattggttaattcgcttgatttgggtttaatttgtagggcaaaactccatgggtggcaagatacatatgtgttcaccaaggccatgggagagatggtgatcaactccatgcgaggagatataccggttgtcaccatcaggccaagcgtcatcgagagcacctggagggatcccttccccggttggatggaagggaacaggtacaaattgtaaatcaaagttcaccaacttaaaccaattttagttcatgagataatttagtttacgatgaattggcattgattttggcgaaatgaatttgagcttgattaggatgatggatcctgttgtgctgtactacggcaaaggccagctgagcgggttcctcgctgacccggagggtgttcttgacgtggtaatgattaagcagatgattaaattcgctaattgcgattagtggttaatcgattaactatggcgatttgtgatggaaggttccggcggacatggtggtgaacgcaacgctggcgtccatggcgaagcacgggcgcggcggcgcggcggcggcggcggcggcggcggaggggatgcacgtgtaccacgtggcgtcgtcgacggtgaacccgctggcgttcggcgacctgagccggttcctcttccagcacttcacggggtcgccgtacagcgacgcggcggggcggcccatccacgtgccgccgatgcggctgttcgacaccatggagcagttcgccagctacgtcgagaccgacgcgctgctgcgcgccggccgcctcgccggcgccggcgccggcgccggagacgagagggtgtcgcagcggctgcgcgagctctgcgccaagtccgtcgagcagaccatctacctcggcagcatctaccagccctacaccttctacggcggcaggtttgtttcctagatcgttcgttttatttaaaaacttttgtgaaatatataaaactatatgtatacgtataaatatatttaacaataaattaaataatataaaaaaattaataattacttaatttatttctaataaaactaatggtcaaatatatttaaaaaagtcgatggcataaaatattttaaaacgggggagtatattcgtatatacccgccatggataatgcattgtgaatttgagatgctgatgagctcgatcgccggccatggcggcggcggcaggttcgacaatgggaacacggaggcgctgatcggggagatgtcggaggaggagaaggcgcggttccacttcgacgtgaggagcatcgagtggacggactacatcaccaacgtgcacatcccggggctcaggaagcacgtcatgaaggggaggggcgtcggcggcggcagcggcgcgtcgtcgtcatcgaacgcctcgctgctcgccggcgcctccgtttgaatggccaggccggcgccggagaagaggaggatgcatgcgcggcgtgtacactaggctagattgttgttaacttgttctgccgtggcagtctgacagatgatctttgtgctgcagtaattaaggttgatagtatgttatctctatcactatgtaatcagagcaaaaattggcaatcaatttaacagaatttacaaaagatgcacataattcagaatataatttagcagagagaacatcggttgaccaagtttttggctttgatcaagtacatgtctagaacagtatggagtactagtagagtagtgcgaaatttgaaaaccagaatgtcagatacatgcgaagaaaaacatccaactagagaaaaaggtgccatggaacactgcactgtagcacatcagggtaaccacccccaaaattcggaatactacaccgaaagatgattaggttgccttgccattgatgatacaaattacaagactatcgatacaagcttacgctacaaaatacaaatagaagttcagtcttgccactagatttcctctgtaaaaatgcctaaaaaggagagggtgaggatggatgggccttttttatcacctgaaaaactcaggcatcgctgcatgagcatgacactttgtttcaggatagcagcatctcttgcattgaccaatggagggtcaagttttacgaagggatctgatgttcccttgttattgttggttggcctatgcgcaggtttcacagtccagcaaagtatcactgaccagcatttgactatcgcaaattcgcagtacaaggtgacaaatggtagcaccattaactcaaaggaaataatcgggcgtcctccgtgtcacgtcaggctcacctctcctaggagctggttcgaactgcaacaataggaaaccaacatgattagccaactacaggatatgcaattgagctaactatcagaattcagaatgcgtattttaaatgaattgaatgaaggaaagagcaaaatcaagttatcaacattctaattcagatttccaacaccttactttgacagttaagccatgaccagcacgtattacatgaacttaacgaaccaaggaagccggaaagttgttgtaaagaataaagttagcagtaatcacctgaataaaagtatggctgttgcagtcatcaacttccaaaatggatgccatattcccacatcggtaacaataatttggagcactgaatatagtaacaactttttgttcctgtatgtgcatagtgaataattatgacatattacttgcacaacacgcctgataaagtatccaaaggttcagtaaacttacatgagcccaattatatccttccataactagttgatgagcccgagctacaagtttgagattgttggtgtgattgaattgctcggatatatcctggaaaacaaaagaaagaatgaacaaactataattaaaacatctgcaactgaaaaagttcaagacagtgtagtacctgcccaaaagtgtagccagcaccacgaggagatatgccccaaccacagcggtcatctggatcagaccatagaagatcacacattggtccctcatgcggaacctcttggacacgatctaagctacgcacactatcaaggttctcaattgatggagataaaccaccatgcaggcagaaaatttcagattccaccttcaagaacataaagaaaatattaacatggctcatagatgcataatgctgacaatatgggtttattgaggatggaatgcagttattgtatgtacagttaatgattttgcagtaaaaagagttatgcactacattaaacgtttattgatgaccactttacatgattcaagtaatgcatccatacaattgaaaatccaaagatctaccagagagaacatcactgttagcaacttggtatgatgtcacacaactcccaaatggccaaggaatttcaattatgcagctgtaaatacataatgtatgatatgtcgcattctttcacaaggtaaagacactagtcatgccccatcgatatgttcccagctatcaagtctgcaggtggcgatatacaatcagtagttatcatacaggtgaaaaacaaactaggcttccatattgaaacagtgtaccatgcaataaatgcaaaacaaaaaaataaagaaaaacaagagatacttagaaatgacagaacaaaccaacttaaagaaaaagaggaggtcccagttcagagcacataccagtgctgtcagtggaaaatagtcaaataaatccgtgaatatcttccatacatttgcattgccatacctggtttgaaagaagggtcaacaacacaaattaaaaatatgactccatttcaaacatctagtagcaaatcattgttgcaaatttcacttctataaattaacaaacaatatcactgttttgtttgaaacatattgaattaatgatatgtactaccacataggttcaaaaggtacagaactctaatatacaaacaacacaaaacctatatactaccgcacagaaagaaaaaaagggcacatgataccaaatagattccacatatactaaaactttgttcgtctgtctattatactgagacaaggacaagaagtaccacataactctaggatcagacagaacatgcatagagtttctgccatggcagcaatgatgcagttcatactgaacagcctacaaggctagacctggaacaggattaagattaattttcatgaagcacctaaacaaactcactttcgtaaacattcgtcgtagaatccataaacctgtgtgatctgcaatcatcataaaataatattttcagtttaacatagacataactaattcaccattatgacagacagacgataataaaacaaactgtgctaaacagaaaccagaagaattcaacaaatttgctcaaatttctaatcaactgagaaaattgcggccaagtctgcacatagtcattgagaaaagttgaacagcacctgccggctctcgtgatttccgcgaaggattgtaatccgatgtgggtgacgcaccttcagcgctaccaaaagctggataaggaataccactcagtagtgcttacacataatgacatgatctcaaacataaaacaattgaaatatttgaaagaattccagtaatcgaattttgttgctggccaataagaacaaataaatctggtatgtgaaacttgacagcttctgtaaaactgtatataaatactcatcaaagaaaataagtaggttaactcttacagtaacagtctcaacagagtaatagccacgatccacataatcccccataaataaataattagtatctgggcactgaaacaaagaagaacaaatatattaagtatctttaagaacagaataacgaaaggaagatttcaaagtatggtagcaaaagtaaatgcaaatagtaccttcccaccgatccgaaaaagttctacaagatcatggaattgtccgtgaatatcaccacaaatcgttactgggcttttgacaggctgcataacccaaaaaaaaaaaaggcaaaaccttaaaaccagtactcatctaccttaccaaattaccatggaacagaacatgcaaatattttgagaacgtcttagcagaattgtatgtgcacatactatgagctatctgaatggcatgtaaaagagggggtaaaaattaaggtgatgaaaattgaatggaaggaggaagacttgaattcctgtgtttattttagtcatcagcattggcagaattatggttggattgaaaggcacagaaatgtatgactaaaacatatcaaaggaccaactaacttgtgtaacactatgaagtacccttgctcaaatacaatgccaaaaccatagtgcaggttcaatcaactgttgaagaagcaataaggaaatcctgtcacactcacacctatcctgaaatatacccagcataacagtgagaaaagaaccggcagtatgcgatacctgaacattgctttcctccatcaatatctccttggccttctcgcacagtgctttaacctgcaattgagggtccattagaacacacgtagattccaggaatataagaacaccagttgtgtagacatttatgcccatcaaatgttcctatttttggtcaaccgtccatgcatatccacacatatgtatatatcctatcgtattctacaggttataagcatgtgaacctaatttgcgatcaaaacaaaaggtagcagtgactacgtgtgcttgtaaatttccaatttttatgctactttccgcgaccatctctagggatctactaccatgaaccaaatctggatcatcacatcggaaggcaccaaattccaagttgccctcgccagccacaacaaacaagcactcgaacccctctccaaaccgccaaatcacccagcacaacaaaaactacgcgccaatcgctcgcgaaccaccggatcacacggcaaatccgaaccccccaacccaacatccccgaacaaaaaaaaccctaggaacagatcaaagcgccaccatattccccagatcgaggcgccccccgcggagccatcgccggcgggacgaacggcgagaccagaacgcggaaaagccagagcagcagcagcagcagagggatctcgctcgctcgctctcacctcctgctcggcgagcgggcgacactgcatcagctgctcgatctgcgtgtccaggccggcgcatcccccgccgccgtccacgctcatgggctccatccccccgctccgccctccggaggtaggcgagcgcaccgccggctcgagctcgtcgccggcggcgagggggggaaagcgcgcgcgcgctccggccgaggcggattgagagagtgagactgagagagagaagagaagagaagagagagaaactgtagacactggaggtagggagagagagagagagagtatcagagtactggacgggaggg

SEQ ID NO: 66560 - DNA, 773 bp, Oryza sativa
cactgtcgccgtcgtcaagtcgaagagtgccgccgcctttttcctcgcgccgccgctgtccgttgatcttccgccgtcgttttggtcatcggtgagttcgccgcgacgttctctacgtgctggtgccctccgttcacgtccttgcgccgtcgttcgccggcgagcaagtgctcccgagccgccgccggagatgacgtcgccgctgacgtcatcatggccgtctgccgtggcccggccgtggatcggttgatctcggccgttcgttttggataagatcgatctcggccgtctgttcccgtgaaccgctgccgtgcgcctggtccaccgcaaaaccctagccgctgacgcaataaatccctttttccttttcaaaaataattcgttattgcgtcataattcaattaaaatccatataagtgttttaatccgatttaatctttaaaaattcataactaattcatcttagctcggatttagttggttcaagtctctaaatttttctaaaaatgagatctacatgttaaaaatatccacatgtactgttcatgcttgtttatgtgctgttttggtgattttgcttctttctgtttagattccggcgtttccggagagtccgttttcgcaggagaagaatttgaagagttccaaggccagcaaggcaagtcacacagatcccaaacaaccctttgagcatgttgatcccgtttaaagctattgtttctattcaactattgcatttattttcgaatgtcatttggtggaattaacctatt

SEQ ID NO: 66561 - DNA, 15125 bp, Oryza sativa
ccttccaattgatcaaataggtcatcaattctgggtagaggatacttattcttgatagtaacctcattcaacgctcgataatccacgcacattctctgagtatgatctttcttctccacaaagatgactggtgctccccatggcgaagtactgggtctgatgtatcctttctgaagcaaatcttccacctgtctcttcacctcaactaactcattagctgccattctgtatggtctcttatggatagggttggttccaggtaccaagtctatccgaaactctatctctctcttaggtggcatgcctggcaaatcctcgggaaacacgtctgggtagtcttgtactatggggatctcttgtagagcaacttggtttaagatcacaccatgagatttaggagaggacataaagaaagaaactgtttccccattgctactggttaaagtcaccttacggttggcacaatctataactcctctgtgacaagataaccaatccatccctaagataacatctagatctttggattctagcaagataagcgaggatgggaaaggaacttcttctatttctatagtagcggaaggacaatactgtgtcgaaaatacttgattgcctggggtattaactagtaaaggtctctcgagactaataacttccatcccatgattgctcgtaaaacttttagacaaaaaggaatgtgtagcaccggaatcaaaaagcacagttgcgggtatagagttaacagggaacgtacccaaaaccacatctggtgcattctgagcttctgctgctgcaacatgattaacacgtgcctttggtgctggaacattggagttgttcggggctggagcgttcttcacgcgccgaggcttaggacacttatcagcataatgtcctggatcaccgcaattgaagcatatcactggcttgcttccctgttccttcctgacaggctggttctgagctgaagttgctgcaggacgagcaaccacgttgcggttgtcattgccacgattactagtattgttgttgtagaactggcgttggggacggacaactgatgaagatcctccttgagggtacgatggaacttgaggtccagtaacgagacgcggcctctggttactgccctgttgtgccttgaattgggcagccctgcgcttcttctgctccatccggttatacttgtcttcctgacgaatcgccttgtccaccaactgctggaaatcccggaaatccgtagacatcaaagcataagacaactcatcattcagtccctccaagaatttctcctgacgctcttcatcggtgcgaacatcttccggagcataacgagctaaacggttgaaatcatggaggtactcggtgaccgatcgagatccctggttgagtgccctaaattctctcttctttagagctacaacacccgacggtatgtgtgtcttcctgaaagcggccgtgaattcctgccacgtaataggctctccttcagccctgccttggcgaaaatgatcccaccattcagcagcaggaccatgcagttgatgcgaagcaaaagaaactttctcctgctcagtacactggatcaaatccaacttcttctccaccgcatgcagccaatctcctgcttctactggattggtggtgctggaaaaggtagggggtctcacgcgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagtagctccacttccacttccacttccacttccggtgcgcgtgttcaccatctgacgataagcagagactcatgctgttacatcccaccaatgatgtaagcaacaactaaaacccacacactcacaagcaaacttaaacaagcaatctaacacagcgatctacggcaacgatctaactaagcgactaaacccgccttgtgtcggaacgaagcgatggatcttcttcctctggagtagctggctctctttcttcagggtcttcctcctcttcctcatcacttatgatgtctatgacaggttcagcacgatcgggcacagcttcacccatcacgcgaatcttcgaagctaactggagacgaggtggcggacaggttctttttctttgagtgaggcgatgcttgggtgttggcggcggcgtttctcctttaagttcagctaattccttttgtagacggtacaccttgctctccaacttgcaaatcttgcctcgattccagttttccctgtcatgagctgctttgtctcgctccacacttactgcatccatagcactaagcatatgcaccgcatgcatcagagtggcactctcttcaccgtcaggacaggtataggttccatagtcttgaccatgaggcttgtgaggatgatactggaaagctgatgaatccaactcttcttcaaagcgttgacgcaactctccaatggccaccaaagctgcctcttgacaagcatggctgtacgatcttcctccagcttcgaacttaaaagacggaaggtcatcactatcactagccaacgtcacacgaacacgacacttctcctcgtcggggtcatgggaaatttggcgatactcgggagcaacttcatagcctacctcaaaagccatcaacctcagctccctgacgaaccctaacaccttgatcaaatttctcggtgaatggggtggcatctaaagaaacatagaagggaagaattaatgcatatttttaagttagctgcaccaactagacttaactgatttagaccaaaaaggaagaaaataaaagaaaagacacatacaaagctactttatatatttttctttttgaatttaacttttgaacagagacaaatcagtttgaacaagtgaataaaataaaaccaaaatacttaagacctactataagcacggtacaatgtcaccattaaaagggatgagtagtactagtgccaacatgattaaatcgataccataatagatgtacagtgccgaccaatccataagatttagtaaagagaaaaagaaacattttgagaagaacaactttttgctttttaaaagaaaagaaattgaattaaatgaattttgtgcataaccttgcatgtgctgccaacttatttaatttgtaagagaatagagaagagcagttctatttttttttcaaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaatgacaatttgataatagagtacaaataaataactatttaatactcgcaaataacaaaagattacagaggtagatagttcctctcaaaaaataacattctacgcagcggaaaaaaaactataacaaactacggaacagctatggcgactccactccacaggcatcttaaccaagaacaagctcaatcctccagatcatcaccttcactgagatactcctcttctgatgaatgaatattgcaagaatgagcatatgacatactcaacaagtcacacagcaaatatgcaagtgcacaggataacgaaggatggcataatatagctcatttgcagaaacagcatttaataaatatttaagagaatgataaaaacagttgaataattaatcagtattaaataaacaccatacaacacacccatgttgcataggcccaaccacatttgaacaaccaaccccagttgaacaaattaaacctccaaaccaggaattatccattccaaaccaggagtcaaattaattaccacattataaccattaatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagttgtgataataccccttgcacaacataacccattacagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggctggcacgataaatgtttcacaacagtagctcgcgaaccggtccttaattgtcatgagcacaaccatcaaaaccatatgctcacaacccaccttaaccaggttttaattatcaattaattaacatcacacgatttaccatcgtgagctaccatttaatataatcatcattattaataataatataacatagtttataattaatccctttagttagctaatgtttctaagcatggctaagcaaacctatatatagcatttagctgaaccaaaccaatatataaggttcatgctagtcaaattataacccctaggaaaataaagtcatcttcggccaataattaactgggaaaggttcaccacccgatgacattcgaaaacaatgcatagttgaaataaaataatagctttaaacgggttcaacatgctcaaagggttgtttgggatctgtgtgacttgccttgagcttccgcaaacgcttcggaaccttcctcaacggaaacgctctcctccggaacgtcggaaactaaagcaattaaacaaaaatcaacaaaacagtacaaaaacaagcataaacagtacatgtggatatttttaacatgtagatcttgattttagaaaaatttagcaacttgaaccacctgaaacggatctacggttatttagttatgattttccaaagttttaatctattagaaaattggaaaaaaagaaaaaagaaggagatgatgacgtcagcatgacgtcaccccacggcagccggctagggtttgcgagctcgccggagatagagaccttggccggggatttggagggcatgtacacgtagaggacgacgaggcgaacccaacggtactcaccacaacgacaaacgacgaacgatgatggccggcgacgaagaggacggcggcggcggctcggcttgacggcgacggcggagctccggtggtcggcggcgaagggggacgggcggccgaggttcccctcaccacggcgcacctaacggcggcgacggcaagcggcggcgacggcggaggcggcgcggcggcgcggctggagaaggccgacggcggcggcgagctaaagcaacgcggcggcggcgctacggtgcacgggagaggacgagagaggggcaaacgaaagagggcgacgatgtggtcctatatatagcattggattgaagagatcgaactccaaacgagaggaatcgactcgggaaaaatccaaactcggttttagggataaactcgaaaacgagtttgattcgaacaagatactcaacggattgctccgtttcttgaggggaaagatagaggagaacgagaggaacaaaacccctcaaaaacccggaagaatcggggtcggattggagcggaatcggaggcggaaaagggcggctcgggctcggcttcggccggctggaggtaggagatggatccgacatgtgggccccacatgtcggtctcccgagaggagggcacgggcggctcggctgggccggcttgggccgcgcgggagagagagagtgttgggccgaattcggcccaacggcttaaaggaggggatttttgaactttttaaaataaaaacaatttgtgaaatgttgtttcaattattaaaaatacttcccttgctcaaataattcccagaaaaatctagaaaatagaggagcaagcatagtatttaataaaattttatctagctcatttttatgttgaaaattttcctagaaaattagggtttagtttgtaggcttttaaaaataatttctaaaaattccaattaaacatcagtttatatatttaggatttttagggcgtgacatcacgcccggaatttctatccaaaattccaaacgcttacatgtgtgttaaaccctcgtccaggaatcaaccgaggcacacaataacaaattgataatagagtacaaatgaacaactatagaatattcgcaaataataaaatattacagaggtagatagttcctctcaaagaatatccttctacgcagcgaaaaaaaataaatctataacaaactacggaacagctatggcgactccactccacaggcaacttaaccagaacaagcctaatcctccagatcatcaccttcactgagatactcctcttctgatgattgaatattgcaagaatgagcatatgacatactcaacaagtcacacagcaaatatgcaagtgcacaggataacaaaggatgacataatatagctcatttgcagaaacagcattaaataaatatttaagagaatagtaaaacagttgtataattaatcaatattaaataacaccatacaacacacccgtgttgcataggcccaacctcatatgaacaaccaaccccggttgtacaaatctaacctccataccaggaacgtaccattccaaccaggagtcaaattgattatcacaattaccattaatgaataacatgggactaatcacgaaaaacattgctcaactcacccataaccgcgggtacggctattcgaatagattaaactctgatcagaggtgtaccactgtacccacaagacacaatcccacaacatgttaccatgcgccttagtaccaccacgatacctcggaaaggaactgtgacaataccccttgcataacacaactcaccacagtgcaccgtacctggatcataatcaccccctctacaaccagaggcatggactccccagcgacccccacggacttctcgccgcttctcagtctggcaccccataatgaatcatgctatacaaaaggtaaagccgttgcccacgctggcttgtggttggcacggtaaaagtttcacaacagtagctcgcgaaccggtccttaattgtcatgagcacaaccatcaataccatatgctcacaacccaccttaaccaggttttaattatcaattaattaacctcacacgatcaaccatcgtgagctaccattaatgtaaccataattaaaataataatgtaacatagtttataattaatccctttagttagctattgtttctaagcacggctaagcaaacttacatatagcatttagctgaaccaatccaacatataaggttcatgctaatcaaattataacccataggaaaataagatcatcttcggccgttaattaattgggaaggttcaccacccgatgacattcgaaaacaatgcatagttgaaataaaataatagctttaaacgggttcaacatgctcaaagagttgtttgggatctgtgtgacttgccttgggcttccgcaaacgcttcggagccttccttaacggaaacgctctcctccggaacgtcggaaactaaagcaattaaacaaaaatcaacaaaacagtacaaaaacaagcataaacagtacatgtggatatttttaacatgtagaccttgattttagaaaaatttagcaacttgaaccacctgaaacggatctacggttatttagttatgattttccgaagatttaatctattaaaagaaattggaaaaaaggagatgatgacgtcagcatgatgtcatcaatggcggccggctcgagttggtgacctcgccggagctagagtggtcggccgggattttggagggcatctacacgtagagaacgacgagacgaacgcaacggtactcaccaatgcgtccaacgacgaccgatggtggccggcgacgagaggaggcggcgcggcggctcggtcgacggcggcgacgggtctccggcgaccggcgacagcggggagagggcggccgaggttcctcacctccgtgcgcacctaacggcggcgaaaggaagcggcggcgacggcgaaatcgaaggcgcggcgcggctggagatcaccggtggcgacggcgagacaaggcggcgtcggcggcgagctacggggcacgggagaggacgggaaaaggggcaaacgaaagaggggaactagggggtcctatttatagccttggattgaagagatcggactccaaacgagaggaatcgaaaccggaaaatcttcgggttagtttggagagataaaatcaaaacgagtttgattcggacaagatactcaacgatttgctccgatttttgcgggtaaagatagaggaggatatggggattaaaacccctctaatatccggactcggggtggccggattggggcggatttgagggcgcaaggtggcggctcgggctcggcatgcacggctcggccggctgctagaggaaggggaaggatccgacatgtggggcccacatgtcggtctcccgagaggagggggcggtggcgacgggttgggccggttttgggccggctcggccgcgggagaggggaaggatgttgggccaaaaacggcccaatggctttagggaggggtttcagaactttttaattaaatataatttgtgaaatgttgtttcatttattaaaaatacttcccttgctcaaataattcccagaaaattctagaaaatagaggaacaagcaaagtatttaataaaattttatctagctcaattttacgttgaaaattttcctagacaattagggtttagcttgtaggcttttaattttaatttctaaaaatgatttaaacaatgtatttttaatttaggcgatttttagggcgtgacacaatccaagctgccatgatgtggtcgcagccaatctttgacccatccatagcggcccagcaagtaccaccagttggagccgggcaatcgaatgccgtggcccaactccacgcacaagccgcgatttcgcccttcgccacaccgtacccgcagcaaggtgcggtaaacagggcgggaggcgaaaaggggctgccgctgagtgggggaatcaagactcgtccaatcccaccccagttgaagttcccacctgtcccgcgttattcgggcgaaactgacccgaaggagttcctctccatctacgagtcaacgatcgaagcgactcatggtgatgaaaataccaaggcgaaggtaatacatctcgctctagacggtatcgcccgttcttggtatttcaatttaccagccaatagcatttactcatgggagcaattgcgcgatgtttttgtccttaactttcgaggcacctatgaggagccgaagacgcaacaacaccttcttggcattcgccaaaggccgggggagtcgataagggagtacatgcgtcgcttctcgcaagcctggtgccaagttcaagacataaccgaggcgtcggttataaacgccacttcggccggtctgcttgagggcgaactaacaagaaaaatcgccaacaaggagccgcagacgctcgagcaccacttcgcatcattgacgggttcgcaaggggcgaggaggattctaagcgacgacaagctatacaagttgagtacgataaagcctccgtcgccgctgctcaagctcaagcacaagttcaaattgccgaaccacctcccctctctgttcgccagtctcagccggcgatccagggacagccgccaaggcaaagccaagcccccatgacttggagaaagttcagaacagatcgggcgggcaaggctgtgatggctgtcgaagaagtgcaagccctccgcaaggagttcgacgcccagcaagcaagcaaccatcagcagccagcccgcagaaggtccgaaaagacctctactgcgcctttcacggacgctcttcgcacaccacggaacaatgccgaaacattaggcaacgtggcaacgcgcaagacccaaggccgcagcaaggaacaactgtcgaaacaccccgtgaagcagttcaggagcaaatacccccagccgaacaacgccaatatacacaacaaaggataatccaagtgattacaagagctgacccgccaagccagttgtcgaaacggcagaggaagatgcagatccgtacggtccacatcatcacttcggcaggtgagggggcgccacagtacgtgaaccagctgatccctttcgggccagaagacgccgaaggagtcctgttcccgcatcaagatccactagtaatctcagctgagatagccggttttgaagtccgacgaatcctggtcgatggagggagttcggctgacgtgatcttcgccgaagcatatgctaagatgggcttgccaacccaagctcttgcaccggcaccaacgtcgctccgggggttcggcggagaggcagtgcaagttcttggccaagcacttttgctgatagctttcggctcgggagaaaacaggcgcgaagagcaaataccgttcgacgtcgtcgacatcccatacaactacaacgctatcttcggccgtgcaaccctgaacaagttcgaagccatttcccaccacaattatctcaagctcaagatgcctggcccaacaggagtgatagtagtcaaggggcttcagccttcggccgcttcaaaacgcgatctagccataatcaacagagcagtgcacaatgttgaggccgaaccgcatgagcggcccaagcacacgccgaagcccacccctcacggcaagataacaatagtgcagattgatgatgccgaccccacaaagctcgtatcactggggggcgacatgggcgaagaagaagttgagagcatcctagaggtactcaaaaagaacatcgatatcttcgcctggagccctgatgaggtggggggcgtcccggcggatctcatcatgcatcacttagcagtcaagccgaatattaagccaagaaagcaaaagttgcgcaagatgtctgtcgatcgccaagaagcggcgaagaccgaagtacaaaaattactccgagcgggggttattcaagagattgaccatccggagtggttggctaatccagtgctggtgcggaagtcaaatggcaaatggcgcatgtgtgtcgatttcacagacctgaacaaggcatgtccgaaagacgatttccccttgccgcgaatcgaccagctcgtggatgcgagctcatgagtttcctggatgcatattccagttaccaccagatccacatgaacccgctcgacatccccaaaacatccttcatcactccattcggcacattttgtcaccttaggatgcctttcggcttaaggaacgcaggagcaaccttcgccaggctggtgtacaaggtccttggcaagcagttggggcgaaacgtggaagcttacgtcgacgacatcgtcgtaaaaagccgcaaggctttcgaccatgtgttcgacctgcaagagacgttcgacagcttgcgcgcggcaggcataaagctgaatccggagaagtgcgtattcggcgtccgcgcaggcaagttgttgggtttccttgtttccgaaaggggcatcgaggcgaatcccgagaaaatcgatgccatccagcaaatgaagcctccgtcaagcgtacatgaagtacaaaagcttacaggccgaattgcagcactcagttgattcctctcaaaggcggccgaaagaggtttgcccttcttcaagaccctccggggcgcgggaaagtttaattggacaccagagtgccaagcagcattcgacgagctaaagcaatacctacaaagcccaccagctctgatatgcaatggttcgccacatctagcgaacaccaaaagaaaactatgaaaatttaagagaagggcggagagcctcacacctctgggtggtcccgggcatcgcctccaccccctccggccgccatgccttcatcttcacaaaggtccgccgcctctgctttcgccagctgcgccaaaaggcgcgccttagcggcggagcggccgtccttctgccaaaattgttttcgccatgcacgaagcgcgggcgaaatgtcttgcgcactgatttcccaatcccccttcgcgtacttggggaactcggcgatgtgctcgcagccgaactgctgcaggaggcccatggtaaaggccgctcatacgcgtgcacagcaatcgccgtatgcggtggcgcagtcggaaaccgaaccaccagcctgttgggtccattcggagaagtcgaaggctgatgcatcttcggaggggacaccccgcactttcgtgcccatgtcagtaagggtgaggcgaagcgtttggcacgctgtccgcgaggactcggtggttttccccatctcccgtgaaaaccgccgcgactcctctgcagcacttgcttcagccttgtgaacctcctgccgaagagcctccatcttcggctcggtgaggttgtaataatctatgagcacggcggtgtgggctttctccttctccagttcggccttcaagcgatcaacttcggccctggcttctttccctttctccagttccgattggagccgcttgttttcagccttcgcctccttaagggagttggcaagggcctccgtctccaaatttttgtggcccagttcgtcatcctttggcccgaagacggcttttgaacccatcaagtcgagctcgcacggttcgctccgttgagcagtgagccgcgaggatctgggcgcagaatacgagcggcgaagagaacaagtgtcaaatgtaaaaacaagatagaggaagaataaagataaaaaaagggggggaaaaaaacgtacccgaacagccaggcgagcacccctcgtcgaactcattcagttcggtgaacatgcttggggcactggcgggcagtacaagattgcttaccccctccacaaaaggaaggaggtccgctcgcgtctcgaagtcgccaggggcgaagcggggtaccgagagcgaatattccaaagcggacgtctcagcgaccgctctctttcccttcgcctccatcagcggcgatgcaaccggctgatgcggaggattgccgaatactttcgccgcggccgtcacaatcctttacgcagaagccgaagccccagcggcggtactaccatccactccagcggcgccaattggcggaatgggggcggccgaaagatccaggctgcgaccagtgggcgaagtcggagtcccgtcggaggactcgttgtcgctaaaaacgcgagcgacatcgacgagtcctttcgttttagccacctttttgataggacctcccttcgccgccgcgcccgaagagaacgcaactagggccttcgccccttccaaatccttccgacgaaggggggagctgttcgactccaccccggtttcgttgttaccaggacttggggtaggagtgtaccctggggtgtcggcgcggtttcgaccgcctcacccgcggccttatcagccacagcctccacctcctcctcttcctctccttcctcctcgccatcacattcttcggcatcatcctcgtcgtcggcgtcggagtcagacgaagcaggaacccttcgcttcttgggggcaagcttcacttgtccacgcatccgctttcgcgaaggccctgcctcgtcattggccttttggggattcgcccggggaggcagttcgccattgtaaacccggttcgcccgcccagccgcttgacgcgttaacagctgactatactcgacaaccgaaacatcgccgatcatcctgcgggcttcggcttcggcctgatcgagggtcaacactgtaaaagtaaagcgtgaagctacgtcaaaagtcaaataaggcgaaataacaaagcacagcagtatatagcaaaagaacagtcttactgttcaccccctcaggaagtatcaggttcggcaaaccgtcgacttctttgccttgttcaaccgcgacttgccatgactgggagaggggaaaaatgcgaagcatacaaaattcctccaccaagtcacgacagctaaggcgggagcaaaccttccgcagtagaacgaaccgcgcctccatggcgccgttcacagcaatattgggtctccgattcggcgtaatcgccctacgccgacaccggagggatttcgctgattcagaaccagccttgaaggggatggtgtggtagaaccacctcgccatccaatggcggtcccacttcgacatagcagcgttcaccagccagagatcggaccgctcggggcgaacattgaagttcacgctcccgaacacggtttttttcgttccagccggggtaatcaccgtcttcgagttcacggtggcgaaaaatatggcgccaaagagctcggcgttgggctcaaacccaaaagtccggcacgcccagtcgaagatagcgatccgaacaagcgccgatgggctcagctgcggaagttccacctggaagaggcgaaggatctccggcaacaacacgttgtagggaaaccgtagccctgcctcaaaaaatacggcgaacaccaccgtccggttgtcgacaggtttcgtgtcacgtcccaaaatgactctaaaatacatcctctaaattatgcctagaataattaaaatccatgtgaaagcctccaaaaattaaaatgtgcaaagttaaaagtcaaataaggcttggaggatttttgtatatttcctaaaagcctaaaatgtgtaaataaattttagtggaattttcagagcacaaataataattatgaagaaataaacaaagttaaaataattttataaaaagaaaaaccctaaaaagtcccccttccctcccttgggccggcccggcccatctctccatctccctccccctctctctcctctccccgtggcccattcggcctccctccccgcgcgcgcgccgctgacgggcgggcccgcccgccaccctcgctgacgcgtggggcccacccgtcatccccgacctcccaccgctcccgccgcctcccccgagccctagcgccgccgccgccgcgaatcccgccgcctcccgccgtccccgcgtgcaataaagtggggggaatcactccccgtgatcccctctccctttcc

SEQ ID NO: 66562 - DNA, 5160 bp, Oryza sativa
tagtctacatttaatactttaaatgtgtgtttgtatacatcaaaaaaattgccaaaacaactaaacacggtctatgaggtggtaataattatttcctagtttttaatttgagagtggttgtgccttatattttagaatagagggagtataagattacttatataaacatagtagagccttgtagcctagtggttacaacagtctcagtagcaccttaggtcctggagtaacggctttgtgctttcaatggtaggcgacgtacccgtcgacaacgagatgtctgcggtgacttcgtcaatctccagatggatttgctggccagtcttcaaatatgctcataggggtagggtgagtgtgcatgcgttgttgttagatgataaaacatgattaatattttatgtgtgacttgtctttttaattttttttataattttttcaaataagacggacggttaaacgttggacacggaaaccagggtttgtctttttttggacggagagagtatgtataagataccaagccggtcggcagtcggcaggaaaagtagtagcggaatttgaggaaattaaaagtgcagggaccctttgggaagagaaagagagaaagagagaggagagtagcaagagagcgacgaggcagtgtgttgtgtgtgcatagaggatctctgccctctctactgctgctgggctcttttgttggcgagcgaggtgaggtgagctgatgggatagtgtgaggtcaaatcagcaaaagtactgaaaaagccttcccttctttataattgcatgccctgcactgccgctgccttgccctgctccccgcaacaactctcctctgtacattcactcccgtcttgcttgccctattcaatgcgcctcatctcatatgagcgctagtactagctcgtttcactttcaccacaggaaaggtatctatcgcatctgtaaacgtacaaggctacaggaattgaaggagttgtctgtcgatagagtatatagtatagcaagcagctcgacagcgaattggagagctagcttgtagaaaaaaaagaaaacaatgtaaagacactgcatatatgacttgagataacttatcccatgtatgcaaatcttcatgaacatattacatagaaatttgctctggtccaacaaaaaatatctcgagatgtcaacaactcacagtaccaaatcgttttcgatcgttgaatctaactatgcctatcctgtaaagctagattcaacgattgaaattgatttttgctagaccggagcaaaattctattacgtatgtcgtacaattttttactggttatttggttccgtagagaaaatgtctatttggggattaccatcgccctggtcatgaaagctctacgtggtcatgcatgctgcacacacatcgatcgaccatgatcgatcacacaactttccttcggctaatttggctttcgatccgtttcttctccatggtccatccgctaggcgactcccagaggctcagagtccgcgtgggtttctttcttctgtgcgcgctgatcgctcgctcgtcgtcttctctttccgatcgatctcccctctctcgcgcgctctccccaacctctggcgccgcgcggccctgtgcttgcatgcatgctgctcctgctcctgctcctgtgctacagagcgctgccggccgcgccgcggcggccgcctctctcgggaataacgacggctacatcggccgcagcaacggcagctagctgctagctagcgcatgcagtgaacccacccttcctaccgtgggcctttcaccacgggtaactcgtgttcgcgcgatcgatcgcggctctggtcaggttgtaaacaggagttacggcgtgcagcttactgttcatgatcacatgtttgtcttaggctaatttatctgctagaacaccattacgacgctttccactgatagtacaaaacaatttgaaccgtgatcttatttgatcgaaaggtttagatctatttgaattaccacatcagttagcagtatataatagaaatgtcaagggacatcattatcaaaataaaaaggtgtgaagggatataattatcatttatagcagtgactaaactataaagctttgctacggtttctttttttttctgaaaggctaattatgtagttgaatatttttttataattattcaaggtataaatgaaagaatatttttacaaaataaattaacttttataaagttgataaatatattaaaataatactatatgaaattcatatatagaatatttttacaaacatcccatcgtttagaaactcgcgaacatgtatatccatccaattatccgttaatccaaattcctgctggaaggttgtggctggaattataccatgcctggaagttagaatgcgactcaaattcaaaatttaactaatgagataattgaaagaaaatgtttttctttatttttaatctttgctaaaatagcctagatatgcttgggagggcatacctgatatatatagagtgttttttttcagaaaaaaaaaagaaaaaccaaaccgtgaatcacccgtcgcgccaacttaatttcactgcagtaataaactagttctagcagtactaataatatactagagtacgcatattgttttgccttttaccatttctctgaatactcggctagcttcctcaaaggatcaaacgttctccttcgacgggttgtaaaattttggtggcctatttatatatggagaacagttatgttgcactgttctgtcgtaacactactacagtgccaaacacgtcgatgtctgtcgtgtcctcatacaagcaactcgttcaccatggcccacaaccagtccaagagcgatgctacgatgcttttttactagcgatgcttcgatgctttttaatgataatattatactgcatatagtaatctattaatataatgactatgagttactttatcttttatatttttccggttaaatcaatctataattatccattttgttggcatcgctcatattccatcgaaaaagctaaaaaaaaggaaaagtttagttactgctaaatgacgattacactcctatcgtaacttttttttataacaatccccctccatgcttctactatcgttaactgggacagtatatattataaatggatatgaatcattcgatcaaataagatcaacagtttagatttctttctacttccagtaaaataagcatagtgagctcgtccaaataacactggtagagaaatcatctttggtcggtcgacccaaatccacaatagttccaattccaataaaaaccgggactaaaaatgatttttagtcccggttgttgttaccaaccagggctaaaaatcatctccaaccgggactaaagttcatctttagtcccggttgattccatgtcaggccgtgtcagggccctaagatctttagtcccagttagtaacaaccgggactaaaaacctatttttagttccggttgatgttactaaccgggaataaaaatcaaaacacactatataatccctagtaccgatccttttcccgtccacacaacaaactcctccctctatctcttttttcctctctaacttcttatctctttccttatctctaactcctagccttctctttccttttttttccttccattcacagcgaagaagacggcgggccggccggcggcgcggggggccgcgcggcggcggccggccagcacggaggggaggaggcagtggccggccggcttttttttttttacaatttatgatttatcctgtgatatatttgatttgtgtgtgatgtgaatctgtgatatattttttagaacttgtgatgtaatttttttaagagtttgtgatgtatttggagatatctatttgaggatttggagatgttctgtgatatgtgatgatttggatttgggatttcttggcatgattaggggatggtgtgaaatcaatattcaatgctaaaaacaatgaaaaagaggaaaaaaagaaaaaatatatttattcccggttggtgactaaaatgctccatctttaatcccggttggtaacaccaaccgggactaaagattgatctttagtcccggttatttgaaccaggattaaagatagcgatctttagtcccggattcgtagtcccgattaaaaaaccgggactacaggaggttacgaactgggacttaaaaagcacttcttcaccagtgtaagagtataagacaggaggaagctttcataaatgatagtggcggcttgtaccatcctcgttagtaattttaaataaaaaatataggattagcaagatatatcgagggacgaagaagcaaattaatatgttgacatgtaggttgtgttttttttatgggtacaaggtcacttaagtatcgatatggaaggagattacatcaatgccaaaaaggctatgtacaagacaaaaacagggatcttaattaggtgatatcttccaatatggttagttgctcccgcttttgacccaagctatgtccgcttttgatccttgtatctcttgcaccggccattgttccaaactactaggatgatgagggattttaatttatggacttcttggggatgcctggcgttgagaatagctgctgccaccattcctccccagtccccaccacatctcgttctccccattgctgtatacacaggttgtattttttttagttttgttattgtttattattgattggtatgttgatgtcatctctcttcttcactcatatgaattttatgtagacgcctcatcatctaattaaaacatccactactagagaattgatgtttactcggatggcaaaaatcatattagtcccgattcaaaagcctaggggtactttttgatctttagttccagttttttttcgaggggacaggcagagagttcctgtaattcattatagaagaagagagttgatcccgtttataaggaaaaccggaccaaaaaccttataacatcatgattaattaaaggaaaaccgacaaaaaccctaacattaattgacgtactgatcctaggagcaacagtccaacaaggaaaaaactcctaaaacgaagtcttcaagaagggtacgccgacagaatgacgacatcgtccgatcctaacgaatctaaggttt

SEQ ID NO: 66563 - DNA, 1538 bp, Oryza sativa
aggggaaatgtgacattaaattttatgaaggataaaaaagtgatatcatgcagatctagccaatggctaggcagatgaagacaaacaggagcattgccgtttgctatacaggaggaatgagtacaaccaataaactcatcccaaagccacctgtttcaaccttgtgagccaatgagctgatcagctgaacatgggaaaatgagggaagagaagtacctgattcagcaagaagaccccatgggaacagaaaaaaggtataggccaggaagacacgaatgaatgggctgcttgtgtgcaatgaaacaatctcactgaaggagaaacaattgtgtcggtttgtgtccaataaatcaagatgaagattggcgaatccagctgttgtgctgcaacaattagtttcatagaaaaaggggaggctaaaatgcctgctaaaatgctgcatcgaaccgaagccaccagatgagttggacatgattacatgagcccttttacagatggaaaccgcgctaacaggggaaagggatttgatggatctttgtatctggaccaggaagaaacgttttcgtgggtatggatgaacaacttgttagtgccattgctaccaggtatacatgtatcctgtaggatagtagttggacgtgggtgtagccgcgtaggcgaacagattgattcgttgtgttgttgcttgtttgtgggagctcagcatgcaagaagatcctttaatagctgcccttccagttcttttcctcttatattccttgagaagtggaagaggctgttggtttcgcagagggagagaccgtaggatggtggaaccatggaagatgaaccaaatgacagtttttgatcgagccatcaaggaggaggcgaatcgatgaggggaagaggactcgacaacgcacgatggaggaaggaggaagaggaaaggttcactggctggcccaggtgggaaaattgggctgggctcagcgagcaagagaaaaggtctcgaggaagcaatctgcaccgttaagaacgtgaatccaacggatggaattaagtggtgatgtggcttaacctcaaagcaggaaattgctaataactatactaagtggggatgatttgtataggtatataggattcggtctaatggtttatctttactccacaccctctaatctcaaatcttggcttcgcccctgcgcagcagcctcgtcgttgttgacatttccgccttgctgcccacaagtgcgcccgaggttgacctaaagacgcactgtctgaagaagttagcaccccctctgtcccttgtgtgcctctagtgctcccgatctgggacgccatggccccaatccagccattgtgccgctgccagcccttagattgggcttcggaaagcaccatttcgacgcccatagccaggtgaaggacttcatcgccatcatcctcctcaaactcactctctcaccaccctgaaatggttcagcttgtcttcgagtggtacatgtttctcgtgcttgcgcccaacgacgaggtgatgaggtgatagggagagagaa

SEQ ID NO: 66564 - DNA, 6971 bp, Oryza sativa
gtttccgtccttctccgaccgccctctctcgccccggccctatttaaaccctccccgcgcctccctcgcccgtttccgccccttgccgcaccgtctctccgccggaatcgagctcgcgacgtcgctctctctctccgccgtcgccgccgagctccggtccgccgccgtcgtcgccccggacagcctcccacctcggcgccgcctcctccggcatcgccgcaccgccgtcgaccccgtccaccccctcgccgggtccgccgaccgccggaacgccgtcgaccccgtcgacccgagccgcgccgccgccttcctccgctccggctgcctagggtgagccgtcgctccgccgtgcctatggccgctctctctcggcctcccgtgcctatttcccccttcccttcccctctctcggccgccgctccgccgtgcctatggccgtcgccggagaccataggggcgcgggcaccgcctcccgccggccgcgccgagtggccgccttcgtgcgcaccgagtggccgccgcgtggggcccggccgtcagccgcccgcgccctcgggtgcggctgacgcgtggggcccacggcgccggccggtgcgagcccgggtgcgcccggtccaccgtggaccgtgaggctgccgtgtgggccccactcccgtggacccggtacgcgcgccccctcccctcggctgacgcaataaaccctttttaaattaaattttaaatgaagaaattcgcaaatattcatttaaagagcatataaacttcaaatggccataacttggccatttgaactcagaattggaccgttcaagtctctaatttttccttaagaagtcaagaacccaattttgtgctttgttcctacttgttatatggagtttattagagtaaaagccttttcttttccgttggtcgtgtagacgctgcagcttcggaagatccgctcttcgtggaggttgaagccgacgtttgggaaagcgagcaagacaagtcacatcatccttgaacatattgaatcccagtttataaaattattttgatttaaattattgcattatcgctttgtttaaattcccacgttatcactgttttatctagccatgcctatttacctttgttatgaccttattaatgttattgttattattaccttgttcaccctagaataaacaaaaccccaactagtggacaactctagactttgggaatattctcatcacctggacactatggaatggatggattattgtggaattggattcacacctccccctctattcaaaaccctcaaaatggttttaggctgggctcggggtgtatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcgtctcggtagtcgaaatgtcatggcacaggaccggtgtcctgctgctaggggctcagtcctgcctacctgtcccgggggttccggccgtaggtggggttgggtcggtactcttgtctatggctaggatgggttggaaactatgtcacgtcttccgtccgtataccatggtggtatgtggcatgtggttacacgtgaggaagatgtgtcttgtgggtaaagatgtacacctctgatcagagtataacctattcgaatagctgcgccctcggttatgggcaagccgagcaatgtacccaagttagtgtttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggaccgtgtttacaaaatagctttgagcaactaagtgtcttttaatgctgtttactgcaaaccctaaccccctaatttatggctcccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccatcaagcgcctgtggtcgtcgccctagtcttccgctgtttttcgtttgtcttcttgtgtgctgggtcttcgccgcccatgtaattaattaattaggcttccgcttgttaaactctgaattgtatcaacttttggtgtaccttgcctcctgggacaaggaataatgcacgcacttaaggaacgcccgttgggttatttccggtcgtgacatttcggcaccacggttttccctggggcgaaagcctgcccctcaaccaacgctccggagctgaccagcttcgccagctcgacgtcatccacaagagagacccccagaaaggcggtgctgtcatcatcgactcggctaggatctggccctttcgccgaagtagggtttggctaacgtggggccatggcgaacggtgcgtttgcggtggcgaaaagagagattcggcgaaacgcctgaagggtcgaaagatgctgtgaaaggaagagacggagaaagagagcgcgcacggtaaaatggcaagtgtggcggtgaaaaggaaagagcaacgggaatatatagcccgcccaagcgaccgtttgcctacccaccagtaataaagcgccacgtgtcgcaagggtaggcgaaacggtaaattcccgtcgaccgagcggcacagtaaaaagcccaagaaaggaaggcccaatactgttccgttcggcccaggaaaaaagaatatatataaccatcaatcgcacgaggcgaagcgcggcaaaataatactagccgcacaagtaacaaacttcatttgcaggaataatgtaggtttcgccaggagcatcggtcgaaagggggcgccacataccataccacatattttacacggtctcggccgaagctccaatctcacccgtgcccgtgaggggcttgttggcggatggcatgaggctcttcgaccagatctgccgaaacctgtggcgaaggctatggagcaagaacggcgtgaggcgaagagtcgcgcgagggccttgtcaggccaggggcatctcgggcgaagggtgcaaggcgaagactatctgccgaaggaagacgacttcgccatggcaagttcgccctcgcaagggccaaggaagcctttccggcccatcaagcctaagggccggcgatcgctagacggcccatcaggggcccatgagaccctataacattatgtacccctgtaaatgtccctttcataagggtaatcatgtaaattcccctgtacaacctagatcctagtactaagagcctgcaacagggctataaatagccccctagggccatgtaacgggggatcccaagtgaaattaaaaatttagtacacttcattttcccaaccactgttgagtaaccacgtccttcgacgtatgcagttgtcgtttcgacaacaggaatggacggctaggaatcaaggagaaaatgtaccttggttcattatatataatatatatatatatatatatatatatatgataatttgttcaatgaaaaaagggttactttattttgttataagttacttctataatatatgtaaattacttttaggctttactgaatttacttttatatgtctaagaagtaacttcgtgaaatctaaaagtaatttagacatatcataaaagtaatttgtgatttttcatcaaaatataatcatgtgagattttgttgtaaagatttaattattacgaacacaatggtataatcggattgtaaatcggatgagtaatttaagagaaaattttatttgaagcatagatgataggaatatttcccctacttgctcaatggattaatagcaaccaaaactcctaaagttctagcacgtgggtgtctctggttaagactaattggagaggcctctccaattagatttaccgatattatatgcatatgcatatattacaattctttcggactttatatttattgtttctgtcgtatactgcttcatctcagaagaagaaggaccggcttgaagaagagactttccgtcgtaatagaattctcccgcgggatcaataagctgcacattgatgaatctcatcagttgttcttgaacagccattatgaaatctgcgtgagtgaggtcttccctcatgtaaatcacctatcatttgaaaaaataagatataaatatatgaaatcaataagctaatggagacataattaatgtatgaataattttacatacttccaggtccctgtcagtgctgatttggtgtgctaggcagtggatatacttgcagacgtagttgccgcataagttagtcctctgatcctgctttgcacactaaaaaagaaatgacaagagatttaatatacatttctattttagaacaaattaatgattcaatataatattggagcatttactcactagaaaagtaaacctttcatggaagaacccattcccccaagaaacaacaccacgtggcttgttaattaaacatatgacgtgtacgtgtacaagtaaacgttaaaaattatggtcaactaactttgcgcacacaacttcagtaacccctcgtgcgaacatgataacgatatgtaaacaatttaatcagttgctagacgacctttcaaattaatacgtgcttttataaatcgttttgtatctaacttacaaaaaatgaggtataatgccatgaagtatttggctaatgcttctataccgacggtaccgtcacaactcactaccagaacccaaaatttagttttgctccacagtaacaagggtgctatgatttaaactctaaaatatgtaggcgttaaatctataaatttatgataaatttagtgttaaatatatgtagttttctaatagtttgatcaaaatgcctatagattagggaaatttaacgacaacacaatgatataatttttttgagaggaatatacaatgatataattgatcaaagattggataaaaaatttaggaaaaagaacaattgaagagctagcattttagctatttaatgttgtatatttgttttcattgctgtgtggttatcttgttatcctacacccaaacatatatatgagttatactattaggtgaagtaatattacaagcaaagtggattaaagaccaaaccatgcgggcaaaacggcaattaaaaagcaaatgtttaatagtttcctcttcgtgatagaaagaacaagtctttcttcctctctaattcatttttatcatgatatcttttgttaaaactgctaccggacataagtaccataaaaagatattaatctttaggggcctttgatcttctaaattcttttccttcttttgggaacactggtctgcaccaatgcaagatcaagagatttaaccgagaatctcccatcattggttagattccatttaaactcgttggtcgtgagataatataatattagcgatacatgagagaagatgattcaatgctactaacttagagcgagtaaggttcctatgccaagaaaaaattagacgactagtatgaaaaaattttgtaatagacacaagggtattgttctcctatacatgcagtctatttagggagtttttatggtccatcaactagtacctccaggtactggtaccgctaggtaccaaatgaaatccaaccgttaaatcaagaggggtatgattgggaaaaaaaaagaaaggaagtagtggtggggaacattgttagtgatatgccctagaggcaatcatagtgatgattgtgtcacatactatgtttacatatttatccgacattgtttagataactccttattggttaatgaatatgtgattctttcatgagactctttatgttgtttgttactatttctaaaggattcctgatcaaatatcatatgtggaacaaatatgtttatatgatcagcacatctattaattgatgatcatgtctcatggatcatggtatagagataccaaattaataatgtgacacatgttggtgaacatggtgttgggttagaccccaccaataagccactaccaaaagcaatatgtgttgtgtcatcattgatctcattgagtattggtgttgaatccttagacctaagattatcatgattctcaacatgtgtagtagcttacttagggactgctaaaagctactccgtaattgggtagttctaaaagtagttttcgggtatgctatgaaacatgtagtgggatatgaataatcaagatgggatttgtcgcgtcccaaaacaactctaaaatacatcctcgaaattgtgccgagaataattaaaattcgtgtgaaagcctccaacaattaaaatgtgcaaatttaaaagtcaaataaggcttggaggatttttgtatatttcctaaaagcctaaaatgcgtaaataaattttagtggaattttcagagcacaaataataattgagaagaaataaacaaagttaaaaaggtttataaaaagaaaaaccctaaaagaagtccttttccccccccctttccctcttgggccggctcggcccaattccctccctctctctcctctcccccgcggcccatcggctctctccccgcgcgcgcgccgctgacaggcgggcccgcccgccaccctcgctgacgggtggggcccacccgtcatcccctacctcgcgccgcagccgccgccccgtccgtgccctagcgccgccgccgccgcggattccgccgcatcccgccgtccccgcgcgccataaagagggggaaatcactccccgtgattccctccctctttt

SEQ ID NO: 66565 - DNA, 1245 bp, Oryza sativa
cttgttactgatgatttagtgtgtcttgttagattgttactattgccttctagcataatggatatagcaagtatgtttagctggatagtaatgttgtgctctattaaaaacaaaggaacaatggagcggattgcccttaagtttctggtttctccgcgtggtcgaggctctgattggcgactttggtgggcaaagcccttctctaatatccttattgtttaagtttccaaagtgtatacaacctctatgtactaggtggcatctaataattagggaatctgacacaaactaggaatatcaaatagaatacataaatcaagctaggactagaattatgaacatatctaacgcaccatgccaatgtttcctgcacctatggtatttgatcccataacatccgtaacagataacctgtatgcagatggaatgttgcaaatcatgagtcctttactgacagcaattgtctaggagaaaattctagttagtgttgcagaaaattaggtgcctctttgccagcaaattcgacctttgatgccatcattgttggtgtagcagaaataatgtcatcaatgttcaatgcagtctcagttcaatgtaggtcaaatcaaaactttacaagacagatgccaacttcagttcgaaatttgagtaaagcttgttacagttctttttataaagttaatagttaatggctacggggaaaacagaagttgaccgctgttatttttgccatgcaggagttcatcaaagagtctttaattgatcgattatccttagggataattggttctaattcggtctacattgcaagccataattccttcagaagtacctgtcacaatggcagcacaatgaaaagtggaaaacaaaagcatcctgccggcaaaacgacttgtggctgaagaacaatgatgaagcaaggggtgacgcagaagtatttattttacttttggccgggttataacttataagtcccttgatcgctgcaggttataagctctgggaatcttcattgccctaggtctagtgttgaatctatgtagttttttatgtagttttttcaaccaaaatcaatcttgaagtttgctgtttatgtgtaattacgatttgtaccaacaagattagaatgtttagctatatgccttggattgattaactaggctcagtttttctctcattcaagtgttcaatgaatgaaatgtatggttctctagcttttcttttgtttcaaaatccttagttttt

SEQ ID NO: 66566 - DNA, 661 bp, Oryza sativa
gcaccgtttcctccatgtcaggcttcaccgtcttgaggttaaccttcgtaccattaaccttgggaagggtttgagcctgtgcctttacttgcatggctgcaggaggtgggttaggctttgcgacaatgccacagacactcaaattctccggcaattcgccggtaacagcagcattcttggagcttctagctgatgctgcaggagatgagcctggacctgggaagaatgctgaggcggcaagagaccctgccatgattgaacttcccctcacggcccaaaattcgtttagaaatcaatcacacgccaaaagcgctaacctgaataaacaatcaattgtatcagacactttacaacaatgtagctctttggaaaacttaaaagaggagaaaaaaaattgaggcatgaactagtggatccacccactaaaaagtttgcctcctcatgggggaaaaaaggcctcatgtatcataaacaagtacacccgcgaatttcacaaacgattcgaaaccacatttgaatcaatgcaggcaaaaatgaaccatatgccccccgatgaacaaaatggcattgagaattgggaggacccaatatcggaactcgcaggggcggatccaacttgggacatgggggaggttaaactgttactacttgtattaaggct

SEQ ID NO: 66567 - DNA, 5436 bp, Oryza sativa
ccgtaggtgggattgggtcggtactcttgtctatggctaggatgggttggaaactatgtcacagcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgtttcaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgtttaataacattgtatagttccaggattgtgtttacaaaatagctttgagcaactaaatgtctttaaatgctgtttactgcaaccctaaccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctctgtgtgtgctgggcctttgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaggatttgcctctcctatggagagatatctttgggcccctcgatgttgtagattatggaagtgcatggccatgacaaaggtgattgaggagtcaatcacaagttatataatctatcaacaggttcgagtgaatgttagaggatggcacatatctagccttgagcttaatcgatatcgtgaggcaaaggggtttatacaagtatacacaagaagttcagccgatatggtctttacgtatgcccggtgggtcaatacgttcttctaggagccgctgttgatgtgtggaccgaaatggagttttcgggttacagcctagtatatatgaacctacagggtcgcacgcttaatggggcggaataaggggattggatagagatccaatatgagcttaattcagatagggatccgaataggagttctacgggccttggaggcccgagtgatggatcttatatattcgtgaggggtgtgaccggtggagctattgcatcacgtgagaaaccctagccgtcacttccctccccgagcaaaaccatagccgcgcgcaggtgctaacacatcagcgcgtggcgttccgtccctgtacgtgtggataccggtagaggcacagctggtttgcggtgctgatcggtgtgggagtacggcgaggagaatgcacgaggaggagaaggtcgagccggtgcgatcaactacttcctctatatcgacgcgcgctacttcgcgagagttccttcgacttctcagcatcttcttccgctgcgcagcgcgtcgagtggtaacgatctatgatctaataaatgcatggttcctggtttacgcgatagaaaattttgattaatgctatcgtagcctgcgcgtatcccaacagtggtatcagagccgccttgtatagtttatgatctagatcattgcatataattgatatgcgaatgtagtagatgagatctattatgttgtatatgagttcttaggtgatcggaacatgagatgaaccgatagctgcatgggttgatgagatcaatcggtatgtgtgttggtgacttcactggaatgtctagtactcaccaaggccgagcgcgattgtgttcatcggatagtccgatgtccactggaaccgcacgccaatgagaaaatcgagccaatgagattgactcggtttcggcataatttgattacgccgttaaggttttcacatggcgaatcgtagatgagatctatgtaccccgtgttcgttgccccttagatttcgcttggggtttttatgtctatcttactatattgctgttatatatttgatatgacatggtaggatagattcccttagaaaaattaagtgtaatttatgctcttccaataattgcacctcttacggttgtgatcataagtgatgggtttgccatagcaaagtgtcactttttatcatgataaaataggatagatgtcggacatctatatgcggagattattggtttacttgacaaggttatcaaaacagttttggaccttggggtataggttgagttggacatggagatgtcaccccaacagcacaagagtcacatatgatgtgattagtaaggtgtttcttacctattttgatagttttctagctgtgatgccaaagctcactagacactaataaaatgaggatcttgactcactatgttactagagggaattttgtttcacaatacatagtgggagtatcttttgttaaattgtttaatgaaaggttaaatgtaaacatggtgctgcttttgcatacacatatttctattgtagatcatggcagctcctgcaccatccaattttaacttgcggtctattcttgagaaagagaagttgactggaacaaactttcatgtattggtatcgcaacctgagaattgttctcaggcaagagcacaaagagtttgtgcttgcacagccttttccagctgacttgcccaacaatgctcctgctactcaacatagagagcatgaaaggcgatgcaatcaataccttgatataagctgtctcatgcttgctactatgtcccctgagcttcaaaggcaatatgaggcattggatgctcatacgataatcatgggactacgtaacatgtttgaggaccaagcaagagctgagaggtttaatacctcaaagtccttgtttgcatgcaggcttgcagaaggtaatccaatgagcccacatgtgatcaaaatgattggttacaccgagagtctagataagcttggctttccccttagccgagagttggctactgatttgattctccagtcgctccctcccagctttgagccattcataatgtatttcagcatgaacaatctgaataggaccttcgcagaattgcatgggatgataaagacttgtcacgtcctgataaattcatcccgaaataaaaatcattttctaaaaggaataatagaattaattaaaatttgaaaagaaattggcaaacactaaaatacgtacaagaaaatttcgaatgtggcccggagaatttttgttaaattctccttggtctaaaatgagccctcaaattttacttgaattttcagagcaccggaaatatttattaagcaacaacaactatgatcaaagtttattaaaaagaaaacttaaaaataatcctccttcctcctttgggccaagcccagcccaaagtctccctctcctccctctctttccctcctctcccgggcctctcctcctcctcccggcccacctcttccctccccctcccggcccagctccctcccctcccctctctctcccaggcctgcctctccctcctctcctcatgggccgcctctgggcccaagctgagcggcgccctcccgcccatgccgcgcacgtgcgtgtgctgaccgcgtggggcccacgcgccggtcgtcttcctcctcccgcacagcctcttctctctcccgtgcaaacctagcgccgttcctcctccaaattcgccccaatcaagccggctctttccaaattaattggggggttttaatccccattgattcctcttcaattccccccaatttcccccttgaatcgtgcccccaatcgccgggaacggacgcgccaaccccggccaccttccatggccgccgggcgcctattccgccgccgttccccgcctctcccgtggccggctccctctcctcccctataaaatggaatccccatcctccgttctatcgttttagccccctcccgcatattcccgtggcctcaccaccccttcccgccgtcgcccttctctttcccccgcgccggccacctccagccgcctctccctcctcgccctagcgccgtccggccgtgccgtcgccttccccggcgtcgcagccgcgtcctcttccccggcgctgcctccgatccgtggggaaatcaccggagacgcgcccccgccggcgtccagtggcgtcgccgccactacaccgtctccggccggctgctgttcatcgccggtacgccgaccgacgtcgccgtctcctccgtcgacgtcgcagcatcgtcctctcctccggctgctcctcggtttcgccggaacaccgccgccgccgcgccggcccctcctttctcctcgtcgacgtcgccttcggtagccccttccgccgtgcccgtgcgccggccgacgttgccatctccacctccggcatcacagcggcaaggtcgtcctcggcctcgcctcccctccacccgaacaccgccggtgtccgtcgtcgtcttcaccgttcatcctcgccggctcgtcgtctcgcggcgccgcctccgtcgtcggcatcgcagcggcgtgttccacgccgtcctcgtctccgtgcagccgctgccggctgccatcgtcgtctcctcgccagccccggtcatcgtcgtcgtcatcctctcgtcgttcccagtttcgctcgtcgtggcgttggtccctccgtcaagccgatcgcgttcgccgcccgtggttcatcaagcgagccgctgcagccccgtcgtcttcgtcctcacctccgcgtcgccaagcgttgcgccggccgcgtctcgccttcgtccaaggatcgccgccgaagtcgctccctcgccgttcgcctccgtcgtctccgagccatctccgccgcgcccgttcaccgtcgtcgttcccacgcctcgtcgcgtggtggtaaggatccgtcctctcgctgccccgtcctagtcctttcggtgtcgcccgtgcccgttgtgcggttgtcgaccccggtacccgtgtactggtgtcggtagtcgttcgcttgtgcgtgtagtgtccgtgttagtgtgtgtcgcgaccgggagaattgccttttcccgaacgctagtgtattaatccccgtcccaggaaaagccggggtacaccacacaaacatgatataagagacacatctttatatatcgataatatttacattataacaaaggcgcttcaggcctggcgatcaaaaataaacagcagcggactagcgggcctacggctccatcttcacaggcgctcaactggggtataagccaagactccacctaagacttcttctccaaaacttctcttactgaggggggagaaagatagagcaagaatgagtacaaccacag

SEQ ID NO: 66568 - DNA, 3400 bp, Oryza sativa
gttaatgaatctaaacagactttaaacagacttttcagtatataatgaatctaaacatatatatatatgtctaagattcattaacatctaaatgaatgtaggcaaaaatcttatattgtaaaacggaggaagtagcaacatttctcaagctccaaccaaacgatgaaatttccatggagcagtttacttgctgaatagttgaatcaattagacgattgaaacaacctcttccacacttcaaaacctgtcttatctccacaggggttaaaaacaaaaaagaaaaaaaaaagcgaacaaagaatcaagaaataatagatgtagcaggtacagtaggcaagcaccaacacctcccctccaacctcacactatggaaactactaattttttacagaatacaactcacacttcaagatcagcttcagggcaacagaggcaagggaagtttgatattctccctaccacagattttcgtcggtttgtttgtttacgcgttctcagctgctgcatgcgatcgctttggtcgccactctgtgtgtgccttcacaatgtcagccttcacaagatggtcgcactggatggcagaagcctgcttgtcggcgccaatgctggtgcattcccctgacacggtggtaagtgattgcagcacgctgtctcggccacactccttcctgtaatccagggtcatgcttgcaagctcatgcttctccagtactgaaattggagcactctgggggaaaaaattagaaagaactcagaaacatgtttgaaagccttctgactgaccagatgtaagactaatgacaatatcaacaatacagatggtcagatcagaatctctagaaaataattgcaagtactacataaaatggttccctaacaactactccctccgtttcataatgtaagtcattttagcatttctcacattcatattgatgccaatgaatctagacacatatatctatttagattcattagcataaatataaatatgggaaatgctaaaatgacttacattgtgaaacaaaggaagtaccatataaaaggataaagccaaattatttttctctaaacaatgaatataagggacaagaatacccactcaaggatccaccccaatatatttaacattgttcacatgctgattgacatcgaggtcaccccatctaggctgttgcagtaaacaagagtccatcaaatatcatttaaaataaatgaggggtgagatcaattattactgtttttcttagataaatgatagcagttgaggcataatgataattcagtatgtaaccatgtctagctgacttacagtgagcccctttcttatgaattgctctgtagcatcatcaccaactttatttcctgtctaggctaacttttcactctgctcctctgttatagctgaacggtcattgaaatatgggcctatttcagctctaacttcatctggcatttttgaaagtcttctagttttcttgtgcatcatcacccaaacactgcaacaaatggattggaaaaggagcacaattagtgattatcaatgatgtgaccaagcagaaataccaagattggatgtcctcacaaaaaaaatgatacagatgattcttgcaatagaatacagttgaagcccaaaccttgtagctctcaagattgttcggccagagttgtagtcacgaacatgccagtctcgacgcatgccatttttgccagcagcagcgacccatgtgtcaacttgaaccatatctcccctaaaaccatagcaggttggtacaatacatctgtcattctttttgatccacagaaagacatcggcaattgtatctgaactaaaaaaacagtttgaaattgcacttccatttttctaactcaaaaccccaaaaaagaagttttcaaccacttgttgacacagttgacaagaggatttaaacataacgtgtgaatagtagtactagcaccacttatttgatgaatgatgaccacctataaatttaaactgacagatgctgttcaacaaaagttcactgttctagatcggtccttagcttctcccatgatatggcacagcattaattgcttttgttcttttctacacgatggaatcatttactgcagcccaataaagggaaactttctgaattgtgatcccttgaggtgtggtaccctgtacagacgtcttttaattcaagatccaagaaagcacaggacagaacatttaatgaggcagctctgggcaatgaatatgaagtaaccagtcaattatctattgggactaaacctctccctctatccactaatcagttatgttttcgggagagcattgtcctgctaagtgatgttatacttttcaagacaaaacagggcaacagagttaagtgctgccaaactcaggccttggggtatcgtaactttcatgctgcttgtaataaagctagacaataactttaatatgaactacccgagtggtaaatttttgtttataaatgcaaataaatcacttgctaatttatttttaaaacggagcttatcgctggaaaacgtaagtacatgcccgttctggcattcccactcagcataattcaagatccaaggaagcacagagaagacatcatttaatgaggcagctttgggcaatgaataaggcgtaacaaatgaagttgctcttggatctaaattactactccactaataattgacgtctaaaggagatattactgttcttttaactgatgttgtgtcttttgaggacaacatagagcaaggagagctacagacttacagtgctgtaccaaaaaggccttggggcatcataacttttatgttgcatgtactaaagctagattatgtctttaatgaggattacccaagatgcaaatcctgtttctaaatgcaaagaaataacttgatagtttgtgttataatcagggctcgacaattggaaacaaagtgcatgctcctcccacttaagtaggaatatattcatttcttcctaattggaaaatttagtttgccacaaaatctatccttgatccaacaaaactggagctgatattactacacatttcttagtcaaccaaggaggaataacagaacctccaaaacatgaggcctatcacgggaaatcaaagaaaaacatggccttctatagcagtataaaaacttcaacccatattcttgcaaacctgcagcagcgaaatttacgagcaagtaaaagattcacttgattttcatcaaccaaccagtgtatggagaaatcagaccagagatccacacaacaatatgataaaccatgttaaagtaaatattgagctaaatactactgttgcttgtgtaagaatcttctttaaacaaataaaaacaaatatgcaaaggacacacagctgtaaagtagtacataaaa

SEQ ID NO: 66569 - DNA, 7801 bp, Oryza sativa
ttaaatgctgctttctgcaaaacttaacccctatattattaccccttgtacccccttgcattaatcatgcatccccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgtcttttatatcatgtttgtgtggtgtaccccggcttttcctgggacggggattaatacactagcgttcgggaaaatgaaattttcccggtcgcgacaaggaggaaggagggttatttttaggttttttctttttaataaactttgataattgtttttgtcgcttaataattatttccggtgctctgaaaattcaagtaaaatttgagggctccttttaggccaaggagaatttaacaaaaattctccgggccacattcgaatttttcttgtacgtatttttagtgtttgccaatttcttttcgaattttaattaattctattattccttttagagaatgatttttaattcgggatgaatttatcaggacgtgacaaatccaccccccttacaagaatctcgtccccgagatttgaggaggctagcaagaagataggttgggcggtcctctcttcttgtctgacttctcccgctccgtcttttataacaaacttgcctagcacaacttctccactctggactgctcggctcgatctcctgttgcagatggaatcttctcttcacctgacttgtccctggttgaacctttagctgacttcgactgggttgcggcacttgaagatggggcctcagttctagaacttcgcatagttcatatctttggagtcaacctcatacaagttacccacttcatgtcatgcgtcgagatcagctcgtcattactaggataccatgtttgtcatcataagaatatcatgcttgtcatttgcttctaacttgctaccaactgcctcatattaactttcctggtctccgggtgctagctacttctgttatttgacgccagggtcgataactttgcctttaaattatgtttctcaacagaaccaacttatcccacttgacatgctttgacgtcttcccaaatggctttactgctggacttcttattgtttgatcgttatcctgccaaatctgaagcttcgttgttaggtgtgattttaatctgacctctatagactatcttcgaacatatcacttggttcataactgggaatagctcccacgaacagacaactcggattcaccttcttttcattcggtttacttcccactattctcttcatgttgtcatcatttagcattcaaagtattcctttacacattcaaccctgacgtattcttttcagatttctcttatcaatcacctttcgacctacttctttgcctgatagtaaacacctttgctggtatcttctatcaataacctcttgaactttgtcaaccaagtaatcttcactccgagagttgtggatgcttctggtgacgatgtggtcctttggtctgctgcctttcagtgaaaccttgaagtgttttgccaaaagctgtactgactgtctttgtctttgatccgaaaaagacacatctgaaactcttagtccaaacaaatgtctctttggttaaacgcttgattttcttttccatcatcaggttggttattaactcgaggttagaacatagtccctctgaaatgagaccctaggtttccttcgacagtaaacaattatacacctaatcccatatcggcatcttctgaaagagtcctcatagaacttgtttttattacacatttctcccatattacatgaatacgaggcactgccttaaacaaaaagggaaggtgcttaacatcggtacattgcatcctcaacatgaatcttccataaacataacaaactcattgtttataatcatgaatatatttatttattacatgattgctgcaaactcccgattacagtgataagtagcgaactgaaaatcacaaacatggatacatagctggcattgttctagtgactgcatccttgattggttctgtgatgatgtgataggactgcatattgctatcattcacaggagaagcttccttctgattgctggttgaagcgaataacggtcttctgcttggtatcgccctcctgaggttgattgcccttcgctcggcctggagtaggtcggggagagacacaacttcttccatcgacgacaattctttgctgaggctgtcggtgcagagaatggttggtgctgaaggtattattgctatgattcattgcagagtcaggtgcagcaggaggagcattggtgctggggatgatatcgtcgatgttgctgttggagctgactagctgatgagacaatcgtagggttgttcgttggatttctgcggtcttggtcaacaacacactgagttggcaatccttgggtacatggtttgtaccttcgcacagaaaacatgtgaccttgcgggtgggacactcccctggtggatggtcttcttcacaatgagtgcagagtgtgagacacatgctagcaacgtgtccaatttccccgcaacgggtgcatgcctttgattccatctcttcctcgccgagatgtcggggagactcatcttcatcatccgaggagacttgatctgacccttcactatcagatactctgccaccatgacttaggaggtgctgggtcaactgtcgtgcacctcggaaagtatttcctctttgacgtctaggaatagttatccctgctggaggccattcggtgctggtaatagtcatcttacgtacttcttcttcagttcgcatcggtgcttttctcttctgattcttactcttcttgcctttggcttgcttagtatgtgaccccacgtggtacgagaggctaggaggaaagcatttcccgggattcaatggattctctccgttgagctctctactttgcacactaggctgcaagcttgacttggtgtgaggaggctggtttagcgatgtctgccctgctaaaccaagggaaggggcttctttgacatatacccatggacaattcagggcatagtgtccttgctctctacaatcatgacaaaaggggacctgctcttctggcattggaagctcattgacctgggtggcaaaggctcgatcaaacacatactgattttggtcttgacttccaaccaatggtagctgtgaactaagcagcatgcttggaatggaccaagggtgtgccctggttaactctcttgaggccagtggtggattgagttggaaacttaagttacttgaggcatacccgctgacattctttcctttttctctgttatacatctgttacagggattgaggtgagagaggaaacaagccaggaaagaatagaccagaactagggaccagaccttaaaagaactaactcttcttattgatgtattgtttgtttcacttattctgcaagttgattaagcaaacaacctaacatggttacatcacaacccaccgatgcaaaccacgcgctacacacacaagcaaggaacacacgactaacaacactaccctacagggtggcttaggttctgcgacgggttctccaagatcttcactgcttcctccacttcgctagcagaccctgcggtcttccggagcttcggcagacaattgacgacatcttcttctccgcaaagctgaccatctagtactagttgaaatttgaagaaggaagaaagagtaaatattttgcaaatagcacaggggaaaggaggaaaaagggactttcggaaatagtttcatttataaaatatgtccttaggttttatccacttggcttatcctacagtcgagatggctctgataccagcttgtcgcgaccgggagaattgccttttcccgaacgctagtgtattaatccccgtcccaggaaaagccggggtacaccacacaaacatgatataaaagacacatctttattatatcgataatatttacattattacaaaggcgcttcaggcctggcgatcaaaaataaacagcagcggactagcgggcctacggctccatcttcacaggcgctcaactggggtataagccaagactccacctaagacttcttctccaaaacttctcttactgaggggggagaaagatagagcaagaatgagtacaaccacagtactcagcaagccacatcggagatgcataattaatgcaagcggggggtacaaggggataataatataggggttaagttttgcagaaaacagcatttaaaagccacttagttgaccaaagccatttataaagacgatcctagcgctacacaatattattaatcaaggccgtgaaccttcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaaccccacctacggccggaacccccgggacaggtaggcaggactgagccgctagcagcaggacaccggccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccggaaaacaggttttaggggttttgaaagaggaagagaggtgtatgtccaattccaccataatccaacaattccatagtgtccaggtgatatgagtattcccaaggtctagagttataaaaccacctaatgttgcctaattaatccgcgaagcatctacctaaattcatactagtggaaccatgaatagagtacccactagttggggttttgcttaatctagggtgaacaaggtaataatatcaataacaataatattaaggttataacaaaggtaaataggcatggctaaataaaacagtgatcacgcgggaatttaaataaagcgataatgcaataatttaaatcaaaataattttatgaactgggattcaacatgttcaaggatgatgtgacttgccttgcttagagagaacggccttccgaaccttcggcgacgaccgcgaaccacgcttcgggaacctccagaacgacgaagctacgcgaggcacacaagcaaagctacaagcctataaagaagcaataacaatacataaaaaggaagcacacggttctttaggttataacaaacattaagagacttgaacgggtcgattcggagttcgtatgaccaagatatgatcatccgaagtttaatgctgttatatggggatttgcggattattataattaagctttgcaactataaaacatgtgcaagcgctagcctggaaaagacaggaaggctgcgccgttgacatgcggaccccacatgtcaacctaaaggaccgcggtagaccgggtacacagagacggtccacgggtcgacggaagcggaccccgtgtgtcaaccgaggcgagtggccgacaaacggactccactagacaccacacggcctgcacacgtggaaaccacgcggctaccgagcgggcacactaacgcggacactacacggtcaccacccgcacgcgtgaacgactaccgacaccggtacacggctaccggggccgacaaccgcacaacgagcacgggcgacaccgaaaggacgaggacggggcagcgagggagagggatccttaccaccacgcgacgaggcgtggggacgacaacgacgaacgggcgcggcggagacagacgggcgcaacggagacgaacagcgaggggacggcttcggcggcgatccttggacgaaggcgagacgcggccggcacgaggcttgacgacgcggagccgaggacgaagacgaggacggggctgcagcggctcgcttgacgaacgcggacgacggacgagaacggctcgacggagggacgaacgccacgacgaccgggaacgacgagaggacgacgacgacgacgacgaccgggaccggcgaggaggcgacgaggacagccggcagcggctgcacggggacgaggacggcgtggaacacgccgcagcgatgatgatgacggaggcggcgccgcgagacgatgagccgggcgaccgacgggacgtcgatcggcgaggacgaacggtgacgaggaaacgatgatggcaggcagcagcggctgagcggaggaggggacggcgtggaacgcgctgctgcgatgttggagaaggtggtggtgcaacggggcgactagccgacgaggaggaatgggtggttggcgcggcgccggcgttccggcgaacttcgggcgaggaggaggtgatgccggggatgagggcggcgtcgcggaagccgagggaggtggtggcgacgtcggccggcgcacgggaaacgcgacagtggcggccggaggtggaacagtggcggcaacgccactgttttgccggcgaggacgcgtctccggtgcttcccccgcgaaacggagggctgaccgagggagaggaggtggctgcgaggccgagggagaagacggcgcggccggacggcgctccggtgaggagggagaggcggctggaggcggccggcgcggaggaaagagaagggcgacggcgggaacgcgcctccggcggtcaccgcgcgaaacggagggcaggccggggtggaggaggtggcggcgacgctggaggaggcgacggcgcggccggccggcgcacggtcgaggcggcacaggcggctggaggcggccggcggcgtgggagagagaggagggcggcggggagagggctagggaccacggggaggctcgggatggggttaaaacgatagaacggagtgaggggatcccattttatagggtgggggcgggagccgggctcgggagagggcggaacggcggcgggaataacggccgacggccatggaaagcggccggacttggcgcgtccgttcctggggattgaaggaacgaatcaagggggaatttgggggcaattgaagaggattcaatggggattaaaaccccccaattaattttggaattggccaattgaatcaagcggatttggaggagggagcgagctatggttcgcacgggagagagagaagccgggcgggaggaagaccacgcgcctggcgcgtgggccccacgcggtcgggcgcgcggtcagcgcgcggcaacggcgcgcacgcgcgcgcacgtgcgcggcacgggcgggagggcgcccctcgggttgggccgagcggccggaccaggaggagaggagggggaggtggcctggcccgggcacgccgggagggggggg

SEQ ID NO: 66570 - DNA, 28604 bp, Oryza sativa
tgctgaaacaattggaatgtatgacatgttgcttaacagaaacaaagtattaaatgtgtccacttaccaatctgcattgtcttcagtggcaagaattgatgcagaacgagccatggacttggtacaatctgtgatgaacatggaatctactgatttctcaacgtgcagttctatcgtgaagaacttattgcaatcaggaaaaataggccaggtaatgtcagtctttgaggaaacagttttggggaagaagttcaatgctaccttgctaaattcctttctacaagcatattattgtgtaaaaaattggagaaaggcagatgcagttctttgcatgatgttaaagatgcagaatagcctttctatttctagttaccgctttcttgtccgtagaatgtgcgagcaaagtcggatttccagcgcattaagacttaaagagctgatccaagatagggacaagtcaacagaactaattttatacaatattctgattttttatcttttccggagaagacacattttacaggttcataatttgttgaaggatatgaaaagcaatggtttttctccagacaccaccacttatgacttccttgtcaatgggtttcacaagtctggagatgtcgatcattcaattaatatgcttgattcttgcattgctcagggattaacgccaagcaatcgtagtctcagagtagtattgagtcaccattgcaagttaggaaaccttgagaaatcactagaattatttcatctgatagaaagcaacggatggaagcatggtttagtcattgagacaaccctcatttcaagtcttctctcatcagggaggttttctgaagcaacatcttgtctgaacagcatgaacaaaagagagctgattgggtttgacatacattttgatgtcctaatcaaggaactctgcttactgggagatgtggaaatgtctgttagtctgctaaatacaatgctaaagaaaggcaaaattccgagtgaagttagctacgactctgttgtgtacaggctatgtatgttgaaagaattcgatcaggcacttgattttcttgctgagatgcaatttgcgaacctaaaaccaagcgacatgtcctgcgatgtgcttatacagggcctttgtgccatgggaagaacctgtgatgctatgaatattttggaaatgttgaccaccattggctcttcaccatcctatcacatgtatagagttgtttttgagaactgttgcaggagtaacaatctacagaaggctgcaacacttctgcatgacatgcagcaagctgggttctcacccaactttgagatgcactggtctgttattagcaatttaagtagtaatgctaagaggactacaggatatgagaagcctattttgtccaaccttatttcttcaactcaagtgaactccccgtgaagtttatatataatagggcaaaaggccattcggagcgaagatataagcaatgctgatgtctggttttccagaaagtggtgaactgacgattgtcaagttgaactgtagacaccagtggaactgacagaactccatgagatcaagctaatgcaattgaatgttccattcacatctgaaggtcatgataaggtaatactactgtctattctaaaagtggaaacaataatcccaaactttggctgtaatcttattatttttctaaacaggatgtactttcgattatcgtttatgttggcggagataatgctgatattatatcactccatcaaatcagaggtgattcacccctgcgacttttctcttcaattagagcctgtgtaatcgattgctttcttgaataacccaatatagagtgtgcactcaacttctcattaattttttttcaatcagtgttactactagttgtgcttgcgcagacacttcttctagccatgaaagacacactggagctcacttgagttgccatgaaagatgcactgactccacaccagtacgatttattatgaaaaaagtaatccacaccagtacgatttattatgaaaaaagtaagcggaatacaagaagcttaaaatgcttcaatgttacaaaactagagacacactggcgcattgccttatccttttaatatataggatttttatgagcatctatgggcgccaatattcaagattatcacacccacaatcagactcttggcttctataaacatacatccaaattataaagcaccaaattgtgcaatttgcatcataaaattgatgcctattcattgttgggcacgacagcacccacacctccatccatgttatatgaagcgtcaatatcagagttctgaagttctgatttctccaagcccttatctggtccaagattctctagctgaaccccatgccttttcaatgcatctttgatcttataaatctgaaatagcaacaaaatatagcttgaaagagcttaaaggtaatctgttcacaaatgggcttagattaacggaactcacagttgaaattgtacagctgaagctacagatacggccttctgcacctctgtaaaagcggaacattggcaatacatgaacattgagcctgcggcacatctccttttgttcattggagttgaccataagaaactgcagttccggatgcatgccagccaattgacataccttttgggacattatgcaaaaaggtgttataactattcaaagtatgaaatgctcttttttcgttaatttatgtttgagaaaattgtttaataccatgcatgtgttcttttaccttagggtgtagggccttgcaagctccacaactaggggaaaagaagtgcaccacggtgagcttatcgctggccaacaggagctgcttgtcaaaatcgtcttgtgattcaatgtttttcatgttgcaggatttcatgttcttttcccaccatttagtcttcattggggtgtgaacagcctaacaccacgacaatatatctcattgacatctcttttgtgcttgagcatgtattgtcaatgcatatttgagttttgttatttgtgtatttcgaatgagaccaacaatttcatcttctgtgcagatttttcaaatacttttggctgtagagaatgttttaccaataaaattctataattttaagcattactaaacatggttagcgaagcaaccaaatctcttaatattaaatgcacttgataaaacagcgatcctgtttcaagaatagttgggctttgatttagtcattattaggccagaaaatggtacctggagcaaatacagtgtgtcagtgattagtgtcatagaacacaaaaaaagggttaccttggattgtgaatggattgtggtgccccttgatatttgaacaacaaaacaaacaaaacatattttattcttgagattaaatagcacttgcaaatttgcaatctaagttaaaatttagcctgttgattttgaaacctgcatattcctttctatttaacataacaaggaaacattctgatttacttgtagaaaaattcagatgaccttctacggaaatgcactgaatatatttttacaaagaaagcatcttagtttgcgcttgtcatagcaagaatggtttttctggaggtaaatgtttttgtttgtaatttaattagttccaaacaagtaatgttcaagattttatactttcatagcgtgtaagactttcttttacttcctccgtttcacaatgtaagtcattctagcatttcccacattcatgttgatgttaatgaatatagatagatatatatgtctaaattcattaacaataatatgaatgtgggaaatgctaaaatgacttacattgtgaaacggaggaagtagtgtataaggacaaagtttcatatgcatgctcaattgcaatgtggtaagaaattacattggtggaattttctgttgcagctttggtgatctgccaaccagttgaagcatccttttctcggagcaagaggtgctttctgttgatccgattgtggttccgagctggcaccatgaaggaaccatcagaactattattcttggatccacgctgagatgaacgagaaatagcccaacagttcgtcagagcagaagccattgccatccttcaactgaaaaagaaaggatgaaacagatcagcactcctgaaatgatgtggaaaatgggaaattttaaaagcttacatgccacaacgtatccacacgaacttttcaagagctggaaatgtttgtgatggtgatatgggaatggtccatggtatggtatttatagctgaagaaaagtttgcttcagaagcaaaggatacctcatcctccctaaaacagagcccctttttgcttttttttttcagttcatgttcgtgagttcatcactctaagaagcaaagatgattatccaaaagaagatatggacagccacatttgttgttacctgccatcatatctggactagctaggtgctttatatactcagtttccagttctccagcaaaagctttggtgtttcttacactctgctgatttctatctaaggcggcacggcttgtgccatggactggatgaagccgatgtgtatctggataaaaagattgtcaacatgactcatctcttctgtagtgtgtcaatcctaatgcattgtgtgttctgtgagtcatgggcaaacttttgatctaaatcttaatctactttactcggatgtgtatccatgacatgactggatttcttgtaggagtgcctgatattgcagctatgtggtgtattcttcttggttgtgtatatctaactgttgatataaaggtcagatttttatccattatctaaaaaaatgtggtgtattttacttgtcctctacttgctcttcatctgcttgtgtgtatgctctatccagctattggaatttcagaatctgtcacgcgatgaacacggcctgtttggaacatcctgctcgatctgcgtgcgaatctatctgtgatttttacgttttagtacatactaatactgagttactgactgatcaaactaacatattaaaggggcagtaacacctgctagtcagaaaataatactctatccgttttatattatataaattgttttgactttttccttagtcaacttttttaagtttaaccaagtttatattaaaaatctagaacatcaaattagttttattaaaatgaacatttaatatattttaataatatgttgttttatgttagcaatgttgctatatttttctacaaacttgatcaaactttaaaaaattgactaggacaaaagtcaaaacgatttatagtataaaatggagggagtatttacagtatgctgcttgataattactgtattccttttgaagtaagaagatttaggtaggtgctaaaattgataatagaagaacttgcattgaacccataattccaaaatggatgaactaaaatacttttcttcaataaaaaaggagatccgctggacgaaatcaagaaaacaaagaatctaatgtgaaaattacaccataacatggtcaaaagaaaaaaaaaaggaaattacacccatagctacttaccagcatacttcttttttcccacagaaaccagggactggtttcccatcaaccttccaaggttgacattgctacagaggttacaactaggacatcttttgagtttttccacccttccacttatagatcttccacttacaccataagttgactacccctcgatggctcgaagggtataatgtatatatagtcgtgcaatgtcggtggcatctttgtgtccgacaccatgacctgatatttttcgcagagcttgtcgcttgttgggtcgacgtgtcgtttaagtcatggtatttgtcacgcaatgcatatccttttatgctcttgctctttttcggctacaaggattgtgttttcaaattaattaatgcaaaaatctagatataatataaatttttttgcaagggaaattactaaataaacaaaacagcacattcttaaaatcgttttatcccactgaagagttgtatttagatttagaagacttctttcttgagtgaatagtggagatactcctttgctatagattataattataggggaataattacaatagagggcatggggagtagagaaaacaaaaaaaaactgttaaactgtaaatggattctcgattgaggaatttaagatacacaattgtctccaatataaaaataaaccataatatttgggctgtgaatttattgtataatagaaaaatcaaggacacatggctaatggttgctaagaaaaaaaattgcaaatattctataggttctcagagagaaaagggaaatcattcaatttgattgactccaattacaaagaatttcttttagtgtcttagaaacatatttaatgatatgcagtttggaaaaaaaatagaaaataaataccgggcactatgtttaattaaaaggtaaaaaaaaatttactacttggggtgtggatttacattgtattcctgcacataagaagtttcaaattcaacagatacaattttaatattgaactctgtccactatacagcaatgcagtacaccgtgcatctgataaaaacagtgatatgctttattattcatggttctctttcttctggggagaactggaagatccaccttttggcaaaacaattcacagctttcataatacaattggctgctacagagcaatggcaactgagcgtaagtgcgtaacactttaacaaaattaataaagctcaaaacaattaatattctgcaggcatattgcacaggccagtattggcttcagaatacacagaaattgtaacaaagcaaactgcttttgttcttacccaagaataaccattatattctgtaaaataatatgggtaatttggccatttctttgcaaaggcaaacatgcaatttcgcacagttcagatccttgtccacaatttgttttgatcattgcaatcccttcttgcagaaccatcaacttatgcttatttacaaccatacaggcatcgatgacagcatcactcttttgtcgctcatgtagcttttttcacttgcacaaacacagtgccatactcccattgtacaaatgatgtgcaaactgatgtttggatggattgaagatgtttcacatatttatagccacgatccacgactcattaccttgtttatataattgagttcaggaaagggttgcatctgtactaaaaaggatatcagaagataacacaatggaggatatgtataaccacaagccatggctgcacatcttgttgttacaaattgttcacctttatgtagcttatgcagcttgggctgatgtttatctgcttgactagaaatccaaacaatagcctgtgatgcaacctctctgagtctgacaagattagacccatttcattaatatatcatcataagtactagaattcactattcaggatagcttgttgttcttcgcgcacatacatctgcatcattttctttcccatttcccatatgtgatattcagtttctgatccagaacagagcttcacaactgatatcctcaaccaatgaatccttttctttcagaatgtgatctcgactgtccaaaagactgaattatatccttcacactgccatctacaaacgtttgacctgcttctttgttgacaccactgtcatccattaactttctcattttctctgacccaaaccattctccaacagatgcatagatgtttgagaggagaacataatcaccgctttcatcattccttgcctttagcagttgcctatttgcatgtttagccagttcgatctcaccatgaaccctacaagccgaaagtagtgttctccaaatgacagaattaggctcacatttcatcgtatcaatgaactcaaatgcttcttttagtagcccagcacgacccagcatgtccaccatgcaaccgtagtgcttgatattgggttcaaccctgtacttatgctgcatcaagttgaagaattcacgtcccttgtcaaccatcccgccgtggctgcaggcgataaggacagcaacaaaggtgatctcatctggcctgaccttccccttcagcatcttctcaaacatatctatggattccaggacatgcccatgcagtgccagtcctcctacaattgagttccaagttgagacgtccttgtctcgcattgaccagaacacctcatgtgcacttttcatgctcccacattttgcatacatgtcaatcagtgcatttcctagaacaactggaaacccatttcttgaaaacatatctgaaagagaggaatgcagcctctggccaacgtccagatcaccagagtcagcacaagctgacagcaagctgagcattgtgacaatatctggcttttcacccatgcgctgcatctgctcaaacaactccagtgcatgcaaatgcgagccacatctcacatacccagaaatcatcacgttccaggacacgacatctcgctcgggtacctggtcgaatagctcccttgccaatgccatatctccccgcttcgcatacgcggtgatcatcacattccaggacacgaggtccttcacaggacattcgtcgaacaggtcccgtgcagcaccaatgtcccctcgccttgcacaccccgtgatcatcgccgaccaagccacggcatcctcacgagctctgccatcgaacagagcagccgcaatgcccaaattcccgcagctcgcgtgcatgccaatgagcgcgttcttgacgaacgcgtcggactcgcagccagccttcacaacgtgggcgtgcacctgaaccccggtgtcccccgcgcccatggcggtgcaagcgcggagcacgaacgggaacgtgagcttgtcgggcctcacgccgccgccgccgccgcgccgcagcatgcgcgtgtacagggagacagcgtcccggggcgcggccgtgtgggcggcgccgcggatgagggtgttgtacatgaagcggtccgggcggggtatttggtcgaacacgaggtaggcgtgcgcgatggcgccgcggaccgcgacggcggaggcgaaaaggagctcgcggagctcggagggatcggagaggaagccccggagcgccatcaccgcgtgcatctgcttgatgtgtcgcaggctccggcaccgccgccacgccggcggctgccgccgctgcgtccccgacttccgcaacatctcagagtctcagtccactagccttgtccacgtcgccaatgtttaaatccagtcccattttaaacgcatactaattgaacagttctccatattttttctcaaacattcatgtaaagttttgcaaacatggtgtcatggtacattcaaattcaaaccagattacaggtttaaaaatgtgcaaacatggtgatacggccttgtccacgtcgccaatgtttaaatccagtcccaccatttgtagcgtagaatggaacagctttcgataaaatttctcaaccatttagatgaaattcgcaccgtttcaagcagggtctaggaccaacaaatcctagaatcaaacatggtacattcaaatttcaaattcaaaccagattacataggcttatttactactccggtaagcgatacgggcggcggcggcgcggctgccggcgagcggcggcgggggtcagacggaggtggagacgcggaccttgaggccgtgagccatggagaggatggtcatcatccggtacttgacggggtggtcctcgacgaggtcgaaggtgtagaagcggaagaggatggcgagcgccatcttcatctggaggtaggcggagtccttgccgaggcagatccgcggcccggcctggaacgcggtgaacttgaacggcgacgcgttccggaacgcgccgccgtcgccgctgagccaccgctccggccggaagctcgccgcgtcggggccccagttgtactccatcctccccatggagtagggcacgtacgtcaccatcccgccggcgcgcaccttggtgccgtcggggagcacgtcgtcctccacgatccccttggggtcctgcggcaccgccgggtagaggcggagcgtctccgtcacgcacgcgtgcaggtacaccagcttccccaccgcgtcgtagctcagcagcgacgcgaactgcgccacgcgcgccgcgaacgacgcctcgccggcggcgtcggcgagcgcgacgccctcctcgcgcgcgcgctcatcctcgaacgcggccagctcgcgccggagcttgtcggcgacggccgggtgcgtcatcgccatgtacgtgaaccacgacagcgtcgtcgccgtcgtgtcacgcccggcgatcacgaagttgagcaccacgtcgcggaggctcttgtcgtccccgaagctgccgcccccctcgtcgccgccggcctccccgagctcgatgaaccgcgacagtatgtcgtgcttgatctgctcgccattacaaatcaacgatatcaagaaacaaaaccttttccgatctgatcatcaccattaccatgtcagttcagttctactgattctttgagcaagagaggaaggatcaccttctcttgcttgccgctggctcgagcctgcaagatctcagccttgcggcggcggatcacgctgtaggtgaagtcatcaaccagcttcatgctctgctcgaggagagcctctgatccgacgtgcaagaacttcttcagacgccacagaggatcgatgaaccgcagcgtgacgatgatgttggcagcgtcgaatgcctgggcaaagctgttctccgggagatcaggtgacagcgtcccgatctcaaccccaaacccgaccttgcagatcgagtccagtgtcatcctcatgaacaattcctgaattttggttagttcttgcatcagaattctgaacaatttggtttctcaagaaatgtttaggtattaggcaaggaattcagttggttacctgcatgtctacaactctgccggccttgcatgcttggctcagaatgcttgatagcttcagggagtactccctgaacaccacagtgctgaagtctctcaagttcttggaggcaaactcgaagctcgccgtcttcctttgcttcctccacatctcgccgtcggcattgaatatgccatcaccgagcagcacatccatgtaagacctgtacacttcaccctgcatattttcagacattttttgtgtcagtgttagtactgtgcaaggcacattttacagtacactgaagatcctatggttcttttaccttggggtaattggtgaagttggtcttcaggacatgctcgacgttcaccgggtcggcaatgtaggtgtaggaggtgaaaggcatgtcgacggtcaccgtcctgtccttcgacaagtactcgacaagccagtcatgcatcctgtggtagttcttcagttgctccactgtcgcgccgatgattggccatgatcttggccctttctggttcctcaggctccacttgtggaccaagatccatgagaggacaacaaggaagatagctatgagcttgtggattcctgctactgggaagaatgatgtcactggcattgcatgagcttcctccatggggctcttcatgaagggttcagtctacaagagatgctatgtagcattttggatggcatagttaggtgatatattgggcactgatgctaccaaccttgagacaatctttgtgtgaccaagaattaagattgtctcattcatatggtgtccctaacctaacacccttaggagttggatcttagctttagttttctttttgtgatctgtccacctagaaaagaatcgttactcatgtaaacacaaaatgaatgctacagtatttttttcccctgctcagccaagttcgttgttttgttcagataactgaagcgtttgcagcgactaaaggtatgccaccttctaatatcagaaccatatccatctgaattctgttaaattgtcaccaactgaaaccaggcttaccattttctgtcgatattgtctagtctttgatgacaactaaaatgaaatggggtatcctcaaaagaaatataaattgtgaacccaaagtagttggtttctacttcacctgaattctacttcatctgaataggctattttaatgaagagaaaatccaagaaatgccatttacaaacacccaaatccaagaaatgctatcgacgagtacgagttccataaaatgctattgtagaagcgattttgtcccagaaatcagttgccatctagttaaaacattctcacataaacaagcaatataaaatactattgccaagatatatccaatactttgcatctctaaagcttctagttattgacaactaatttcttttccagtcaatacaaataagccatctatcaaagatttgagaaattgcagggcacaattctacagaaaattaaagaacatcacttgaaaaggaagattttttctatagaacttatcctttgtgatgtaacaacaaatactcgaatgaattgagaaataaccaatgtcaacactgaaacaagtctgaaaccaagatcagaagagcatgaaaatagtgctcttatggattgaccttgattcttgcccacactcttattacaaccttcgagcaaaccggagcatttgctgaataaatctctcatctgttactgaagatactaggtaactaaataaacaatcaatcaagagtatcaaaacctacaggcttttgttactgtcagcatccaatgtaagtctgaagagagctctcattgcctgcctcttcactaccctgccataggtagccctcccaatcctcaccaccttgtcttccacctcgagccgattgccgcagccgttgccattgtcggcacccctcagcattgccctcagcacgctctcgttcccgccgattgcgccggcgacgctctctgcgacggcggcctcaccggggacgcgcctcccccacttcctcaccagcttgtcggagtcgaacagcgcggagtacgcgctccagaacgacgcgcgcaagaacgccttcctcctctccttcaccatggactttctcatcctctcctccagcctcaccaccagtgctcccatgtctcctcctcggccattgaccaattcgttctcaagttttgtgagttcttgcccaacaatggcgtcgctggcttcgaacctgcaccgatcgcattggcattcgaggccccacgctctcgctgcctccctgcgcttgctcgccggggtgagcacgtcgaagtaggcgaatgtgatctcctccccggctttgatgtcccttgacgcgtggacaatggcgtggtcgccgacgtgggtgcgccgggcgttggggtggcacgagtggttgatgaacgccggcaagatccacagcccgacgccgcagttgacgacgccattgctgccgagcagattggcggatggcgctgcgtcctcggtcaagcaattgacgtcgagcactttcaagatcttgtccacatcaagagatgccttcggcgccatggccgtgccgtcatcgagctcctccgtttcttgcttgaaatgtgccatgtccgggatggggagctcgtcttctggctcctcgccggtggagagagtgtagatgagagatgccgtcctcgggcacttctcggcggcgtcgagcaccttgtcgacgaggtccttccacaccaccatcttctcgccgctatcggcggcgtccggaattactccccttccgatcgccaccgccttggagatcaccaggttagctcccgcctcgatgttcttcaccgcgaacacccctcggccgccgtgcgcggaccggcgcacctccaccgccccgacgtgctccgcgaggtctgggcacttcccggagaacccggcgagcacccactccgacagatccaccgcgccgctcctcgcctgcgcgtccaggcgcttacactgctcgaccatctcccggacctcgtcggtgccgctcacggcgagcgccgcgcggaagcactcggcggcgcgcgagtaccggccgaggccgcgcaggacggcgcccttggacagcaacgccccggggtgcgccgggtcggccgccagcgcggcgtcgcagtcggcgagcgcgccgggggcgtcgccgaggcgggcgcgggcgtcggcgcggtgggcgagggtggagcagaggacgcggcggtctttgcaggcggcggcggcgtcgaacgcctcgatgatgagggagcacacggcgatgtactccgtccagttctccttgagcagcagctgcgtcgcgcggctgcgcagctgctgcagcgagtcgtcgtcgaggccgggcgtcgccatggctgggcggcggcgtgagatttggctggggagtggtggtggtgcgccgcggggcggcaatgtcggaggtgtttgtttggctcggtttcgaaagctcgcggctttacagcgtaacggtcggatctgatttctgaatagtttttcgaacgaaacaattctgaattttttaaactcactggagtgaatgcagtagcaacggctatgagctgtcacacactcacagtagtactccgtaatatagacgtcataatggtcatcttgtaaaaaacaaatactccgtatgtaggttatattggagtgaaaaaatatgtattggtcatcttgtacaatgcaatggacttgtgctcggtagagaagaagtgatgaatgaaataaatctagggcttgagaccgggtgactctctctctctcgaaccctccctcgcctgctacagtaaaattcccctttctcgacccctcttcctcctcgattccggcggccttgtcgccggtgacgggagggagaggggtcgtccccctcccctagtttagtatagtagtcgggctagtctcgttaggtcgggtttttcccgtttctcgtttctatggcgatggaagttgaagacggtggcggtggcgcgattgaggccggtgacggtggaggcgacaaggttggcgacggcggcggcgcggatccggttcgcggcggcggcggcggcgcggatccagtctgcggcgacggcggtggcgcggaccagctccgcggcaacggcggcggctcgaacgcggcccgtggtgacggcggcgcggatccagtccgcggcagcgccggcggctcggacgctgcccgtggcgacggcggcggcgcggatccagtccgcggcagcgccggcggctcggacgctgcccgtggcgacggcggcggcgcggatccagtccgcggcagcgccggcggctcggacgctgcccgtggcgacggcggtggcgcggatcctgtccgcggcggcgccggcggctcggacgctgcctgtggcgtctgcggcggcgcggatccagtccgcagcggcggcagcggctcggtcgcggcccgtggtgacggcggcgtcgccgatccagtctgtagcggcggcgatggtgcggacgtggcctgcggcgacagtggcggcgcgagggctgtctcccacgtcgttgcttccagttgtgtcgttgtttcatggtgcaggccatctctttctcagccatctccatcatctcagcaggacagaagctgatttgcagccattcaagtgcttcttccttgaaggttggctgttcttcggattcatctatcctgttgttccctaacagaagaaaccatgttgggtttgtcattcgggttgagctcggaccacctgatgagccccgtggggatcctttgctgagtccggtgacgcacacaccaaaatctacggctcagcatcaaacctcggtcttgtgccgtttccgtggaggcagccgatggggattaacggtttgtcaagcggactgcacatcttttgaggcccagggtagcagtcgtcgcggcttcgccgcagatccctgtcgacttgctcctttttctgttctgatgttaggttatttcaggaaggttgctttcgtagttcagttaactctcctttcttaaggatggctcttttgcttggatatgtaatggggtttattccctagatctgttcctgcttaataaagttgatgtgttttcaaaaaaaaaaaaataataaatctagggactattgcggtttgcttgggaatggcaaagtatgaatatataaacttattactataaaatcaaaagaaaatgatttataagattttatacaaccttacatacaagtagtagtaaccaggaagaaaaataggagaacatcaaggggtaatatttttcaatacagtcattttgccttcacagttcatgtaatattccccctggcctttgattttccatttaccattgatgagtaatggtaataaaaacgcatagaccagactgcattttgccaaatcttactttgaatttgcaggaacctaggcactcacagttcagagagtttctgagctttggctttgtgttaatgaattgctgtttttcctatatttgaaaagggagctgctatataccggtatcccgttgggatactgtcccaacgggatcgctccctgtccacctccctcagacgctagagaacgaaggtcactatgggagcagcgtagatgaggttgacgtcggcggcgcggacgcggctgccggcgacgagctctagcgtggaggacgcggccaccggcgagctccggcatggagctggtcgcatggacggcggaggatcctgcgtggtgacagagacggcgccggcgacgagctccggcgtggggcgtggacggcggaggatcctgcgtggtgatggcggtggcaccggcgacgagcttcggcgtggaggacgcagccaccggctgaggcgtggacgatggacgtggtcgccggtgtcgaggtcccggcggaggacgcggtcgccggcgacgagctctgatgtggaccatggacgggggaggatgcggctgccggcaacgaggttcgggttcagtgtggagcgtggacgggggaggacgcggccgtcggcgacgatacctcgacgcccaactcctgtatctagtaggtatcatatgatacctcgcaagtatcaccccgatacatcgtagaaatcacgcgatacctgataggtatcacatgatacctcgcgagtatcgcctgatacatgataggaatcgtctgatacctgatacgcggtagaatcacatgatacctggtaggtatcactcgataccggctaggtatcaggacctgatacctcgcaagtatcacgctctacgtggtaagaatcgcatgatacttgataggtatcatctgatatctcgcaagtaatcacctgatacgtggtaagaatcgcatgatacctgataggtatcatctgatacctcataagtatgatacgtggtaggaatcgcctgatacttgatggttatacctgatgcatgttaggatacttgcgaggtatcaggtatctataaggtattaggcgattcctatcacgtattatgtgatacttgtaaggtatcaggtgatacctgtaaggtatcatacgattcttaccacatataggtaatacttacgaggtatcaagtgatacctgtgaggtatcaagtgatacttgagtatggtcatgttaaacctaggaggtatcatgtcccccttagtatcatgttcagtctcaccaggtttcataagtgatactttggaaggatcatgtgatacctgggaggtatcatgatcctcatttgtatcatgtctgctatcatcaggtttcacagatgataccctaggaggatctgcacgaccctacttaggtatcatgtctggtaacacaatcgtatgaatttcatagatgatactttagtaggatcgtatgatacctgtgaagtatcacatgatcctacccaggtatcatgatacatgatcctcaaaagtatcattatgtgtgatacttgtgaagtatcacatgatcctatctagtatcatgtctagtacagtggtttcatgcaagtttcacagatgatacttgagtaggatcatgtgaaacctgggaggtataaggaggtaggatcaattggagtataaggagtacatcatcctcctgaggccgcggccggacgccgccaccgtcggcatggacgatgacgacacgtagcagagatagtacttacccttcctccccggcaacaccatcgccgacggcaagccgtggctggtctgctcgtacaatcacgccgttgacggcttcaccgctgtcgccgtgtcaaagaagcccagctccgacgctgcttccaggacggcatcgcttgcttgtattgctggtttaagcaggaaggaggatgtcaaccttgcggatccggccatggcgatgacgcgctgcgcgcagcggcgagagcacccgaggcggagctgctgcggatgcgccggggtagcggcgacggcgacgcgccgcctgcgcggtggaggtcagcgaggtaggaggacgcgagggacgacgtcgccgccattctctctccaagccaatcccttcgtctcgcgctgcagcggtggatgacgcggtggacgaaaggggatcctgtcccgttccgatgggatcccgttgtttagcattcctttccgtattgaggttcgaagacgtatagttgcactctccgctttcaggttccagtctcgcgccatcctatccacccgattaaaactggacggtcagatcagcaagtccttccgctctctagccttgcactcccgccctaacccttcttccccgtaaccccacgggaaggcgatccatggcggcggcggcgggttggctccggcgagcggcagcggcggcggcggcgcctcgcctgccttcaggccttcctatactacctactccccctccagcccctctcacagaggcccaatcgttcgtgctcccgggcataggcaccgccgtcgccggcggcatggacctcatggccgttcccaagaaaaaggtatcctagcttctccccccactgtatctcgtggtttttggtttgttaccttcatagtcatggtctggtcgtgggtcgatggtgcggtatggcgcaccactgcaccgtgcccggtggagtgcactctaggtgttcgtcggattgcctggagagtagaaaggtattatgacctatggaataatggaaatgtcctaacggtggaacacggggtgatagtgcacacagaagattgcctctttttttctcgatccattgcttggtaggttagtgatagatgttttgtgttttgagcccattccatttggagcataatgtcagcgaggtgtggtcttaggggtatgcttgtttaagctatctttgcaactatggcaaacaatatagttctcatgaaattcagttccacttataactgtgacgaaggctgagtttgttctttcaatgtctaaaaagctctttaattgtagagtgtatactgaaagatgttgccaagactagtggtaagttttcacttttgtttgtaattagcaatgcacaagttgtttgttatgtgagtggatttggcagatgagtcaatacatgtgtaactcatcatgatgatatgcaaatgtgataactcaggaaaaatcagaaaacaaagataaccgagcaagtagtcagaaaatgtctggttaaaggcataaatttcttgtcacatttgatatttgagcatttgcagttatctatatgtaaatagtgatagtcttgcggtgagatcaactaattctaactactagcatagttacttttgaatatgtactttttatgtgctctgttgaagcatgtgcttcatctcattgcctcagcagcttcagctgctttttgagatttgagaattattatttgtttgtttcatgttccatgattgttgcttcttgaatgttgcaggtctcaaaatacaagaagggtttgaggaatggaccgaaagcattgaagccggttccagtgattgtccgttgcaggtaaatttgaagctgaaaacaacatgcttgttagttattctgatttgttctgctatgtctaaagacaacttagtattagtaaatatcatttttttatgtaacagcatactttattctgattgtttcactactcatgtggacaattattagactgttcagattgttgtctagcgataccctcactctttacaatctagaatgcaatagtatcaatagccaccaacttaggttttagtggagcccaaagtgcagacacagaaaacatgctatgtgatctagcatcacaaatgctgtagaacaacattttggcgtgcatcagttcttcccagatgattcagaaattgcgcgactcatttcagtttccggatttgtcatcctttgctcattgttgttttttgttccatgaaatttatttacataattgttctggagtacctttccattgtgctgacgctgaaaattgttcatcttgaatggcatgttgcaaagtttatataacctggtatcctttttgtgcctgtcaggtgctgtggccgagtgaagctgccccacttctactgctgtagcggagaaaaagggaaccccggcgactcaagctcataaacctgttctgtttctccccaagttcagtctgcactcagcacatcaagcaatgtctgaacactattccaccatgaacgttttcagatctcattttgtgttcggccgctgttctgttttcaagctttttaatcagtgtacacactttaaacccagcttggatttcaaaactccccttgtcaaaaactcaaatgccactcgtgacatgaatggatgcattctgtctgagacaagaaccaaatgtgtgcatgtgccttgctagaagaaagaaataaagggcctcatcttttttttgcttatgcttatgtttatcagctaaaatttaaattttcaaccttaaatttggagttgattttggggttttttaatcaaagtttatttttcagcccttgtttttagatagctaagaacacgtatataaaacaattaaagttgtattcacgaattatttttcgtttgccaatatgccgtttcgcttattccctggtagagccgaaaagtgtaacaatccagcagcacggacaggggcgaagctagcatcaaaataagaggggtgcactaccattgagaatctagaaaatttcagcacataactgcacattctagtatttttaagtccgaaattaggaatctggcacatagtatagtttcgccactgccgcacggaaggtgggcgaggaagactggaagagagatgccagttcgagatgcggatgctctttcattttcgtgccgtttccggtgcggtgcaggtgcaaaaatgctgcaaccacacgcgcgcagtggtggtgcgggtttggtagaggacgaaaccgcggtcgttggcttggccttggctggctcgcctcagagccgccaccaactaaccaaccaaaaactcctccccaacccaaaaacgcgacgaaattcgctggcccccacgctgcgatttatgtggaccggctgcggcttgggtgcagcagcgagcagataacgaggcgaagcggagccagatttccctctcctctcctctcctcctacgcgacgcctcctagccgccaccgcttcaccaaatcaaaagctctcgctgctcctcgagagggagttggtggagagagaaagagagagagagagatggcgtcgccgtcgtcgtcgtcgtcgctgtgctcgaccttcgcctcgccgcgcgccgcctccctcggccgccgcctcgccttctcctcgcccaggtagttacccccaccgttcgcttccgagattgcgcccccttcttcgctggtatgcgccgcggccgacccgatctttgcgagctctcgcgctgtgcgtattacgtccacatggttaggggtggttgggcttcggggtacctcccggattggacaaaactccattcctgaacgccggatagcatgtcagagtcaaaccttctgggactggatgggttcatgagctttgagctgccggcgcaggttgaacgagctagtattgatgctatttctcccaactgctctcaagctgcaccagttgacttgaggagttcatcaggacggcatttcttagaacctttactgttgctatgatgctatctgttatttgtgttttgtaagtgatgtatgtattgcctagtcatgataaaacatgacaacaaaaggtacaaatgctggttaaacttaaaatcacatgttgaggacttcactgctttcttaccttggttaagtgctgtgatcttaaggttctcattctgtttttcccttgatgctttgcaggaaagcattccgagtgagggcatcatccagggttgacaagttctcgaagaatgacatcatcgtgtccccttccattctttctgcaaacttttccaagcttggcgagcaggtctgtcaagattctaccctccatcaaaccaccatgacatggaaatatatgtaggaggatcatttaggctactatatattggaataatagatcgatatcatgagacaaagaataggttgataatatattgtgtgaataatattactaggtaaaagctgtggaggtggcaggatgtgactggattcatgttgatgtcatggatggacgttttgtgccaaatatcacaatcggacctttggttgttgatgctctgcggccagtcactgatcttccgttggatgtgcatctggtacttcttgagaagccttactgaaattttaggtatttatgtgctgtaatttttctttcacccttgctaatttggcgtttgttatcttatttattgcagatgattgtggaacctgagcaacgagttccagattttatcaaggcaggtgctgatattgttagcgttcactgtgagcaatcgtcaaccatccatctacaccgaacagtcaatcaggtaaagattggcatcttttactagttaatatttgagatagctcatcctcgctctttcagtcattcatgaattagcataccactgtagaagtgtggattcctctccaaattgaatcagtattttgttttatgagttttactggtatgtgaccgggaggaaactggactttcactagtctcctgtcaaaggatcatactgtaatatacttgtatactgtactttaggactacttaccaaattgtttcttggatcctttatatactagataatggttatcgtttgctccttgagctaaccatttccttgacatggtgatcgggactgcaataagttgatttcttacctgtctaattctagttgaacttgagatatactccatattcatttttggcagtaattgcgtttttattctaaggataaaaatctaaaagtgacatagtggtctcacattttttcagatcaaaagtcttggagcaaaggctggagttgttttgaatcctgcaacccctctcactgcgatagattatgtacttgatggtaagactattctcactccaatatttatagggtgttgacacgtgtgtaaatctattgatggattgatgtccaaattctacttggtagtcgtatgaattttgttattattttcaatgtatcaatcctaatattagttgttaagtgtgatgggttgatgttgaaggagcacacatgacatgtttagattatgtttgtaattttgtgaattagacaagtcactcctgttatttagttacctattgcagtttttataagcatagccataatgcaattttagttaagagtcaaaactgtgctatttctggtgaaaatttgatgagtattgactgcattccaatcttgactttcttgactatcctgcctgtagtcacttcgtttccttggattaagcataattattaacagcactcacagtagaaatttacatgtctttctcatcgtacgacactattatttctttagttcatcaatagcccaacaggcatatactccgacaactgacaagctactacatttgtctgcgcagttgttgatctagtattgattatgtcggtgaatcctgggtttggtgggcagagctttattgaaagccaagtgaagaagattgcagagttgagaagattatgtgcagagaaggtatatcctcatttcctgcatgtattctcactgagccagtgctctaagcgtgcatttcattcttttaatagggagtaaacccttggattgaggttgatggtggagttggtcccaaaaacgcctacaaggtcacctgatttctagctttctgttactgttatttttttcactactgaataccaataacagttttggactagaattatggttcagttgggtgttaatttattgtttctttgaataacaggtcattgaagctggggccaacgccattgttgctggttcagccgttttcggggctccagactatgcagaaggcatggcttcttttcagtgacatacacattcaatcatcaaacactaagttcttaaacatgaatttctgacatagtttactaacagatagtaatatgcttatgtttttcctcttgcaattttgcagctatcaagggaatcaagaccagccaaaaacctgtggctgtaccagcatgaggatcctaaagtagtatgctgtgtacgttgtttttgtttaccagtaccgcggtttgtacagatatgtgccaagctgtacgttatattggagaaattgaaggaagaagaaaacgtggagggcgaccgtttttctcactgtccgcgaagatatactacatattctcagtgtcatgtgatactaccgtgctcacgaaattgttcataataaatatcgttctttagcaaatcctataatgatttacacttctagcatttgaaatttatccacaaatatatgcatttttagagtactactttttgccccagtaacaaacatatgctccgcactggagtattgggtaatgtgacagttgaaaatatagtactaccaaaatggtcagggggcaaaaaaaaaaaatcaacacttgcgaatttttttttcatagaaaagcatgtattttgctttggctatcatcatgaattaattgattgtcatgaacacgaacagtaaacaaccagcccaatttacatgctttagaagggcattcatattctgcattcggcaagtgaaaaatgaatcaatcaatcgcaaagcgaaaaggctgacctatacaacaggagatcaggaaaaccggttaaacgatcaagatggactctgcctgctgtgctgctggcttcagtccactgcacgtcgccataataacttggctcggtgaggttacaacttgacttgacgctcaccttacactgattgcatccttggttcggctgcaaaatcttgaattggccaggcattcgtgtgggttagcataaaagtaatcctcttcttttggcttattttcaagtttctgccgacaggacggttgaactacacgatttctatgagtttcctggacagaagatgcaaaattgttccaagagattgtcttattgttgtacagatctataaatccaaccaatttctgtcggtctagtagcacacttctcctgaaacccaggaacctgaaatattgaaatgccaataaaaaactaatgaccacaacatatatctgattgcacgccaacttttggctacatgatcaaatcatactgaactgaacaagaagcttgattttcataaagaggaaatctggctgtgtccatacctccggtgaccttcaacaagttttgccatgttaccatcataagtaggaatgaaaatatcactggctgtggatacaatgaagtcaagtgcagccatctgagaagaatggttctggaattgtcgtagagcttccaagtctagcagcgtctcctttcttacctgaaagatattcaacactgtttatatagcgaagtgagtgaacatttaggcaatgaagtggtatcccaaaacatgtgaaacagtgttggcagacagatagggaaaaaaacacatgcattgaaatttatgaaaactgtactacaattattaccagttaccataacacatggaaaaggcaaaaaaaattggcagcattttgactacaatattgcacttacaagttttggaaatgcagcttgtaatggttctaatcttttttctcccccataaatttcaccggcagcaatgtatatgagagtgtccttctgaaatcccagagctttcagaataaaagatgtctcctcaggtgtaagtgggcatagcccttgcaatctcttagcttgtgaatcaatttccttttctctccaccatggataagcatatctgtttgagagaaaaagttggcctcagttgcttgtggcttgttgtacttttcttacacagaaaacattgagacacttatcttagagacatagacgtgcaattgtgtgtccatactcagcactcaagaataagatagcaattgactaatttgacaatattaagaataaatgagtatttttcctttttcatttcattgaaatgaatccaccataaaaaggagagaaaaactaggtatgaaaatgacgatttaatagactcagagtgatgttttataaactcaaataatcaccaaaaaggtaatacgagaatgttacatagaattgtagaagactgttacacatagtatctatgacatgaacaatcatttctagacgagttaagggggtatagataacatcattaaactattacccctttcattttaaatagatgttgttttgaattgtgtgtagtcaatgacattagtaggtacataggcgaaggaaaaaaggtccaaatcgtcatagctctaatatttttagtgaatatatgactagaaaaagtaatggtcaaaggtgcatattcgaaccatgcaaatgtcctataaacgacataagaaaaaatacaaaaccatggagagtgagagagtgtgtgttttggttgaatagggggatggtgtttgcctcctactacaacaaacgacataagaaaaaacggagggagcaatggagtgtggtatttcctcttatatgcaaggaactacttgggtcaatatctgaaaggctacattttggtatttattaatatatatataagagcacaagatggcttttgacctcattcttttgagctcttcagcttcttcttgagaaagaccatgattgcaaccagaaaaggccagcatgtccatctcatagcgtaaatgcaaggctgcaaatgatcccttggcctgaagtttctgcaccagtttattccccaaggcctcaatttgaggggtgaacttcagtgcatgaaaattaacacggcacctaagtagttgaagctgtgtactgataccattgtttgctaaccgagcatccgtcttgttaaaatggatgacgctatatttgctgaataatggtaagatctgcatagataagataccatgaagagtatataatatatagtaagcatgtgtcaagcaagatatatgtacaaacctgatgcaagtaatatttttcatcagaccagctcacaggtggcatattaagtatattgtttgaatcctctggaccaaacctcttcggaagctgtttaacaatgtgcacttcatctcttaatgtgtcaatgaaatgtttaacatcaaatatatcttcaaaattgctgcaaagtattgcaaaaatatcgcacatttcagatattaacatggtaggtccggtacataacctatcctacaaaatgaaaaatacctttgatcagcccagaatgacctcttgtctagttctgggacaaccattgtaaggtttagcaagcgagcaaccgccaccatgtcacatatctggaatatatggtttcaaaataacagaagtataaaaaagtgagagacaatataatactgagcagcaaaactaactcaagtaaaaaaaaaaacaactgacctctgaacgcatctgattcaaacccccattgcaagataccttcagataaccattactcttatagactcctaaaaacaaaaaaatcaagttaaaactgatatgcccaagtgatgattaatgctgcttcttaagtaaacattcaaaaaaatgaggatgtcaatcagctagtgcatccatttatgttctgccgtgacttctagagtgaaaaccatttttctcatcaatcgcaactgtacttgaagcagccgcttctacaacttcactaacttactatcgatttgggaaagggcaataacaagttcatccacatttgaatccaatacactttcatttgtacaattctactcatccctacagaatgccaccaaatccatacacatcaaaattcaaaactgaacaaaacttaaatcaaactccgcgaagaaataactaaacaaataaacaaataaataagacacggaggagatcacgcacttcgaggcggaagcgcggtgggcggaggcgagggctccgcgtcgccggcgaggccgaacaaggcgaggaggcgtccgacggccacgagctgcccgacgaaggcccacagcagcacggcgctgcaccccgccaggagccaaaccctaggcctcgacctcgccatcgctcccccaccctacatccaccgccccctcctcctcctcctcctcctgatccccgccaccggcattggcagccgcggcagcagcagctcctcctccgcctcctggttcgagaaggttccagaagattcgggagaggcctagctgcgattttttttttctttttc

SEQ ID NO: 66571 - DNA, 5812 bp, Oryza sativa
  unsure (1)..(5812): unsure at all n locations
tcatcacgacctgcaggcatgcttagatcttatacgggattgactatatatcagtcaactaaaattttaataaccctgtatctaccgtgagccgttggatcgacacctaacaaattcatgatatacatggtttatcttctccaatgagacatgttatattttttttctatcttcttacttcgaatgaacttccatgaaaccatgactcaccggtgtcatctagcctacctcatctccggcggctcacttcacctaatacataggtacctccctccgcctcatggtcactccatttcgctcaacccctgcgactagctaatctaccaaaactatgtactgctgccacctagctgcaccacccgactaccacacatcaccgaccgcccgaaccaccactcccctccccgaccatccctctaagcttcagaacacccctctccccggcccatagccacactcacactaaccctcatcccgaatcctaatctagcgatgccgacatcctctcatcatatactaacgtttacattgtaatgaaagtggaatgatggggacattggtgttgttgttattagtgaaaaaaaagagagataaaagccggaggagagttgaagaaaaggtagaatacaactcacaatgatcggattttagtccaatggtaaatacaaggtgacactgtgaatagtttactgtgatacaaatttataacttattaaaaatgccatgatttatcttccattatagggcaacattttcgagtttttattctaataattctatttcaaatttattctagcgagatggcttattgtaagggtcagcgaattgctcttctatctgttcagtttgctttaggcttgatgatttgatccttaatccttcttccgaggccatttatactcgaagaaataatcatggaatcctttgatatagttttggtcgaggtcgagtaggtcatcaggattttgccaaagttgattttttttaattcagaatcctatcctcgttatacgtatgtgggtgaggatcctctaccataatgccactgccattacggccagtgatgcgtggatcccaccgtcctattgccccacatgtcaatctctacgtacacatattgggtatgatatatgtggactagcacatccatacatctatggaatatctcatactcccttcgtctcataatataagtatttttggagttagaaacgattattaagaaagcatgtagaattaaatgaatgagggttgtgattagataagaagtgaggtagatggaaaaattgaatagcggagggttgtgactagttgtgaagagaatattggtaaataaattgttatattttgaaataaattctaaaagagttgttatattttgggacggagggagtattatacagtacaccgacaaccatttgaagacaaaaaaaaatactggtgtggaaatggtttgaacatatttttttcagacttttttttcccgctggacatagaggagcaagttcgccgcacatatcctaaccagaaagagaaaaaaaaaagatcggacggtcgctccagcagcaagatagattgtgcgtcgacatgcatgattcatggcaatgatagtgaaccccagaatttagtacagccggagatcgatgagctcacaaccttatctcatctaatcatgatttgattttttgattagttagttttagtggccaccgcgtcggctcgcaggacaggacaaggacggacagtgctgagcaaaatggcagctgcctataaaccaactgcggcagattgtttacgacgcattacatttgttagcccatccatttaattatactattattatcgaacgcacacactgcacgcacccatccttttgctgcgatccgccaatggccaccaccaaatttgcaagattctgcagatcttgtcgctaccagggccaggatgtatgtttctttaagaagggtattatttcctcgacatttacatccaactggatatatacaatcatttaaattgagaactttgtttaaccaaatatgaaattcgctcctataaattaggaacctagtcccgcaaacaatctaatctgaaattcactcctatgaagatttaaactcagaatcttatgatgctattcagatcactgcaaccaatagattacatgctctttttgcattgttactgctgctgctgcttattgccaatcattttatttggtggagaagaggaggacggatcggatttctctccttatctccacttgcagtactcaaaagaaagtctgatgaagcgtttgcgagtgtgtgtgtatgtgttggtagtgtttgtctggatcttgagacagaaatgcttttgcatgatcgatatggcgtcggtttcggcagcactgttgaggcacgaacggcttcgtttctccgagaaaagtcgttctggatttcagtgggtactaggctgctttctggcgacgtgatttgtcgtctccaattatccagagagagagagagagagagagagagaaagcaagtagaggtcatgtttgctcttccgaattgttcttgttgctgttccgcggctgcacgagagcttgacgcctcaacgaccaccttgttctcatgatcctcccattcatctttgattttaaaattttaaggagtgactacactacatatgcaggtggttggtagtcagtttttaaaattttgaaaaagttaaaaaaaatccaaagctcttgacttctagttttctgaattgcttgagaaagctagatattttgaaaaaaaaatttgcaggtgcgagaagttagtttagtggttgtgacctaagtagtacctcaagatactgagttcaaatctttatataaaagaattttagattaggttgtttgagggacaaaattcccaatttaaaaagaccgcatacatctgttttgatgcaaaagttgggtaaaaaaataccattctctaaaaagagaagttaaaaccaaagctttcatatccaaattctgcaaatcaagttcaaatagggttcaaagttgcgaaaggacctgtaacctagtggttacaagagtctcagtagcatctgaggtcctaggttcgactccccgtgaaagcggatttttcaagatttaacgacgttgtgctttaataaaaaaaatagggttcaaagttaaatccactaacacttcgggatttgactgaacagatggaccgccggccaaacgaacaaacccaccactcccactgtcccacgcaacgaactgaagctcatgcgatcaaaaattcaaggaataagtccacatagactcccttaaaagtgacccaaatctaatatgtaaccctcaaccgcaaaaccggataggataggatgactcccgaactactgaaatcagtgcaatttgactccctcagtggttttgctgatgtggtgctgacgtggaaatattgacctagttttcgtcacacgtggcgcttacgtggcattacaattaaaaaaatatatgtgggacccatctgtgattcacacaaaaatatattgtggtccccactgacatgtgaggcccacatgtcatcctctctctctctttcttcctcctccctctctcccccttttctctccaccttctctctcgtggagcaatagacgggcaggggtagcgacagcgggcgggagctggagcggcggcggccggcaatgaccggagcggcagcggcggcaggcgggctcgacgaagcgggacttgagcttggtgagcgacgaccggcggtggagtagcgcggcaacgacagcggacgcaatcccgtcgcgccgcggccgcccatgcgacaagaggaacgccgtgccgggggagaaaggggagggaggagaaagagatgcggatgcaggggagtgggtgggtcttcctcgccggccgaccggtcaagggcgtcgagggctccgccttcgtccatggcgcttggattagggcgcggcggactccctcaaatataggtcaagctgcagtttcactaattcacaacttccaccgcctctacctcgccacgagcacgagccaccaccacccctcgccgacatcgcttcgtcctcgtcacaggagccgttggcttcgtcggctgccacgcaactgccgccctgcaaatcacaacactactaaaatctgaactctgaattcctgaatgcccagttgtttggtcttcacaaatgctcctatatatacaagacaattactaccgcaagaacacagaattagatcggttttgcagtagcacacacaatgatccaaggaaaatggattaacatcaatggcagtcgttttcagcacgcggaactcaggaggcagatcggcaaggcgatcgtcgtcgtgagtagtctgaagctctgaaacgaactaatcgacgagcggcacatacaggagaagataatcggtggagagagatctcatgagctgttgctatcgcattcaagcgccatgaccagtacgccgttgctatcggttttggggaggctttgcaacctccggcaacggcgtcgtcggcgtcaacagcggtggcggcgcagtcggaaatcctcctcggggtggcgctcccggacgacatcgccttcctggctggaggtggagcacggcgatgggatcggggcggccaccgcttcagctcccgccggctgccaccactccggcccccgcccgccgccgctccagcctgtgctccccgcagccggccgagagaaaggaagaggggaggaagaagaaagagagagaggatgacatgtggggcccactgacatgtgggccccacaatttttatgtgtgaatgataaacgggtcccacgtatacgtttttaattcaaatgccaccaaagcgccacatcaaccccacagattaggtcaacaatgtcacgtcagcgaaaccaccctccaaaaccaccaagggagtcaaattgtaccggtttcaatagttcgagggtcaggatatccggttttgcagtttaggatcatggattagattcgggtcatttttaagggagtaaaagtggacttgttccaaaattcaaaatggacagttttttttaggaataagttcacttggtgaccctcaaaagtgattgaaatttaatccgtaaccctaaaccataaaaccggatatcttaacccccaaactatggaaatcggtgcaatttgactccctcagcggttttggaggtcggtttcgctgacgtggcggtattgaccgggtcttctttacacgtggtgttgacgtggcatttagctggcatttagaattaaaaaatatgtgtgggacccatttgtcaatgacacagaaaatagattgtgggacccacatgtcccttctctctcccctccctcagttccctctctctcctcgtcgttccctctctctctcccgcagcaggcggagacggaggtgcggcgacctgcgagcggcggcggcacccgggctgagctccaccacggcgaagacggaggagaccacagcggcagcggcgggaggcacacgcggcggggtacagcgagctcggcccagcagtgggaggacgaggggagccggcggcggtgtaaccggcggctgaggtatgggggccggcgggcgggagctgccggcggcgggagagcgggtgggcgaggncgccggtggctcgtggcagagccagcatgagggaacgcggcggccgaggtatccgagttcctcttcgaccgcttcgccgcggaccgcgccgccatcaccatcgccatttcagcagtcanagtcgaatgatgaacgtctgtcccanccagcnggtcatcaaaaccctg

SEQ ID NO: 66572 - DNA, 7838 bp, Oryza sativa
agacatgcttaaagtgcttttgatggtaaatctagtaatactccttttgctttacttaaactaagtaattgtataaatattggttgttatatattaaacacttgatcaaacaccaccggtccaaacactcaggaattataacattccagtccttttgaaataaaccctgttaaagtatataagaatggacacctaggttaacacaaaccccgaagttggggtcaacaccataccttgtgggacctcttgggagttcaatagcaacaaaccattgcaccacctagaaggtgatgacatgatgtggtatattaagtactagcataatgcccctgcgttgcaacggattctaaataacatttattgacataaattaaaatcctaaaccatgcatatatcacaattagactgaagggaatatgatcacagaaataacagtattaaactacaactaactttggctggaacgatatttcaatatcagaaaaaattatataactaaatccttattttatttagctataaataattcaatacagaggaaattgcaagttacaataattttttagtggatcaaatagcactaaaactaatatcgcaaacgaaaaaacaaatgaaattaactagaaattaaaaaagaacctattttagcccattgatgaaaatttgatccataaaatctgaacgggtacccgtttcattgatataaattagaatttcatgttctgatcatattcctatgatctcaatattatgtaagtggtccaggagcatggttgggctagaccacgaaggattagagccttcgtccatagatggtggaggttgccaatgaaaaaaaaaatcaaaacaacatgaaacaagaaacagaaaaggagggaagatggacatcagtcctccggcgaccaaactgtggtgagtaaggtggccggacatgccccacgatgtgactagttcgtagatggtggtggttggcaatgaagaaaaccagaatagcaggaacaacaatgatgtggtcctgatagagagagaaacagtaacgacaagctctggtggtgaggacgaccagatgagtgcgtcaaaacgtgttcctggatgaggaggttccgttttccttgaatgtgtaggaagaacgaaagatggagaaaggcgactaacgttgttcattgtcttccctagcctaaacaaaaacagaacatgagtgaagatgggcgctcatgctctggcgaccaacggtggtgagtaaggtggctggacgtgtctcatgatgtgactcgtccatagatgatggagggtggcaacgaagaaaaaccagacataggaaacacgaccagcaacaacgttgtcctgatagagagagaaacaacaacgacgagctcttgtggtgaacacggtcggtgagtgtgtcaaaatgtgttcccagacgaggaggttccatttttgttgaacgcacaggagggagggagtgtaggggagaagaggagcgctgggaggagggggcgacggggaggaggagcgccagagaggagagaggccgtggggggaggagaggggccgggggaatggggagcatgtccaatggggttggatcggatgattttttgggattgtgagagagagatagaggtcgtcgggaggaagggggatcaggggaagggaggaggtggaggcgcacacgagagggagggagggagggaggcgtgcggcgcatgggagggagagggcagccaaaaatctcgtccagaagccttacgcatttttaattaggtatatattaattgtcgatatatgagttcagcgtagtgctgacccgatgccacttgtgcataaggttccgctaacgtggtagcggttactataccatgctcgctggcgttgagccattggaactcagtgcctttggccctggttctgtcctcgaagtccattttttatatagtttttgtgcagggttcatttataaaattagttttgtaaaaggtcaaagtgttaaaatttcagccaaacacttgaccatatgcccataataaaagtaaaatgttgttacacaaagtgcacatgcacggatcatgcttctttccctccctacttgaccctaagttcggacttcgcatgacgtatcaacaccgacaaggtgtgcaatggggtgctaaccctagcagtggacatgctttgtggcagttctgacacataatctccttcagaggttaaggaaaatggttacatttttatccccatttagtttaaaagggctaagtccatggtgctatggttggagcacaaatgattgtatgttggcttgaaattatctaaactcaggttagactaaactggaaaactagagcaaacacatggcaaaataaaaaaatattaatgggcaaactagaaagtaattcgagcaattttgttttttcccctactttgatgtctaatactgattttacccttactttttagggtttttgtttttgcccccagttttttgaaccggacgatcatccggcccctattttggatggtgaagttaaaggtgttaagtaattgtcacaaggacatttataccctcttatattttttttattaattgtgtttttgcccccatcttatacatgttgctttggaactttatttttttgaatatatttaaaattaaatgatacacattgactaatataacaattaggacagattcagacctaattgttgtggcaatgtatgtcctgtctcctgtcctaattgttatattagtcaatgtgcgccatttcattttaaatatattcacaaaaataaagttccaaagcaatatgtatgaaatgggggcaaaaacgcaattaacgaacagaaataggagagggtataaatgcccttctgccaattacttaacattgttaacttccccatccaaagtaggggcaaacgatcgttcgtttaaaagaagtgagggcaaaaacgaaaaccctaaaaagtatgggtaaatcaatattagacattaaagtagggcagaaacgaaattgccccaaagtaattagagaatatcacaccccactacagggtgtgacctcaggcaacatattgcatatatgatagggctaattaatgggtgaataggaaaattattatctaggatattactctcatccccatccccatcactcttcaaggctaatgtccttggtagcttagcatacaagtacataacaatgggcatacctcagtggtacgaaagcacgttggcatgaacacacacccatgccatgtttacgcaactagaataggaggtgccggtggtggatgttggattataggttggattaaaagatgctctcaaaagctgctagggtgcaacttttgtaaactagatgaataccccgccgcgttgctgctggaaattaagttgcataatatgtacaaagaagatgaaatatgaatattaaaactaaaacaaattgatacttatgaattttgaggcctaaaaatgattgagattacttggtgttatgagaggaaagaagagaaaatttgaaccatagatctatcatccaatggctagaaataattggggtgatatggcttaatgagagaagagagaaatagcattaactacacttagtggggatgaactatataagtatataggataagaggactcactcctggagcttcccgtagtggttgttaggcaagctgcaggttgagcacggtgctcaatataacttagttggctactttgaagccgtgcacacatagagagatagagagagggggaggggagcgcggaagggagggagagagagatgaggtgtggtggctgagggtaaggtggccggcaggaagagaggggaaagaataaagggaggatgacacatgtgagggcctttttttagcttcttcttttttgtctgatttgattgccactcaacaccacattagggaagaccactctaactttaatataggatatatgcaaagtgattttttttaaaaaaagttcaatgttgaacggtgtccaaatgaaatttaggatttatttttagagttgtaaaatggattattttcctaatatatttcacttaactcgacagacattaagcatccatggcttttaattggctatctatgttttagttcaaaaatcaactttcccacctctttattctaaatactaatggtgcgcatgtgcggggaaaatcccactaaggttctatttgtaaatatctattctagcgcttcagtgtataaatatatgttttgcaggtttccaaggtgggctcaaccatccatgagatatgttgtaacctttacaacgcaagtaccaatgcgacgcattctctctaaaaagataatggctatcaacaccaggcttgaggaaattattcaaaacaaagataggtacaagatggacgatgtgaataagggaatagaagtgacatggaaggcttcaacgtcaatatccgaaagcaattctgagctgtaagtgtgcaaaagtgcatttttccttgtgttttacatgcttctctagttggttctccattatccaacatacttagtgtgcacttaattagatttaccaaggtaaattgtttatataaattgttagagaggatatataggtgtaatttctataagaaatataccaacaaagcaccaaatgcattgttgtccatcacacatgttctaatatttatggacagaactattaaaaatacaatcatgtttgaaagtttagccacacacattccttgaacacagagatatgtagcctaggggggggataggtttacctgaaattctaaaaacaaatcgcagcggttaaattaacagggtccggaacatcctgatgaagaacgccagaacttccggtgttgcaagacaggaacttccgagcaattggtaaatcagagcaaagattcaaacttcgactcaagaaacttgacctattagagcaatataaaacataggataacaaaaaagtaaatggatcacagagacgagcacaaaatcatcatagagaggacaagagggattttttttcctgaagttcggatcgcacgtatcctactctctgttgaggaactctgaagagttgggtctcgattaacctcttgcctctcttgtgcaaagattccagaaaaggtccacagccttcaatccaacacccttaggttattctctagaatttgagtgaccgccaagatccaactcaactttcttctagagaggaccacaagtgagaattgctctactaggacgatctctgaaaccttagcacattttccttaatcacttacctcgtttccttgcggaggtgaggaataccttcacaaacttgcccgggacatccacaatctcgaaggaagctcatgggcgacacctaaccgtctaggaagagacctccaagagtaataagctccaaatgacagcccacgagataccccaagtgctcaattcatcctaaccttcaaaaccttttgcaaatctctctaacaccctcacaatcactctctcacacaagaatggctcaagattttgggtgggggaagcaaattcaccttgggagaggctagaaataactagggaacggaagagcaaaagtgaaatgtccaaagaatgagctgggtctgagtttgatatatataacaaatatgtgacgtcatctagccgtcactcacagatttgaactgaagggtggaccggaagttcctggtcctggggctaggaacttccgaccaacatttaggaaaatgtcgacttcacctcagctaggaacttccggcccaaagtgccaggaacttccgtccggcccttgctgtcttgagaagacccattctaaaaatggctcttaaaaatatttcttcgcttggacaggagtaagagcacttgtactatctcagaaccacacctagaatccctcttaatagtatgatttttcctaaactcgaatgcaaaaaagtaaactagtctaatacaactccgagttctttcgccattttaaatttgttgatttgggggttctccaagcatcctgggactaaaacacttgcattttactccataaacacattgatcccttaaccacttcatcattaatcaccaaaaaccactagggggataaatgcactttcaattctggaagagaaatatttgtgaacaaacaaaaagtaacaaagaataaagtatgaaactatagtgacagcattttggatgtaaatatataatccaatggcctagaatcctgttggacagtctaataagtagatagatcaaaaattaatgttcccaatgatgaaaaatggtggaaatggcattccaatccagacttggtggtgtggttctcttctattttccaatctgcagatggcatatgatttctttaactacatatagatacaactgtgttttcttaatcacaccgaacactcgtaagtctttgacttgctaaaaagtggagatgtatattaataatgtttatatcttaattagtgtccacatataattaaacatatatggaattactttaattgttactttgaaaatttaccgcacacaattctctcagggcatgtgttgtggtgtgcatatgttgcatgtaaatggagaaaaaatagtagctttagggctacttttgattgaaggaaattcaaataaattttaaaggattctaaacacaaggattttttttgctctatattattgtttggaacaaaagattttagcataccaaattcccatggattgctatgctctggacccattttatatatagaaaattttacactaagcttaaaccttattttacatttcctttgagaagtccaatatacatcttatctctcttagttccatcaaattcctatggttatattccaatgattcatccaaacacaaatatgtttcgattcctatgttttgaattaccataggatttgttcacatgtgacactctaatcttgtcttcttttctattcctgcatttttgaaatcttgcattccaaatgatccctaatacttttcatgtaaaaggggttaagccactggaaagttgtcatgtttgacattggtagttatagcacaaactggtaaaccaaataatattggtaatttctttaaaaaattacacttatcatatcattaatgaaaatataactcagcctctacaccaaccattaatgtatagaggcttttaattatgggacttaagtaccatatagtcataactccagtgtcagaccaaatatacttcgtgatcaagcaagagcacatcgacgaaacactttttatagctccatgcatttttacaagagaaatgctatataaattatagaaaaagaataaaaacaaataatgaacatcaaactgaacattattcaaacctcaactgtcatgcatagttttttacctcggtcttgtttaatagtgattttggatgacatggtgccaagatggtataccaagaaaaagtaggtttttgagtaaaatggatcttatgaaatctcacttatagaaaccaccaatattcttgactaattttgtacatacaaaataaagtaggttaattgagttataaaacattatttaaaaccgaacgaaaccattttttttggggaaacaatttatgtaggttctaaatactctaatgtgcatgcgtgttctaactttttcagtatttactactccctccgttttttaatagatgatgccgttgactttttctcacatgtttgaccattcgtcttattcaaaaaatttatgcaaatgtataagatataaatcacacttaaagtactatgagtgataaaataactcataacaaaataaattataattatgtaaattttttgaat

SEQ ID NO: 66573 - DNA, 38404 bp, Oryza sativa
tcctgcagcccacaccctaattattcctgaactggatcggtcctggggatctttgcagtatcaggcagtggggttctacactgccctgattgatctggttacaaacaaacttacaacacattattcacataaagcttttcacttacacatgaagagggttccagattaaaatagctaaagcatgtgactgccctgttagtgctgagcactatgttaagataatgcatgtgattcctagcatctgtatggcaggcaggcctacttgacctattgtttagtagataggaggtactcttgattctcttgcttgatcaagtgtgcacttaaacaagagactgatctcacttgtgtgtgtgtgatggtgtgaccttgggtggtggtgaaggggctcagcataaataaatcgcctccacgtgacaacctgtacggggtgttttctactaattggattgagctacatgtgacccatgagacatgctgcagtccaaatatgcttagatcatcgcccactagctgattttgattggtgatttgatgttttatactggttacatcgtacttaatgaggtacatagtcatttgtagagtttcttatcctgtagttggtattctatgtaagagctatgagggtaattatgcttggaacatagctagggctaattaactttgtgaaaaggtcaatgggaccattttataaacaggcagtacctaacagtttatgattattttatcagtggcagtggatcttgtgaaaaaaaatacttgagagacaaagagaatttttagcgcatgtatatgctgtgattggctggctaatcagatgtttaccaggctaatatacctattagctaaatcttgtgctcatcctacgtcattagctcgtcatttctaaattatctcttcgttattatagattttcccatcgttatcctagatatcctttaagttcataaatgttgctgcacaataattatttgaatgccatttcaattaattgtttagcagtttgccgatgaacatgttttcgtttaaatgaatacccgcttatgagctagtgcaatgtgtgcattctacagatcacttcgatctgtagcgttgcgctgcttgaaaacttcatctgcattactatgacatggtgttttgctgtgctgcactttgaatgagtcactaatgaaaaaaatggaggagatcttgcagctggaatttgctttaggagcattagagatcttgatataaaatgcaagcacacacgcatgcacatgtttctgttaaataatttattgtcatgtcaacattataataacatctcttatatgcagctgttgttaaatgaagaaagcacttggaatacacccagtagttgcactttacctgctggagagatgcattgactggtcaaattctgaatgattgctctgagttgtgcagcaactgtttcctggaatgattcatttgcttcaagatctatacataatacttaataactattaagtttgtaaacatatagggtgccatatatatatatatatatatatatatatatatatatatatatatatatatatatatatatattttgaagagaatatagggtgccatatagtcccctgcatctagccctccttgaatacagaactaaatgttgtgtaattaagatccacaaatattcagataccttacatttgttagagttgcttggaagctgagattacatgactatgatattcagaattaaatgctgaacatttgttagagttgcatatagagctaaatgttgccaagactaatttgttgcaaatcgtaacttcccaaaagccattacaggttatgttttaaagcctcaatacatggataccatagccataaaatatttatacttattctctgttcccattgtttaacatgtaactgactgaaaagcttgctcactgtattttgttatcaggtctaacttgagcaacagaacaggaatggctaagtgggggtgtcaagactcaagaagttcagaaagtaaaatacttttcatgccacatgtaagaatttacttacaatcagacaattccctagtctaactccaaattacatacccgaaagttgaagcagtgcagggacctgatgcatctgccctgatatcggttctcgttctccctgatagtttgagtaataacacctacagtgtgacccatgcctgtattgattatcaggcgccacaagacatgggctgtggatgccagatgattggagaagagaccagccagcatcgtgacactgctgagtctgatacacatcatgaggtaatcagcactttaaaattacttgatccggttacttatgttaggtcatcaactgatggtttcatcagcaagcatagtaattctatatgacacaggagcacgtttctagaggacagagactttcatgattctattttccttgtttggtatcaaaggtgtttagaaccatgtagcttagttatataaatatgaattaaactataagcaaaataactatacattgtctaggaagcaagtcctgttgactgcttcaccctgcgttgtttttcctctggacggccacgggcggctagccggggaggcgtggcagaccgcatttggccggcgcggcagcggcggtaggagtgctcggaggccagctcgacgcatagaggcgcgggctagtggcagcggaggtcggcacggcgcgaggaggcgcagctggcggtagtggaggctggcttggcgcgaggaggcgtgggcggtggcgggaggctggcttggcgcgatgaggcgtggccagcagtggaggaggccgacacggtgcgaggaggagctaccagtgggtgcggtacggtctacggcgcatgaaggctggccggcggggggtgccggtgtagtggtcccacatgtcggcagaggttggacagtgtggagcatcggggcgccagccatggactcgcaggtggtgagcggcgggtgaaaacccagcccagcctcggccgggccggcaacagtgacgctcaaagcgtcattccccttctgggggcgttatcatgccgtctcatccctcgtgtgtggacgttgggtaaaagtcgagtctcggttctctttgagaccttgacggacgacgacggcagtgttttcgtcgcttctctccttggagacgtcgtttaggtatcccttagccgaaaccccccatccaattggtgcaaactctctctagatttcttcctcctgtggcggcgccctagtctctacaaattggccacgtcggagggcctagaaggacaggagttccattcttctctctcaccctctctccctgactcctgaagacttggatagagcggggctttgtgttgattgtaagggttgggttttgggggatctcagctgtgtttctttgtttgcctagaggcggtcggtcacgcttagcggctgctggcccggtgctagccttttcttggttctgtgttggcactgttgatgtgtggatggtggtatatttttttcctttttcctggttacgaccttccagggttgtaatcttgtaatttttctcctgctctatcaatagaacctcgcacagtcttgtgtgagtcgttcaaaaaaaaaaaagagctcctagtcctgattaggaagacaagaggtgtatgcttcatgcatggctgtatactgaatcctagacatggatacaaagccatccatcaataaatgtagcctcaccattttttttcatatacatatatattattaaatatcaaatgtgggggaaaataataattaatccacacattttttgtaggccaagtaacatggtttgcgtggttctttctgacagtgtaggcctccaagtcgccttctcaccagcactttatctcctgttgttctgagcttctcccacttgcaaggggcaatacacgagtagcagaacatacactacacatcactcctcagtatggcctgtccctctcttccatctctaagagttcctcttcccaattcatgtttctggcatgtgactgccattggggccatattgtagtgtggcccctgttggtcagagccttgagctaggtgacacacttgttgtaaacgggaaggtcactctccctcttgcctgatctcatcaggttcctctatttgcagctagtagtagtctatttaacacgccagtagccacccatttctttctcccgtgcggctgtcttgtgtttctcaaactttgtcttacgccagccaaccgtaaacagacactgtctgcgcgtctctcttgcaagaacagctagctctcccatacatctctcctacgttggctgagatcgattgctgccacctacattggccgatatgtcaagccggaggtcacggtcgaggcagtcaggctcgtcgaggatcaccgacgagcaaatcagcgatcttgtatccaagttgcaggatctcctccccgaggctcgactccggagcaatgatagagtatgtaattctatgcactaaatggttaattgctccacaaattcccagtctaaataacagctcgaatttattctagttataatagattagcattattcaccgttcactctagctttgaccacattaagatgggggtagaacatgatcggttgttacacctactgccttggcaaaagaaaaatagcagcgcaagttgaatgctccttatttctaattcctaagcagaagttgaagatcatatgaactgatgttaccaatcgactaatcgactatgtcaaacaatccaagcatcgcatcattttgcattcctttttccttcaacaattgtaattaagcaccaaatctcaagagctgacagagaaatcttctcttctccaaatccaggtgccatcttcgagggttctgcaggagacttgcaactacatcaggagcttgcatcaggaggtcgacgacctgagcgagaggctgtcggagctgctggccacgtccgacatgagcagcgcgcaggcggcgatcatccgcagccttctgatgtagccgccggcggccgtcgtcgccacattgtcttttgctgctgggcaatcagcgcgcacacaccctcggaatgtttgtagcttagagagtgatcttaattagtactggaggagcagggattcctaattcactctacgttcataagtaatgtaatgttgttgtcatgtcatcttctaaaccagatcaatcttttttgtgtacttaatcaaaatccatcctgattcgtgcaaagttcatacagtaccattttttgtgtgttttttgctgctatgtgtacagtatagtaccaacctcgccggcttaggaattgccagcgagttgcctctttcggcgctggctgaatgtacacactgctgccccttttggcacaggaagattcttaggagttgtctttcagtttggcagcagggtgctttgctaatgccagattcctctctctctatttcctaagtatcttacaaatgcgagctctcaatttgtgcaagagcgacaaaagcgtcgcaattatcagtccatggccaactgattaatcatttaatcacaaacacttgctcggttgctccatattgtaccgtgtttgtcgcaaaaaaacaaaaatgccagtttgatttacactttggaagcacggtttccatatttgctaatgccaaatatctgtagtacagtactccctccgtccaaaaaaagataaaccctgggttttcgtgtccaactttaacggtccgtcttatatgaaatttttttataattcgtattttcattattgttagatgataaaacatgattaatattttatgcgtgacttgtctttttatttttttcataattttttcaaataagacggacggtcaaacgttaaacacggaaactagagtttgtttttttttggacggagggagtagtaattagtaaaccgtgccagcctagccgagcgtgtaacttaaaaattacattggccgttgaaaggatttcgttagctgcaaaaaaaaaaaacaaaaatgcctggttgatttaccctttggtcagtctgtgaagaaatatctggtagcagtaaaccgtgccagcctagccgagattgtaacttagagcagataggatagtagattattagtcaagctataaacatattttaataaaataaaagatgagagagaagagcagcgggttacagattatagcacggactccaagacacagtgtatgtatgacagataagattatatattaataatatagtaagcaactgttgtataaattgatgattagattgactatagatgaattggagccaatagtaagctatactattaaacttgctcttaaagatcacattggccgttgaaaggatatgattagctgcagagccgataagattttcaattgattctaggtgggaagaaagaaccgggagctagatgattcgttaatatcggtagcatcattttagaaacgaaccctagagattctgctatcctatcctccgtgctccccaggctcccggcgtcgtcgtcgtccctacacttcgcacccagtaggcactaccaccctatcgttgcaggtcaaatgaactaggctactaggcgctaggtagctctagtacaagtgaagtattctatcaagagaagatcaataaccctcgtgcacacatgccactagtccactactccactaccagtgttgagcaacaaaccaaccagaagcttttgctgcacgggtgcatatgccgctgtcttatcgttgggattttacggtgtttatttttggtgcagagagaggcttttcagaaagttggcaactccgcctagtgaaaaagcagcgcgtgacgcgtcgacgcacgcgactacgcgacgagagttagcggcgccggaggcggagacaagacaccgaccgcaagatgggccgtgcgttcgatctgcccgcgaggagcagacgagccggcctctatccacgcgcggtgaacggggccggcccgggagaatatctgggctacgcgctggtgtgacgcacgcgacatggagagcggaggcggagtatcgtatagaaacaagtgcaatttgaccctcggaacaatattgatagtagtatttacttacgtgaaataccagttatcaaaagaaaataaagtaaagcccacttgtcatactcccctcactctctctctctctttccttctacaccccgctttcactctacccgttttattgccaatagcaatggggtgcacgacagcgagcaccaactaggtgacagcagcagtaacccgatgcgtcgcatgccttctgtgtcaagcggtgccccgacgaggagcggttgtcttgagcacctccttgtttgcggcacaattccggcggtggagacggtgatggcatggtgggccagtggaaggcatcgaaggatgtagggagcgcgttccacacttccactccttgtccgcgctctgtgccaccactgctgcacccttccatcgacgacgtaaagcagtggcgacgaggagcggcaatgtgggaggcgagaggatggatgggccagcgcatgacttcttttcctcctccccgatagcaaccaggcgacgcccaacacccccaacactggacatcagacgacgcccgacacccctgacacctgacatggagtagaaggaggaagagggaagaatgatcgtggtgaggacaacggggcggaccggtccgacgccatccccaaccgagctagccaccaaatgctagatccgatgtggcgggacaaagcaagcttgcctctgtccctcttcttcgttgatagctcctcttctccccgagcgccgtgcatcgagataggtacgacgagaatcttggcacaaccaatcttcttcctcaacttcctctagtcgggactgcccacgcaaagccacggttgggaggccctaacgcgtgatagcggcctagcctcaagcgaagcggcgacaacttggccttgaggtggaccgatggcacggcagaagccggagcgacaacgtggcctcgaggcggagtggtggttgggtgctcctgacgcgtggtggtggcctggcctcgagtggagcagcggtggctcagcttttgaggcgaagcaacgttgcggcttggagatggagtgacgatggaccggcctagaggcgagacggcgacttgctgtgcccagacactgccgccgttgagagacgtggcacgatggagggcgttgttgaagtccccgtcgtccttggctcgccccactgcctctatcgtcagtggcttccgccgcatgccatttactcacgatcgatgccatgtaggccccatgtgctgacttagctggttggactaggttaatgagccacgttagtgaaaaccaccgaggaagtcattttgaaaatactcacactgacatgtggggctcatatgctgacttaaccggtttgactaggccaatgagccacgtcagtgaaaatcaccgaggaaatcattttaaaaatattcaacatatgggccccatatgccgactttagacagttgaactagatcaatgaatgtgaaaatcaccgaggaaatcattttataatggtttttaatagttgggaacaaagatatcttatatttatggttgagggataaattaaattggacccttatctgcccgcccgaattttttatttatagtaattaataagtcttgaattaaataagtggtaaattttaaattgaatttgtaaaaatagcatgaacgttgtttcaaagggcgtccagacttggacggtgttctaagaagtgtccagaggtggacgctgtaccgaagcacgtccaggctcggtttggggcgcccatgccgccatgcggagaggtgccattgtggactctcctctcctcgggcccaatgttggtgcagggctcgggcaaggtgctgccatgcccgccgttcacctcgactctgggagactgcaacagccgccttccggcttccgcctccacaacgtcaggaatctgccgttgcagttcacctcaactcacctcgaaggctctcgaatccggagaggacaccgccgctttctgccttcacgccgggaggtcgtagccgctatccacgttctggttgagtcatgctggaacaataacccactcgtgccggcttgtgttgcgtcgtctgtccgcccctcttggttcctaacagcaagtccaggcatcgcctcactccaggtggctggccgagcaagtatgctcagttcatagatcttggtattcaggtgtatatgttctgcaatagaaagcttacaaagaatgcaaaattacgaagggtaggacgcaaacatcctccttctatcagatcatctattgcccgatgacttccaatctctggcctgttgcaaaaggaaaaaaaaaagcatcgatcgaagacctcgcatgcagttcatctggcggccgcttctcaagattcagtcagtcgcttctcaagattcagtcagcagagagctcgatgcgtagtaaacaatggaccagaacaaaaaccaaactaatcaaatatctcaaaataaaagtggtggctgttcacatatgaccccgagtagagtgtccgtcatgcggaacagcggaagcattgaaggagggccgggggatggcgaccctgtctggcagattaggtagagagcggtgcctgctcggcaagcaagcaatcaacgagagacaatagtctgcataggagtaacgaggtagagttcgaccattgtgtgattggattcaaagtccaatcttagtccggtgaattggatggctctttgaggtcttcaactgcagcattatggacgcccttgtaagaagcgtccccatctggatgttgtctacaacagcgtccacacctggacgccctatgcaatagcgtccttcctattttcgtaaaaattgactttgttttattatatatttaatttctgcattattaattattatgaataaaaaattcggtctgcccgcactcccgagcggtacacggcccgtcacgggagaaaatctgggctccgcggttccgcgcccgcgcgaccaccgaccacgcgcgcgcccgctcccgctcccgcgtcgatcggccgaaacgccggaacggtgcgcgcgggatcacgggccggctgcccggccacgggagattttgggtcggggtgacgaagcgagcgaggccggccggtgcagtgaaagtgaagcccaccgcgcgcctacgtacccaaccggccgcgcgcggcgcgcgtacgaagaaacgtggctacgtgtggccttcctggtcggcgagtccgccgcgcgcgcgcgtccccggtcgcccgcctgcgtacgtacgtatctcgcgccgtggcaggagaggcaccagctagtaccaggcatgtcatatttgtcacacacaccgcacggtgacgacgtacgaagcgattaggagatttgcaggaataaaggccgcgcccccacacactctgcgtctgcgtacacatccatcgatcgaccatacgaatatgttcaagagaagaatggggtaacacgatcacctggcagggtatatcaatcgtggatggatctaggccagtgggatataggggcgtgtctgaagttgacaacacctaccctgtggcaggtgcatgtacacgacgcatatatatgtatatgataatatataaagtcttctgtatgattgcagcatccgatcctaagagcacttcttacagcatcctttggctttccatcaatcagtgccctcccaacatccacattccacgcggtcaaaaagcacatcaagccaacatcactgcactgtgctcataatacaggccatacaggtataggctgcctcactggttcgatatgcttcggccaaaaccaattcgatccaagggtgtatagttctcaaaggaaaaaagatccaagggtgtataggatctggacctatcagagacattcaaattaaaggactttttgatggtaagaatcgatcatacttttgcggaactctagggttacacgcttcaacacaataaacgtttcgtttcgaatttctcctgagaagacctccaacttgagatacaatgaatcttttctgttcataaagaaaaaaaaattaggttcggatccaaaggtacggttaagaccgattgtagaaagtgggtgatacgtttttgtatttctatgagaaaaaaaatacgacatccacaaatcttagtagtaagtcatcgtcgtcgtatcacgtgtatcaaattcttattaataaggaataataaactagtaaaacttcatagccctccatctctttgcggttatcgaatatttttcggttctcgtgtgtgcgacacgtgtaaacattacacgtaggtacaaaagcttctcgtagttggtgacaagaaccgaatgggttgtctcccagttatttcactgtatacctatgccctagggcttttaaagatggtcatggttgatagaaaatgatatgatatctatgccggtttggtaaaccatatagatcttgtgcaaataaggagtagggctagcttgtaaggcactacttagtactacgaggattcatacaaagttccatgtgtagataaagcgggataaacatgagaaataaacatattctcaactagataactatatggtagacgaccatcttccaatttacaatatatatctttcattgggtaggtaatgggaataatcatgcaatttatttatctcgtaagttgctttgttacacaatcgtctaaaattatgtagctagccccttaatggaaagaaataatttataaacaactcaaacacactttcccttcctcatttccccattccctatatatccatgaccccatcgcgatcgtgccacctcggccccaacaccgtcatatgtcccagcctgttgccgccaaacatcgcaacccaatctccatagccccccagtcttcgccgaccatcccaacccataatcagtggctcctcaccctcaccagcactattgtcttcgtcctctccaatgtctttggtatctccggtcatcatcgcctccactaatctttgtccacctcaattgacacgtccttggctgcgttggcatccccaagtgctcatcggattcgtccactgccaagtcctcgtcctcgtggcagcttccccatggccatgaccttattctccttaacgatgacgtatttctcaagtgttctccagatctgactatggcaccaggttttctgttgcagtggctccacgaaatgcctaccggatctgtcggtggtgggccatggtcgattgcagcatgctcgtttgtgaatttcctgagacgccacgctctttctccatctcccttttggaccacctactttaatttctttgggccttcacgtggcttgcagatattactttgacacctataaagccactctcaaacttcaatttacccgtggcactgcgcctagcttggatgaaaacacactatgaatgtaatatctactgttgctctctaaaaccaaccgcgaatgctggaggagttaacagcaaagacaagaaaggataatcgagatcctctacaatactatatgtgcagtactacttactgacatgtgaatcaactgtcagtgagtcgatatgtcgtgaacagtactgcacatgtatggcactacaagagtacttgcatcgaaggaagaagcgtcaaccccccccccggggcgcggcgagcacacgcgctagtcgcggtagcgcgccctgcgattcttccttatccattcatgcatgcatggcagaccattcctccattccatttcgatcgattttaactcctcggtattgcaaacccgatagcctcggtatgccaaatcttggtgttacggatggatgcatggatgatgtggttgaccaacccgtcgtcagttgttcattgatcatacgcatcggagaaagaaagagactttccgtctttctttaccttccaatccccgttgacttggatcatgtcatgcagctatctgagtgaattgtttaattaagcaagagacattcctcgcttgcactgcaccggccgggcacagaacaaattgtcactgtcgcggtactgaattattcagacaatctggctgcatctcctcattttacagcatcagttagacaagccaccttttttccagtagtatgggttatgtgtaggtttgctgcatactcctatataggagtatcgctttagggaatcaatgtgcaggctcccatagagttccagctgaatgcttcagaaggaattgaatgtccatactgcagatttgtagatgtagatatcgagaagcatagccttatatctgcatgcatggacttggatatttctctcttatctgatagcccatgtatagctctatatctgcacaacactttaccatgcacatatatttgcatctagctacaactccgtcagacatctagctagctaggaggtgtgtgcaacaagaacaatatcatatctcacaccttttccgaaaacttcaatgtcaaaaccgcggcatcatatctccattgacgtggttttctctttttccagagaaaaaaaaacatgcatgttcagtagtacgaattatagactctactgcaaatgccaagaaatattaattgggacaaaaacgacgaaatgaacactgtattaacccgatgcaaactgtctaaaagtagcgtttaattaagctgaccattgcgaccgaccgaccgaattgaatcgagtctccaaaagaaaaaagagaaaatgcccttctcctgcatgcatgcagtccttggtgcagcagtgacctcactgaattttgtttgttcttggctagggactgcttggaattggattttagtctagcaaaatttgactccaacatgggagcatgtgagatatacatgtcattgatcacatcactatactgctgtgtatcttttcataccaactaccataatatggtagcccaagtagtggaaattaaagaaagcacaactccatatctcgatccatctatcccttatcactatatatatctatatcattatcccgtagctattttacaatatcacaaatatataaaaagatttagtttttttaaggagtgaatatgttcgtttcagtttgactataatttcctgaacttttttcagtgaccgaccaggcgaccacccgttactaagatcagggtaaaatgtgaggccgacatgtgtattactggtcaatggcagaactgaaattcgaaaatgtattgatgtattattcctcttttttttttgttcaaattaagatgacacgtaggctccagcaaccatccacgtggcggcaggttgtgcacgtcactccatctccaacacatcagcattttcagcaaagaaagaaaaaactgtagtggactttgcagaaaacgctgacgacgagtacgtacgaattaatgccttaatcatatgatatctccaaagattaattaataagtggcttgcttaattttgctactaatcgctatctcgacgtagccagagagccatgcatgcatcacagcgagcccacggccgcacgagcactcgccaacgaattcgctaggcgtacaccgtgaatgatttgatgcgttgattacgggtattcatattcctttatgaaaggttattgtcagactttttttattccacaagatcgatcatactacaaagttattctacaatagtttagaacacttatccagttgtgttagaatataataatgatggatggatatgtatgccatattaaacaatctaaattccccacaaaacatataaaagaacactataataaactatggtttatccaacatggacatatatttaaatgaagtgcgatctccggtgctctttactggtaggatgaatgatgatagagataaaagcgtttaacaaatatggcctcaagcgaaattcgttatattaattaaatcaatgaaaacatttactggattaataaaactccatgctactccattataaatgaacgcacacctatatatagcaaaattcctatttgccagtaggtccaatacttcggatctgtttttttttcttttaaatatccaaaattgattttggataactactcgacagtacaaacgaattaaaccagctattacaacgtcgagtggatttaaaacactcctctattaaattcacctacagaaagtcgttcccgctgaaataatcgcaccgtctagaagctcggcaagcgtgtcgctaatccgatactaactccattaattccattttcatttcaataattgttgaagttattactgcactggaaataataaaggcaggggggtgtaactgggtgtgtacaaagtgttggtgagcatagcagttggcaggtgcaccaccctttattatattcctcctttctctctctctctctctctctctctctctctctctctctctccccctcttcctccctttaaatgcttcgcctctctcgctcgtctctccaaacacaaacccaccacctcctcctcctcctcccatccagcacgcgcctcctctctcgcgcggctttccatttccatctccccctcctcctcgtacgtctccgccgctcctcacttcctccactcgatttcctttcttggcctctcctcctctgacacaggggtgtgcaggtttgtgtttgtgcgtggcgcgtccgccatggctcgcggcagcggggccggaggaggcggcggcggtggtggcggggggctggagctgtcggtcggggtcggcggcggcggcggcgcgcgtggtgggggaggcggtgaggcggcggcggcggtggagacggcggcgccgatcagcctcgggaggctcatcctctccgggatggtcgccggcggcgtgcagtacgggtgggcgctccagctctccctcctcaccccctacgtccaggtatatatatatatatactgtactcctgtgtattttgcacactctcatgcatgcatctgaaactctgaataatcctgcaaaaaatatatacaagtatctcacgtgtggatttgattttgttcgcgagtttttgctcgtgctagctgttctaatctgcaaggtttcatggtagtagattatatatgtcctggttacaatcttttcaaggttataatcttgtaatttttttctgctttgtcaatatttacttcgcactgtctggtgtgagtcgttaaaaaaatatatatcttgaaagattggggaatttttcttcatgtgtggggagagatttatttttttttgtttgaacggtagatttgactagtgtctaaaagtaccgtaataaattcaatctgcatgccttttgtaattttttttgctcatgtgtttatatacatgtggccaaatatgcatttgatgcactagctatcatttttgtcattttgtagttattccttttcctttcctttttttttcctttttctttttgttgtcactagaggattcatatcctctcgattcctctatgaaacgtcggcgttttctgcctcttttctgaagaatctgtatacctatataagaatcaaaatcttttataagttctttttgtgcactttggatcaatcaggctagccagcatgacacttagcatcagtaccggtctactgtaccgagattcactttacgcttgacacgtttctcaactccttgtttgattccattttacctcaattagactgtttgattccgttttatctcagatatgacactcctttttttaaaattccattttacctcagatgctgtacagtgccataaaaaaatatacatctgctccaactcaccttatccttcttgtaataaccacgtattaggttaatagctactaatagctagagatgtaaacaaaaataagcagacaagggcaaaagtgagcggtaataatggagaattaatctgtcgttcctccgcgcgcagttaaaggtaggcagatgacgggtccctcccctctattccatactaaccgcaagatgaaactaatattcttactgctagatatataaatcatccttcatttagcttcatctccctccttaagatgtgttcttttcttccatttcctaacttctactcccttcgtttgacgtacacatatttcctaaactgccaaacgatgtgtttctactaaaaatttatatggtttaaaaaacatattaatatatttttttttgtctttttagctaatatttaattaattatgtgctaaactaccgctcaattttgtgtaccgggagaaagggttctcaatcattacaaaagaacacagcctagtctccatgaaaaacatcacttttattttaagacagagcaagtggagcgattttataactttactatagtacaaaattaatggtcagaaatttaaaattttgaccgaattttatcgtaagcatcaaatatttattaccggagagatagagtattggttatttgcctctctgtcgtcaaatattctaaacaaagacgatcttcttagtggttaaacttaaatctcagtccttccaggcgtttatttgaaggatttatagcggagataaacagctccttttttttcggaaatacgtaaggagggcacttttgtattaaggggaataaaaagggtctgtacagggaaaaccaaaaaacagcaggggacaggaataaacagctcctcacttcctctttgtatcagtccatactaattaacaaagtgttccaaaatgttctgtactttttctgtagaacattatatgcagttcatcacccctgatggtccatgcatcaggtctagctacctactgttgtattgaagtatttctggcgaagtttatccttaccttagccttctcgagccaagtgccataaagatggttgctgtagaggcaactccaacccactttaaccgcgcacatgaaaaataaaggggtaaaacaaggaaattctaggtcagatatatatgtcctgtggactgtggcacagttgcaacagagcaattgcataggcaaatgagggcagatcatcatgtacccatagcctgttggtgctatgttagcatccaagcattgccattttaactattaagattcttcttcttatatttgacaagtgaaataaatttagtgactgaacatatatagaacgatgaacagtctttgtatgtttattcatgccatgggggaaagagaagtgtgatctgaagttattggatagatagctgttagttgtagcatgcaaggcaatgcatcctggaaccaacagaccaacagagctggggatatttcatctgctaaatttctgggaaaatttattgtgtggtaatcaatatgtgttcactctttgcaactggtacacgctctctgatgtttctgaatatcttccacagtgatgcagatcttgttgacacagcaaactcaacaaacatagtcatttttttaaggaatgaagcatgatcatctattgtcagagtagattacagtcaaagtttttttataagccaaaacaactgattttctaacctctgttatttacagacactcggactgtcgcatgctcttacttcattcatgtggctctgtggtcctattgctggcatggtggtaagtaacaataccaaattatctgctctatcgatatatacgagacaaagcttttgccctcttttaaaaaaaataaatcaaattaattcatgttatggaatctgtactttctgcaatgtaaattcaagttactttagtgtcttcactacaacaaaaacttgggtatcctgaactcctgtatctatcagagtttgaagctgcattttctgtagcttctgatatgtgtaatgtagatcatactgtcataattcataagctttcataaaaaatgtttgtgtacaagtcatattttttttaattcttgatccattatcatctcccaatcctgcaggttcaaccatgcgtgggtctatacagtgataggtgcacctcaaaatggggaagacgaaggccatatattcttacaggatgtgtgttgatatgcttggctgtaagaaccactgaaccttggaactcttattccttaagttgaagtccccaaattttctctcatattgacattgcactttatgtatgtaggtcgtagttattggattttcagctgacattggatacgccatgggtgatacaaaggaagactgcaggtaactgaacattttgcgtatcataattagcagataacagttatctgatacaccatgtaatgcagtgtctaccatggatcacggtggcatgctgctattgtatatgtcctgggattctggcttcttgatttttccaacaacactgtgcaggttagtgcctactatataataatcatgttaaagaaatttgtacaaagaatcataacaaaaatcttaattttgcaatgcaatttctagggtccagcacgtgctctaatggctgatttatcaggtaatttttcatagccttgtctttcagagttaactaccaaatttttattggtttccacagttcactaacacttgattgattccagaaaaaaaaaagttgcccttgtgttctgggcttctggtatcagtgggattttggatttgatctcctaattttcgttctgtaggacgtcatggacctggcacagctaactccatcttctgttcttggatggcaatgggaaacatcctaggatactcctctggttccacaaacaattggcacaagtaagttactcttatgtatcagtttcatacagattttctgtttagcacagtctattcagttgcattcttttctgaaagaaggcaagtgaaattcatattacattagtagagaaggtgaaatttgtttacaagtattgagttgcattctccctaattaattgcgcaggtggtttccattccttaaaacaagagcttgctgtgaagcttgtgcaaatttgaaaggtgcatttctggtggctgtggtaagttctgttattacctcataaactgcctgctgataatactttaacaatgtgctaatattagtctttgtaataagatagtactatactgaaaatattttagcgagtatgagtaatttaacttacatattgtattgctgttcctcttttttcaaccctgtcatattggttgctttttttcacagcctaacatgctcttgtttggtcattttcccctgttttcagattttcctgtccctgtgcttggttataactctgatatttgccaaggaagttccattcaaaggaaatgcagccctcccaacaaaatcaaacgagccagctgagcctgaaggcactggtccactagcagtgttgaaaggcttcaggaacttacctactgggatgccttctgtgcttattgtgactggccttacctgggtatgcaatatacatcagaaaaagaacttttcagattattgaaaaaattgctactagatcatatcttagttatatcttatagtaccttaccttttctatgatatgattgtccttgtagttgtcttggttcccattcatcctctacgacactgactggatgggccgtgagatctaccacggtgacccaaagggaactgatcctcagatcgaggctttcaaccagggtgtcagggcaggtgcatttggcctgctactgaattcggtaagatctgattggtttctgaattctgattgccacaactactgtcaaatctttaacactcaagccatgttctttggcagcaactaaccatgggcttctgatcgtgcagattgtgctaggattcagctcattcttgattgaaccaatgtgccggaaagtcgggccaagggtggtgtgggtgacgagcaatttcctcgtctgcatcgccatggctgcaactgcactgatcagcttctggtcactcaaggacttccatggaactgttcagaaagccatcactgcagacaagagcatcaaggctgtctgcctcgtcctctttgcgtttcttggagtccctctcgccgtaagaatcactgacacttcaacttaaacacattgctaaaaaaaattatttcctcaagaatgccttatcctgatgaactgtctgaaaatttgcgcgatgcaggttctgtacagtgttcccttcgcagtgacggcgcaattagcggccactagagggggtggccaaggtatgaatcccaacattcttgcagcttttcttgacataattcggtgttgtttggatgctggtctaatccatggcgatctgcagggctctgcaccggcgtcctcaacatctccatcgtcatccctcaggttaattagctgccaaattctaatccgtttcccttgaaaccgaatcagatatacttcatggattattagaatttgaatgctcatggattcatggttgcgtggtgttcttccctcaggtggtcatcgcgctgggagccgggccgtgggacgagctgttcgggaaggggaacatcccggcgttcggcctcgcctcgggattcgcgctcatcggcggcgtcgccggaatattcctgctgcccaagatctccaagcgccagttccggtcggtcagcatgggcggcggtcactgaccgccccgctctcgccgccggctgcggcggcggcggcggccggagcagcgccgccggaagtggtgagctttgtagttctcgtttgcaatggatcaaaggagccccctctttttttttacatagggtaattaattaattaaggctgttaattaggaaggggtgaggtggccctgcagctggggcccacgctttgttgccacctcggtagaagagaataagcagatcatgcagataatatggaactgtaaaactgttttgtgttgtgtgtgtgtgcagtgtgcttggtaattagtgtgtaatgaatggtcaggagaagtgcagtgaactaagtgaaagtgagcttccatcatcatcatcatcatcttgtgttgtgtaatacttttgtgtatgtagaatcaaatactacaaccaaaccaatcagagaagggtgaatggttcgaacactaaaaattaaaacttttagcaaaattaaaagattaccctcaaacttgatgaaattgcgccaatcgcaccgccatattgccaccggtctgaccgcagccttgccgccggttggaccgcctccctgctgtcggtgtgaccacccgccggttagaccgcacaatgaaccctggccaactcgtcaggatctagaaaaacacatatcgatgaaactcttgaaggtaaatcaattttgttgcatcaatatgtgtttacaaaatgtatctaaatcacctctctctctctctctctctctcaacttagaactaggattaaaacctcaaagcaaacctttttttttctcccaaaaaatcgatatccttctagcatcaatctctcttcgatttatacccacaatgtggctgtccatatccacgaatccaaccataactagactcttaaacataggaaatttaacaaaccaacgaaataacatcctcatacaactccacacttcaatctttccaaacttgaactcaaatttaaatttgactcctctttacatacacacacaacaccacgtatatgctatatggaaacattcacatgcacgtgtattgttctctagcctgagtatcccgcgtgatatcatggaccttatagaccttaacttctcgcaagtctagtcctgatccatatacgaatataaaccatctaaaagtaataaagataaagcaatctagaagttccacgaaaacaacttgaaattgactccctcctggagtctaccggtctgaccgtcgggctacccggacacctccagactgaccggcgtgcctcaccgagtgtaaacgacaacctagtaccaacatgcacggttcattgacaggaaacactattcagtattcaccgtatttttcaaaacattcacctttgacaatttattcatcactaagattaatcatcacatgattctacaggttgctctagcaaactcaaggtatgtgtaaagagctgaagatgaatggattaatagatgagctgctcaactctagccaattacattatggccatgttcttctttattatggattttggatttttgtttgcgtgcttggtaagcttctaaacggtgattttcacaaaaaaaatataaatcttttcttaaaatattttttaaagaaaacattaaactttgtagtattccctccgtcctaaaaaaagacaaaccatgggtttccgtgtccaactttgactgtccgtcttatatgaaatttttttataattcgtattttcattgttgttagatgataaaacatgattaatatttcatgcgtgacttgtctttttaattttttttatatttttttcaaataatacggacgattaaacattgagcacggaaatcagggcttgcctttttttgggacggagggagttctagttaatttcagctataaattcttctatccaaatttggagatgttgagcagtactccaatcaaaagaatgtagcactagtagtagatgagtagacgatgatgattggtctagagattagggtgggtccgttttgaaattttgattggagagccttgttttgctccaactgtcctgttcttgtggctcgctttgccatttaaaacgccgttgttgacggcgccggctttgaacgaaggctactatgctactactgtctgctgctgctagtgctagcttgctacgatgattgccaacaactctaacccgctacgcaggcaaccggttcacgcgtaaaggaagcagttcgccgccgtcgtggccggcaagatctagcccaaaaatcatctgaattctgcctctttttgaggcaaactcgtctgaattttggttctgtctcatggagaaatcacttgtgctcaggaacatcacatgaatcaccaagcattggttgcatcgatcacagccgttggctacaaacggaatttcaacaatcatcatcatcgtacaccgtcgatcacacacacacgcacgcacgcacaccatcattcacaaaatcacgagcaccacacccaagtggcgccacgttgcaccgtcacgtctcagcagcagcagacggggcacctcacgatgccgttctcgttgcactccgtgcatcgccggaatcccccgccgccgccgccgtccaatgggttctcgtcgtcgtcgtcgccgtcgtctacgtacaccttgcagctgcccgagcacgcgccgcagagcacgaaccggacgtcggcgcaggcctcgcacgcgccggcggcctcgccgggcgccgcgctctcgcacccggcgagcctcgccgcgagctccccggcctcgtgcagccgcttcagctcgtcggcgttgcccacgagctcgccgtccacgaacaggctcggcagggcgggcgccgccgccggcgcccagcacttggcgagggcggcgccacggccgaggccgagcaggccgtggagctcgtcgcggaatccccggtgcatcgacacgtcgcgctcgtcgacgcgcacgccgtagcccccgaggatggcgcgcgccaggcagcagtcctcgtgcgtcgcgcgcacgccgcggagcgacgtgaagtagagcacggccttgcgcggacgcgccaccggcgacgccttcttcttctccaccagcggcagcggcgtgaccttgcgcgacgcagcggcgagctccgggggcaccgccgtgatcgggaacgagaaggagtggcgcgcgaacggcgggaccaggagcggcgagtgctcctcgaggccggccatgagcgcccacgcgtcgatggcctcgggctcgttcggcggcgtcatggtcggcgtgcgcggcaccatcctcctcatcggcggcgcctccgccgcccgcggcgcgcccttgtcgacctcgagggagccaagcgtggtcgacgtgagccgcacgacatggacgccggcgtcaccggcgcaccgggcggggaacgactggcaccggggcagcgcgagcggcgacgggcaatggcggaggtcgtgccgggcttgcctggaggtggtgcaccccatggcaatggcaatgtgaggaagctcctaagctctggactggcaatgggagtgtggttaattagctagaaacattctgtcaagtattcctaatttaagtagtggatggatgagctggatactaatctatggggattggggttcatggggtttagtatttttggggagataaaactagtgaggtgataagggtggtatgattgaatttgtcaattacttgacctaaaaagcataacaaataaatagtttttggaacattcttgttctgaaatgaatggttttggaacattcacactcacttgggagcctgggttttggagggaaaaaaatcaaatgttactagatcatcttgtaagtatgagcggctttaattagtttgagatcaaaatgctgcaaagttgcttaattcggttgcttggtaacctagtgagtagtgagaactactgtggctgaagataactccttttcagcaatgtttgtggttttcttagtcaaatatcacgcttcctttttgttgcatcttttcttcgtttgcttcacctgtcccccttgattctaggaccctgttcgcagggcactggctttggagcttcctttttgttgcacttgcacatcgatagatatacgcatgcaactttaggcacacaacaagttcaacttctgtataatacagactgtaaagtgtcagcaagcagtaataatatgagttgatgggagattgggagctggtaaagtgtcaaacagaaacggtaatttcatccattgtcaagctgatatgtagcctgtagatactgcacattcagtacataataggactacgatgccattggaaatcttagagcaatgaacatcgaaactaaaactccaagatatcacataagactaaatggtgagttggaagagaaaagtgtgaagagaagaaagtgctatccctcatgcaagaaacagtccatacacaaactccaataaaaattttgagttaaagttattagggattgtgtgttagagacaacctgtaatacatgctacctcttaatttactattacatggtatgcatgaaattagaggtaatattactcttaggaataacagagaaaacagtactattagtttaagccaggcccaacaaggggacactttcctttggtccatagtctctagctgttgagctgctatgctcacattgcttagttccaggctcagcccagcaaaaatattctcagcttttcaggctacacaaagaccatacctttcgggctcagcccaacttctgttttttaagtggttcacccaacttctctcaattctataaaaggtcaggataatggagttcatttgttcagggaaagaaaaggcaaaattggttaaatagcatcgaaatttcatgtttttttatagtaccgaaagataccggttcactttaatagcacctaaatttcacccaattttcaggggatccactagagtcgattctcgatcgttttccgtccgccttaatcgctattgacatagccacgcacacaatatgatatttctacccctcattgccatggattctacttgtatttgtgagaggtagaaacgtcatatcatgtgcgtggctgggtcaatagcgattaaggcggatggaaaacgatcgagaattgacggaagtgttaaaaatggaaacaaagtgaactttgggtgcaattaaagtgaaccggtatctttcggtgctataaaataaaaaagtaaacttttgatgctatataaccaattttgccaaagaaaatttactattacaggcttgttcaccacttttaaccctaacacattttgaccaaattttgggtagcgttcgacatgttcaatttaaagccttactaaaatttggaaataattagaaacaaattaacaacaaacataatttaccacaataaccctatttaataactacactacatgtgtataattcatatgtatacttgattaaaatgaaggttgaagaacatattccatatgcaaacttaattaaaaggaagattgggtcacacatttcctttgttgtgtcacatcttataaaaatatatttttgttggaaaaaatttaaatggtagaaatgtaactattataggatggatgtagtaataaatacaaacatcagagggagtacgaaagaagatgatgaatgtacacagttggcttgttgccttgttggtacggatccaattgttttgttgcgttgacacttgacaaccatctggacgacgtgagtaacaacgatagataaatagtgagttgtgcgcataattttatttatttatttaccacctgcagaaacattccaccatctgtcaccgcacacgcacacatgtatagtagcagcaacaacgttcttcacatcacacacacagctaacaaccgcgccggctatcatgggaaaaggagaagaaaaaaggagcagaggatcatggacggatccaagtggatcgcatagaaaaatggacctcgagaggaggtgaacatggttttgcaaaacggaagatgtggttggcacgtgagagtgggaggatgggaaggttccaaacggcttggtgtgtacacacccaccaccacgcaaataaaaccctcaaaaacaaattgtagagtaaggctcgtttagttcgcaaaaagaaaatttttgggtgtcacatagaatgtttgaccagatgtcggaagggcttttcagacacgaataaaaaaactaattttataactggcctggaaaccgcgagatgaatcttttgagcctaattaatccgtcattagcacatgtgggttactatagcacttatggctaatcatggtctaattagactcaaaagattcatctcgcaatttcctccctaactgtgcaattagtttttttatttatttatatttaatgcttcatgcatgtgtctaaagattcgatgtgatgtttttaggaaaaaaatttggggaactaaacggggcctaagagtaaccgatcctgtcggctacacgcacacgtctcgcacgaaaacttactctagatatactaccacgacatatcttcaataacgtcaatcggtaccgggcaaaattttaccgtgcgcacaaacattctcgtcaaacatctacagccgacgcgcgatgcggttaacccgattgattttacaccgcgacgcatgagaccgaaccaaaagattcgattttagcataggcattttgggagagagatatttggtgatggtggtggaggtggagagggagaggggggtggaaaatggagggggaggaggcatttgagcatggcatgagaggaggggaagggtccaaggggaaggagatggatgggcaatgggatctctcctctaactaacaaggccatgtgccgggctggcctcccaacacaaaggccaactagtccccagggccaccatggttagcattagcagggggcaggggaaatggtgggccccacacaccccccaagcccacgtacattgcacgtctcgctgtgcgtggggccccgctgttttgcagccccctgcattgcacatgtgttgatatatactatggccatagcaaatgcaaagcttctcccactagtgttaattaattaacctctcccaaagataaaatttgacaaatctgtgcgtgtttgtgcgcaaaaactgagcttatgtagcgtgcaaatgctgatgctggcacggagagaaaagatcaaggagatcaacggtggggagggggccacgtagtcgcgacattgacatgggctggatccagccacatgcaacacgcggtgcagggctcgtaccgcacatctctttctctctctctctccctctctctggcatccatttctccgtgtccttttttttccttttatttttaattttttattttattttgggagtacctatacatctttcgaaagatttttatgatcgtatcacacagatttttaatctttagattaaaatccgatagatataataaaaagcaaaaagcaattaagaaacaccataatggacactaaattaccatatcctcaagaaaaagaccaaatccaatacaaaatttaaaatttatatgcgaagattcaaaaattacagtataacttacaaaagttacagtgtaagtttcataaattacactgtaacttacaagaaaatgcactgtaaatttgagtgagaaaatcgagtgagagataagaaaaaatctttcgtgtgagatatagcaaaatcgttttatttttgctaacgcaagccacaatctggccagcatcatccatatgcgactccagattggcatcatgggttgatcgatctgcaatttgcgtatgaagcgtgtggccttgttgtttcatttttcaacgttgaacttttatggtttcatttagagtatgagaaatgcatggttaataatagcatcttttgaaggaaagatcatgagtgaaaccaaaatgccattctatattttattttattttttggggggtgggggtataactgtccagaagagagttaagtactggagtttgtttggtcctttttcttgtttgtctgagtaaattaaactggagtagttgatatcctaaaaattgatggaagtgttgaagctttgaaccatgctgcatgagccaaaaccgtaaatgaatggatgtcctagttctgtaataaatgtgtctaggaaagatttcgactacacgaatagttggagtcaataattcccaagggatatattgtacttggctttctattacatatacttgctgctgctccaaacttcttctcatctcatctcatatgcatgtaaaccataattgcacctggcagcagtggctatgatgaagagtgagatacgctactgatcatttgatcatcaggttggaaatgatttgtaaattatcatggcagtcatcatcatcaatgtagctttcagattcttttgtcaacaattcccagaaccatgtcaatcctgctgctgcatttggagcctccaactcaaggggatgtaagctagttcttttttaaaaaaaaaactaggttcatttcatctgtataaacttatctaaagggatctaagaaagctaagaaaagaggtagtactagctagcaaatgtatacatgctactagctagttcataaaggaaaaataaaggaagactcgccacgctcggtgaatgacttcagacccattagtctgatccactctgtggcgaagcttatatccaaaactttggcaatgagactggcagcacggcttggtgatttggtctcgcatgcccaaagtgctttcatcaagaagatatgcatacaagataacttcctctatgtgcgcaacatggtccggtccttgcacatgcaacggaaaccatccctcttcttcaagttggacataacaaaggcatttgattcagtatcttgggaataccttgtcgaaattctgcagtggagaggctttagtcagcgctggagaaattggattgtgcttctcctatcgactgcatcatccagaattttactcaatgggatagcggaagaaccaactacacacaggcgaggcctccggcagggtgatcccctcttgccctacctcttcatcctagcaattgacccgattcaacgactactcaataaggccacgcaagaggggcttctatctccgttatcaaaccgagcagcgcggttcagaatatccttatatgctgatgatgcagcgatctttataaacccgatcaggaatgatgccaacaacttgattagcatcctcaattcttcggcgaggccacaggccttcaagtgaatctgcacaagagctcggtcgtgtccatcaaatgcgcagagcagaacctgtctgaggtgttggaaaatttcaatggacagcggggcaattttcccataacatatttgggattgccgctcaccccaggccgcatcaagagaatacacctgcaaccggtgatggacaagttgcaatcaaggttagtgggatggaaagggaagttaatccagcaatcagggcggaagacgctagtcacgtctgttctcagctccataccaacctacttccttaccgccttaaagccgcctaaacagttcctcacagacatggacaagattaggaagaaattcctctgggccggcgatcaagagattagcggggggaagtgcaaagtgaattggaaaaagtatgctccccaataaagatgggaggactaggcgtgttggaccttgataaattcgcgagagctttgagactccgttggctatggtttgagtgggagtgccctgacaaaccttgggttgggacaacaccccactacgatgagttagatgagcaaatcttcgtggccgcaacaaaggtaacaatcggtaatgggcagaaggcaaaattttggacatccaactggattggacaccagccgctgaaatacctagcgccagcgcttttcaaccactctaaaggaaagcaacgcttagttcaggatgcgttaaccaatgacaaatggattgaggatattaggcatgagctgtccatgccactgatccgagaattcttcgcagtgttccgccttatctgggataatgagacaaacctggaggaaggagttgaagacaccatcacctggagatggacaaataccggtaaatacacagcaaaatcggcttagcccaattcgccggtagagaagactcaagggccgccaccttgatttggaagacatgggcgccatccaaatgcaaaaactttgcatggcttgtcctgcaaaacaggatatggacatccgaccgcttgcaactccgacaatggcccaataactacttttgccaactctgctacaggaacttggaaacggcgcaacatttattcaagaattgtccattcacgcgagaaatttgggacaaaataatggctaggatgaaccacaaccaacccttcccggtgcacaatccggacgagagcctagttgactggtgggaatcaagaacaaagcaacaaagcaaatgtcaaagtaaggggatgcagtcactgcacatgctcttgagttgggaaatctggtgcgagaggaacagacgagttttcaaagataaaagaacttcaaatccctcaactaacggcaagaataatggacgaaatacatggtcggtccgcatgtggggcaaaaaatcttgcgagaatagcgccttaacctctcatcctttgttgtaattttcctttttttctgctctcctccccctgtctttccccttgtcaccattggtggcatttgtacagtgcttatcttctgaaatataaaaccagctaagctggctaaggtttcaaaaaaaaaaaaggaacagtagaagctaccatcctactcatcttgaggggttaccttttaggaagcatggtcctttgtggtactctttgctggcatatcatatatcttaagcaatattgtctgctagttattagagcaattttcttttttgatactctcaaaaataataaatttattccagattttttttttgcaaaactaaaattccccaatattattattattttttctttttgataaacaacatcttgttaaatttccattccctcatctatagccatctctctctctctctctctcacacacacacacacacacacacaacacaaagttctcactctcaaatactcgcgatgcgcctcgccttcctcgcttgatgagctaaggagatcgagttgaggacaatggccagcaatggcatggcgtcctccccttcctccttcttccctccgaacttcctcctccacatggcgcagcagcaagcggcgccgcctcacgacccgcaagaacaccaccaccaccaccaccatggccaccatggccaccaccatgagcagcagcagcagcagcagcatcaccaccacctgggtcctcctccgccgccgccaccgcacccgcacaacccgttcttgccgtcctccgctcaatgcccgtccctccaagaattccgaggcatggcgccaatgctggggaagcggccgatgtcgtacggcgacggcggcggcggcggcgacgaggtgaacggcggcggcgaggacgagctgtcggacgacgggtcgcaggccggggagaagaagcggcggctgaacgtggagcaggtgcggacgctggagaagaacttcgagctcgggaacaagctggagccggagcggaagatgcagctcgcccgcgcgctcgggctgcagccgcgtcaggtggccatctggttccagaaccgccgcgcgaggtggaagacgaagcagctggagaaggactacgacgcgctcaagcgccagctcgacgccgtcaaggccgagaacgacgcgctcctcaaccacaacaagaagctccaagccgaggtaactaactaatcaaaatcaatccaattacgcattcgagcgtttgatccatagatctgcgtgatcgtggatgatgcgtgttgtgtttaatttgtccatgattaattttcccggggctttccaagctcaatgattggttggtgatgtcgatcttccctgctgctgctgctgctgctgcctgcgttggcaggaacggagatccatgtgggtttcagtgttggcagaaaggttgttggaatcggtgcctttctcaccaccacgagtacgtcgacgacggcagcagtagctatagctttttctcgcgaaaagttcagcagaatatgcagcgtttgctcgtgctcgtcgtcgtcatcaagctggtgagatcgatgtatcgatcgatcgatgggtggattgatcgtcggaggcagtgcaggtttgggtggtagctgctggtgcttttgctgtggtggagtcaatggcctcatcacacggccagcctcgttggcaagtgtagtagtactagctagtactaccagctcttggggccgggcatgcatcgcatctctctgtgcctggtcgcagtgttgcatgtgctgctgcctttttcctgagatcacttcttcttcttctcaacaatcagatttgcaatgatgcgtgtttgtgtacccggagagaaagagaaaaaaaaagcacaattagtacttctatgattgggcatcgatagatgatcggtgcaaaaaacgtactagtagaagtatagctagctagatataccttgtaactaatagtactagttcgtgttgcttttgttaattagtactgttttactgaatgattaagaaggaaatgtgataaaatgcagatagtggcgctgaaggggagggaggcggcgtcggagctgataaacctgaacaaggagacggaggcgtcgtgcagcaaccgcagcgagaatagctccgagatcaacctcgacatctcgcgcacgccgccgcccgacgccgccgcgctcgacaccgccccgaccgcgcaccaccaccaccatggcggcggcggcggcggcggcggcggtggcggcatgatcccgttctacacctccatcgcccgccccgccagcggcggcggcgtcgacatcgaccagctcctccacagctcgtcgggcggcgccggcggacccaagatggagcaccacggcggcggcggcaatgtgcaggcggcgtccgtcgacacggccagcttcggcaacctgctctgcggcgtcgacgagccgccgccgttctggccatggcccgatcaccagcacttccactgatcgatcgatccatggatccaaccaaccaaccaaacaaccattggcaacaacaaactatcttgcagtgatgaagcgatcgacagtatgtacggggtgatgaattaacgatgatcacacaccaacgcaagcgcatgcacgtgtgtggaagattcagacgcatgcatttggattaattcttggagagatcgagcaagcttaattgggaagaacaatgagaaggttgtgtatgatgatgatgctagctacgagtattgaggtgatgaatgcattgaatttttctcttgggtttgaagaggatatcgaatcgaaggaacttgtagatgaataagcgagtgagatggaacgacgtacgtagggttagattttggagttcagtagtagtatattctgtcactttttatttattttttttatttattgggttcttattttttcccctttttctttacatacataaatttgtgaactttgtgaggcagtgtttgttgtgtataggtgcatggtgattcttctttcttcccctaatctgtgtggatcatgtccctgtgttgagaaaaatgttcattaaatttcgctctagcaatcacacaattgagttgtaccctataattaattccattgatgtttggctaggtttttgacacataagctcgtgcaaacatactgaacagtacgtacttgtgtgaaggcaagaacacatgtacatgtttctggaagaaacttttcttcttctttttttggtagaaaaggaaaagaaatggaccaaagttttcaacagttaaattaagcggtgtgtggttgatccgtgcattaatcctagctcgtgcatgcatgcaaccctacaatgcaatcaaggccatttagaaagaacagaaaagcatggacaccagcaatatttaaatttggcagctctgtctacatatcttgttggcccccttcatctttgaaattaagttttttgttacatcgccacagtttgtcacacaacaaagttaggttaatttttaccatgtctagctactatttggttcgtgactagtgactacaagattcacgcagctggcttgtgcatgtagatctagtatagttattcagaagttgtctctccgttaatgtcaaaactttgtagatttcattacttgacgagaatatggtcatgaattatctagttatagtgataattataggaataaattaaataacctaagaaataaacttaacaaatagtagctcgaaacaattggtccaagcaatgcagtagttttttttcctttagataacataatttttaggggtgtaaagtaaataatccataacaataaactggtgaatctcagttgaaaagaactaggcttagtgaacaaaaatattgaaataaggactccatatgcagcgtaaatcttaagcgtttatttttatcctacgatatatatatatatatatatattttactttttatcctacaatactttttagggtttacactgtatataaactttgcattatatattttctattgtagtgaagttatatatgggtatatattttcctcttctacctgctattggctcagtgtgtcgtacgtactggacatcagtacatctacgtcgccatctgcatcggccttatcacctcactggcagctacagttgactgaaccgggcttggctagtttgcctgtctgaaagtgattggcgagatggcagctaaggcacaaaacagtgccagtaaaaccgggagtttattcgtacctcgagggtacgttttcgatttcgttgtggatcagatctgtctctcaaatttgtcaccgtggatcatttcgtactacaaaaatttacggcatatgaggagtttagggggatcagagaccattgatgttccaactgaattgattcgccagtacattttggaattggatcacggggaatttcatatgaaacggttggcctaccaactatagcgattggggaaaaaaatgtacatatatgcttgtggcggtaaaaatatcatatcatttcagaggtgacatcgttcgtgctacggatgataaatcatgaaaaaataaatgtaattactgaataatttatgagtaaatgttttatatctgtgacgttagcggtttagcatcaattcttaaaaaataaactactaagaaataactgtagaattaaattaaatgtagttccaaaatttagttttaaaatgcaattaataagcaaacgacgagggacttaactcttttttttattacaacaaaaatttgttggattggcagggtaggtcacctcagctcagcaggtcaggtccacagctgagctagctcatggaagaacaatcgcttgtgggtggatcagcagtggaggggccgtgcacacatcgcaggcagaaaaaccaaaggaccgtgtccggtctggccccgtacgcgccccggccctatcctcccctccaaccccccctctgtggtccaccgtggcaccaaaaaccactgcctttttacgacgtcactccctcaagtacatcctcacaatctttacgtgtacatgcattgatccttttgcattatagcctcctctctcgttaattttatttaatcacgatacaaacacagacataaagacggaaccgacataacttaaaattaataagaccaccttaatcatctcgctgtcgatggtattgctgtcgaggcataccttaaaggttaagtcatcttatttgtcttactgtcgcaacagtgcatcgtttgtcattgaaagaataattaaccgtaaatacaaacactcgtatcaaatctacatcacaggatacctagctagttgagctgaactcacttcgtcttttctctcattaattaattgtcccatcgattgaaatgcattttttttcatttttatttatgaaggacaagatcatggtcatggcaacttaattacagggcagtgaatgtgtgtgcagagaaagaggagtactagtgtactctgagcagtagagatcagttcagtgcgcgcgcaaaaataactgccatggacgatctggtccagatgtgaggtggtacgcttactactatgtagccgaatatagggatgcaccagcaacaatcattattcattctctgttccatgatcaggaagagaaatggactcatctaaaactcgtctttaaagaaaagcgcatagaacattccatccattaattatcactgaatttgataacgccatgtcaatggttgctagcggtatttctttttggaacttgaccttgctaattatagtaagaccatgtacaatagcagactattagccagctataaatatatattaatgagataaaagatgagatagaagagcagcgggctacagatatgtagccagctgcagcacggacttcaagacacagtgtgtgtatgataggtgggactatatatactaataatatagtaagcaactattgtatgaattggctattaaattggctatagatgaattggagctagtagtgggctatgctattgaacttgctctaagagaagtgcactgcttatttattcgtgggatcacattaatcagatgggttcagattatagcagtttagatggattgggtatatccgtatatgctagagcactgctaaagatgaatgagataaatatttttaaaataataaaaatggttcatatttcaggcttccgcccataaaacacacataaaaaaaagtcccaaaagata

SEQ ID NO: 66574 - DNA, 2142 bp, Oryza sativa
ccctcctccccagcacgcaaaatgaagttcgttttattgcatgattaattaagtattaactgatttttttaaaaaatggattaatatgatttttttacacaactttcatatagaagtttttgcataaatcacaccgtttagcagtttgaaaaatgtgtgcgcggaaaacgagatagatgggttaggaaaatgggggaaagaacacagcctttgaagactatgccaagtttgatcgtaccttaataagtgagatgaatggagtactatgctaagaatattagggtatgatattttctaatatttttatcaaaataaaaagattatgccactttgatttaatctacaaagtctgttttttctctaaagaatttaagcattggagccatgtcaaacagggctgatttgccttttatgctgcacatatgggatgacaaatcttggaaactagatgataccccgcgcgttgctgcggaatgttggtgtataacatagttgcaaaactataatatgtaaatcaaatattgtaaatcccactaagaaattagtcattaacagtcaaaacaggatacatggaggttagaaagattatgcaataatcttacccattagcaatcacgggctagccaaagtacaaattgcagttagcagattgtattatcaatgttctcataaattaattgttcgaagaattaaatttattaaaaaaaagtgaagttttgtgagaacatctcaatcaacatgtttaactcgtacatcagacttcctcggccaacatttaaatcatcacgttaattcatactgctaacttcactggctcaaaggatgataaatatatttatgtagagattaagcttatatggtctattatataactatgaaatactactacatgactaacacatctaggaatagaataagaaaatcaccttatgaaatcatgaagttgatttatagtagctgacatatataaggtctgaaaaggggtaaaatcacatattattcattgcgctatgctgcaaactggatcgaattctcacctgtggaatttttttctgcatgatagaaaattatttgataagcagaaaaggagtgcagccttgaaattttccgtatcactctcatggagaggaaaactaagttatcgtcagcaatcgtttcttggaaacgtaaaattctcttcaggaatcagaacagaattgaatacaaaggtagaaatgtctaatcaaaatttacctcgtcaattagggtcagatcgatcatgtaagtgacattacaaaagataaaacatagcgatattatcaagttatatgtccaaaaatggggcaatcagaagaacacatgcatgctattttacaaaaaggcagaaaaaaatgagtacaatcatcaactcacctaatagctatgttccaatttggggatcgagaaaataaactcagcattggagaacggaagaaaacatgcacctgatcaaaaacttgaaaactgatgggattaagaacggtaaacacaaagaagacaccatgcaatcggctaatgttgaagctaccatcaaatcatgtagccgaaggacaaattaaccatgaaccctgtaatatgcccaatatagtttccagccaatggggcagactgaagaatacctaaagcttcgctatttgatgtaaggggagaaaaaaaaagagagtacagtatagacatcagcttaaccaaaagctgataaatttgggatcgagccaatgaactcaacgtaggagaataaggggagagaaaatgtacctcatccaaatactgatgggagtaggaaagataaacaccaggaagacaccaatcgcctgatgtcaggagctgcaaatgaaatcatgttgacggaggacaaattagttgtttaccctgcatatatgccctatatagatctcattcccagccaagatcgaccaatgttttctgaatcgaaagatcaaatcaatgcccggataatccatatgagccaccagatgaattggacgggaaattgatgaaagccctgataatccgcatgagtactggataatgataagatatcgtggtgagcgccgcgccgggattgaaagcctgcatacttgatactcgcagagcatcgggagaaagcatcgatatttagcatga

SEQ ID NO: 66575 - DNA, 890 bp, Oryza sativa
tgaaaatactctctgaaagagcataatattgtaatcagtggcacatctctcttttttttttctcaggcagaaaagcttttcattatatgaatatgcagcagcttacaaaaataatgcatcgatcaagcacatgtaatgtatatatgtacagtacctatagaatgactaactttggccggccttctatatttcttgtgtgtaaaaaaggctatgcatatataaaaagaaaaccataagagatagatatagaaaagaatgaagaactgcaactatatatatactttgtaggtagtctatattactccagagattctcaaggatgaaagtacaacaaaaacaacccaaaggatcatgaagtacactgatgttgcccaagcccacatcctagggccaccaagctcggcgccaagtatgacgcgacgaagaaccaaaaccgtgatgcaaccgaacgacgtcgcgaagaagaccagaagggagaagctgaggccagcagcattgtctatgtacaggggcttcttgtagacaaaactagcatggtggcccgcgcacattgcgcggctagcatcattatattttctctcatataaaagcatatatcttttctcattatattattataaaatatattacaatgacaacataattttaaattttgcaataacttttcaaaactactaacgtgtaataactactctagtctcctcttctaatatttcttattttttaattctgaatttcagctatttctaaattgtatttctatatgtactctgccttttctttttctctgattaatgtgagaatttctaggccatgagagcgaacgtggaggctcctttttattccgaattttagttggttttaaattccaatatgaactctatactcta

SEQ ID NO: 66576 - DNA, 6994 bp, Oryza sativa
tgttgagatgcaatggtacaatgctaagcacctttctttttaggcaatgcttagtattcatgtaataagggagaaatgtgtaatacaggcaagttctatgaggattcttttggaagatgcggatatgtgattatgtgtataattgcttactgataaaggagacctagggtctcattccagaggaactatgttctaacctcgagttaataaccaacctgatgatggaaatgaaaatcaagcgattaaccaaagagacatttgtttggacaagagtttcagatgtgtctttttcggatgtcagggttgaatgtgtaaaggaatactttgaatgctaaataatgacaacatgaagggaatagtgggaagtaaactgaatgtaaagaaagtgaatccgagttgcctgttcgtgggaactattcccagttatgaaccaagtgaaatgttcgaagatagtctatagaggtcagattaaaattgcatctaacaacaaagcttcagatttggcaggaaaacgatcagacaataacaagttcagcagtaaagtcatttaggaagacgtcaaagcatgtcaagtgggataagttggttctgttgagaaacataattcaaaggcaaagttatcgaccctcgcatcgaatagcagaagtagctagcacccggagaccaggaaaactaatatgaggcagtttgtggcaagatagaagtaaatgacaagcatgatattcttatgatgacgaacatggtatcctagtaatgaccagctagtgttgacgcatgacatgaagtggtaacttgtatgaggttgacgccaaagatatgaactatgagaagttctggatctgaagccccatcatcaagtgccacaacccagtcgaagtcagctaaaggttcaaccagggacaagtcgggtgaagagaagattctatccgcaacaggagatcgagacaagcagtacagagtggagaagttttgctaggcaagtttgttataaaagacgcgatggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatacgtgcaagaaaaattcgaatgtggcccggagaatttttgttaaattctccttggtctaaaaagagccctcaaattttacttgaattttcagagcaccggaaataattattaaacaacaaaaacaattatcaaagtttaataaaaagaaaaatctaaaaataatcctccttttcttttgggccaattttggcccaaagtccttcctctctcccctcggcccgcggccgaagtctccctttcctccctctctttctctccctctccttctctccctcctcttgggccccccttcccctcggcccagctccctcccccctctctctcccgggctgcctcttccccccccctcccctcccggcctgcccggcccaggccgcctccccctcctctcctcctgggccggccgcccggcccaacccgagcggcgccctcccgcccgtgccgcgcacgtgcgcgcgcctgcgcgccgttgccgcgcgctgagcgcgcgccccgcgtgggacccgcctgccaggccggtcatcttcctcctcccgcacggccctctctctctcccgtgaaaaccctacttagttcctccctcgaatccgcgcgatttaagcgttggattccaaaattaattggggggttttaatccccattgaatcctcttcaattgcccccaaattcccccttgattcgtgccttcaatcgtcgggaacgccgcgccttcctcggctgcctcccatggccgccggccgccattcccgtcgccgttccgccccctcccgagcccggctcccgcccccatcctataaaatggaaccccctctttgcgttctattgttttagccctttctcgagctcccccgcggccacagcacccctccccgccgtcgccctctctctcccgtgccgctggacgcctccagccgcccctaccgccttgcctgagcgccgcccggccgtgccgtcgccttcctcggcctcgcagccacctcctctccctcggtcagccctctgtttcgcggggaaagcaccggagacgcgtcctcgccggcaaaacagtggcgttgccgccactgttccacctccggccgccactgtcgcgtttcccgtgcgccggccgacgtcgccaccacctccctcggctccgcgacgccgccctcatccccggcatcacctcctcctcgcccgaagctcgccggagtggcctcctcgtcggcgtccagtacctccccgcctccggccggctcctgtacgtcgccggtacgccgatcgacgtcgccgcgttgtcctctcctccagctgctcctctgtttcgccggaacaccgtcgcccgtgctggcctctccatcctcatcgtcgccgacgtcccttcggccgcccgttcatcctcgccggctcgtcgtctcgcggtgccgcctccgtcgtcggattcgcagcggcgcgttccacgtcgtccccgtctccgtgcagctgccgccggctgccctcgtcgtctcctcgctggccccggtcgtcgtcgtcgtcgtcctcccgtcgttcccggtcgtcgtggcgttcgtccctccgtcaagccgttctcgtccgtcgtccgcgtttgtcaagtgtgccgctgcagccccgtcgtcgtcttcgtcctcgactccgcgtcgtcacgcctcgtgccggccgcgtctcgccttcgtccaaggatcgccgccgaagtcgtcccctcgccgttcgtccccgtagttcccggccgcctccgccgcgcccgttcgtcgttgtcgttcccacgcctcgtcgcgtggtggtaaggatccctccccctcgctgccctgtcctcgtcctttcggtgtcgcccgtgcccgttgtgcggttgtcggccccggtacccgtgtatcggtgtcggcagtcgttcgcttgtgcgcgtggtgaccgtgttagtgtgtccgctcggtagccgcgtggtttccacgtgtgcaacccgtgtggtgtttagtggagtccgtttgtcagccactcgcctcagttgacacacgggatccgcttccgtcgacccgtggaccgtctctgtgcactcggtctaccgcggtcctttaggttgacatgtggggtccgcatgtcaacagcgcagccttcctgtcttttctaggctagcgcttacacatgttttatagttgcaaagcttaattataataatccgcaaatctccatgtaacagcattaaacttcggatgatcatatcttggtcatacgaactctgaatcgacccgttcaagtctcctaatgtttgttataacctaaagaaccctgtgttttctttttatgtattgttattgcttctttataggcttgtagctttgcttgtgtgcttcgcgtagcttctgtcgttccggaggttcccgaagcgtggttcgtggtcgtcgccaaaggttcggaaggccgttctctctgagcaaggcaagtcacatcatccttgagcatattgaatcccagtttataaaattattttaatttaaattaatgcattatcgctttatttaaattcccgcgttatcactgttttatttagccatgcctatttacctttgttatgaccttattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccgaccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctccagggcaaatgaaggctacacgagctgcggcccggtagtcgagatgtcatggcacagggttggtgtcctgctgctaggggctcagtcctgcctgcctgtcccgggggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggtcaaggcaggttcgtgtgggttcacggccttggttaataatactgtgtagctctaggatcgtctttataaaatggctttgggcaactaagtgacttttaaatgctgtttactgcaaaacttaacccctatattattaccccttgtactcccttgcattaattatgcatctccggtgtggcttgctgagtactgtggttgtactcattcttgctcaatctttcccctcttcagtaagagaatgtttggagaagatgtcttgggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaatgaaattttcccggtcgcgacaagatggtatcagagccatctcgactgtaggataagccaagtggataaaacctaaggacatattttataaataaaactatttgtgaaagtccctttttcctcctttcccctgtgctatttgcaaaatgtttattctcttttcttcctccttcggattttcaactagtactagatggtcaggtcagtgaagaagaagacatcgtcagttgtctgccgaagctccagaagactgcaggatccgctagcgaagtggaggaagcagtgaagccagctatgaagcaggagtgaagatcttgggaacccgtcgcagaacctaagccaccctatagggtagtgttgttagtcgcgtgttccttgcttgtgtgtgtagcgcgtggtttgcatcggggggttgtgatgtaaccatgctaggttgtttgcttaatcaacttgcagaataagtgaaacaaacagcacatcaacaagaagagttagttcctttaaggtcctatccctagttctggtctattctttcctggcttgtttcctctctcacctgaatccctgtaacagatgtttaacagagaaaaaggaaagaatgtcagcgggtatacctcaagtaactcaagttttcaactcaatccaccactggcccccagagagttaacaagggcacacccttggtccattccgagcatgctgtttagttcacagctaccattggttggaagtcaagaccaaaatcagtatgtgtttgatcgagcctttgccacccaagtcaatgagcttccaatgccagaagagcaggtccccttttgtcatgattgtagagagcaaggacactatgccctgaattgtccatgggtatatgtcaaagaagccccttccctggtttagcagggcagacatcgctaaaccagcctcctcacaccaagtcaagcttgcagcctagtgtgcaaagtagagagctcaacggagagaatccattgaatcccgggaaatgctttcctcctagcctctcgtaccacgtggggtcacatactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaatactttccgaggtgcacgacagttgacccagcacctcttaagccatggtggcagagtatctgatagtgaagggtcagatcaagtctcctcggatgatgaagatgagtctccccgacatctcggcgaggaagagatggaatcaaaggcatgcacccgttgcggggaaattgaacacgttgctagcgtgtgtctcacactctgcactcattgtgaagaagaccatccaccaggggagtgtcccacccgcaaggtcacatgttttctgtgcgaaggtacaaaccatgtgcccaaggattgccaactcagtgtgttgttgaccaagaccgcagaaatccaacgaacaaccctacgattgtctcatcagctagtcagctccaacagcaacatcgacgatatcatccacagcaccaatgctcctctcgctgcacctgactctgcagtaagtcatagcgataataccttcagcaccaaccattctctgcaccgaccgcctcagcaaagaattgtcatcgatggaagaagttgtgtctctccccgacctactccaggccgagccaaggacaatcaacctccggagggcgataccaagcagaagaccgttattcgcctcaaccagcaatcagaaggaaacttctcctgtgaatgatagcaatatgcagtcctat

SEQ ID NO: 66577 - DNA, 3433 bp, Oryza sativa
ctctgaaagtattttgacacatcaatggtggtagtagtgatgccatcttcccaaccctctaaatgactcgtccatgttgcatgtgacaactcacgctcgcaaaccagaacctagaggacgactacgattggagcggtgatcatcttaatgttgtgtattctatttattgtttgttgttgcttcaagaacagactgcttgacctacaaagcaaacaatcgtccccttccaccctccgcctttgcctccgtgctgctgctacttcaatatagaaaggacacaaatagttaaaatggacaatcgtttgcacataccctctaatttattggtacggtcatatatatatttttttgaatgaatgcattattttaaaagttttcacgagatttaatttaatttcttcaaaaagaaaaccaattccacctatttcttgaaagtcgtactactatgtctatactaatatgattttcacatgacccagtaaagatcagtctccggtaatgatatatgtgtatagttattgtatttcaagcaaagttaaaaaaagtaatccattaagcaacactgccgcaaagatagcatacctccgatccatcaccgcccggctagatactcccttttttttttctctcgcatggaccggccggtcggcggacccgggcgtatatacaaagcctatttctccgtgcctttttgtctccccacccaagatgagcgtaccgcacagtcgcacacaccctccctgccgtagcgtatataggcccagaaagcaagagtcgagagaaacagaaagacgccgagacgcggagaggtgctggccggcggccggccgcgcgcacgcccgcacgcgcgcgcgcgcatgtatatgctgtctccgatccgacgcgacgatgctccatccgatccgacgcgacgtgtggagctagctagcgcgagccgcccgtacgcgatgtacgcccgcgcgtgccgcggtcaaccgggatgtggagtggatcgcacaggatcagtactgctgctgctgctcttttattgctgcgcggagtgtcggagcgctagaccgagagcccggccggccctgaatcacgctcgggtgtgaccccatgaggtgactagtgatacggtgatgccgcgagctttgcctcttacggcaagtacaataacttgaaattaccggctaatagtaagcttacgttggattttatacctacgtggtggagagagagtaccaagagaaaaacatcgtcgattaatctgtcgacgatcatgcacgggcaccaatacacctagcactggtttgaagcctttctatcgacagcaccatcgacggaacaaaaaattagcatgaataatctttcctgattggcttggaggaaagagaaaagctgggaaggagcgagagagaagtaattaaataattattgatatgtgtgctgcagtaaatgtaaagagacaactattatatttattatctattaagttacctccaaataacgtgtataaagattagagtaagcagtcgtcttttttattgcccttgcccttatctcctctgatcacaactacctcgactgagtgcgtgcgtgggccatccgtgtgcctgcctgcctcactggccgtcgtcatatgacaagcaatgtgaatatagtgcaccgggcacggcctgtttgctgcttgcattccctgcgcgcggcaatgtatactgtagatgaccgtgaaattcagcagtcgatgaaaatctgaaatacttccatcgagagcatcggctctgcgccggatggccaatatcaatcaatcagcatttaatttgacaattttaccttttgtaaaaactaatttcgcaaataaaccgcggccaaaactacccttttatttagcgtcaaatcgtatggcgctaaacttagacatatcagcgtcaaatagcacggcgttgaatgcacgttggcacgccgactcagcctcccatccgcggtggcacagcattcagcgccagttgacgtgatgctgaggtgtctaagttcagcgtcatacgatttgacgcttaacaaaagggtcatttttaaataagttttggtcgcgattcatttgtgaaattagttttcggagaggatcaaattataaatttttgtgaatcaatcagtccgtcctccatatgtaatcaagagcgaggaaaaagtacaccgaaggtccctcaacttattatcgagttataaaatcatcccccaaccgcaaaatcagatatacggcgtcccttaactaatcaaaatcggtcccaataggtccttcggtggttttgaccccgattttgtcctacgtgacggctaagtcagcgtgggacccatgtggggcccacatgtaaggatgccacatcatccttctctctcccctcttctcttcctcgattcctcctctctctctctctctatgtgcctgtagggcgccggtcggcggggcgaggcgggagaggaggagggcggtgccgcaatggcggccggcggtgacggccgcagtggggaagcacggcggcgcgggcgggcgacggggaggcacatgcgcctagttggtggtggcagcaaccgtcgttgatgcctggcacggagaagcccatcgccgtcgcggcggtgcgctcaaccgcggaggacggggtcgaagaggtcagcatgggcggaggattctggcgggaggaggaggaggtcccggtggaggagcatggggagcacgagctggaggtgagatgagggggagttctcgaagctgccgacgccgaaaagcgatagccgcatgggggcgaggcgacgcggtggcggagacacgggagaaggggtgggcggcggcaaggcgaggcggcgtcggcaggcgagcgcggtggcagagaggcggcatccgcatggtcgcgggcgacaaggaggcgcgggcgtcgacggggagacgggaacggcgtgggcggcggggaggtacggccggcgcgggtggcgaccgccgcgccacagcgacgtcttcacggcccacgccgccatgattgttgccttcttcgtcttgcttggggccgccaccacgccgcgagtgccaccctgcgcgcggctaggccggcccgcatgggcgccacctccgcgaccacctcggtgccagcccctcctttccattaccaccgccgcgcatagtcagccgacgctcaggcgagcacggctgcgagctgcgccgtggaggaagaggaaggcgggtggacatgggcatcggtgaggagctcaaggaaggagaaggccgggaaggtcggcgtcgtcttgttcctcttctgccattcgccaattgcatctagggagagaagagaagggggaaggagacaagcaacagcccctctccgctggcggccattgcgagacagaaagaagagaaaagagttgggactatcatgtgggagccgctgctgccgtgttgccc

SEQ ID NO: 66578 - DNA, 2070 bp, Oryza sativa
cccttttatcactttcgccttttttccaacctcgctgctcttccaagtgaccaatggcagccacacagaaacacctgtggctggtaaattaattaacacgcctagctggctctgcacttcttcagcttgttcaatgatactactacatcaagcttgtatagctagctagctgtagtagtgtacagtacagggccacagtatgtacagatctgcaacaagctgtacaaatactcctacatgagtgatcatgctgcaggaaaaacgtacaccagaaatcagaactcacatgagcatgagcagactagactgatctgctgctctaccagagcacctgtattccaatacgctcctgtcccctcaacctttctgtagtatatactaagatctcaaaaaaaaaacattctgaatactatctctgtgactgacttgtgggcccggaggcgatggtgctcacagggttgcagcgtggtgggcccggaggacgatctgtaaaaatatctgcgcagagcctttttgcgcttttacagttgtatttgtatacgctgggtagagtacatgcaagtgtacaaatacagtagaatacgggttggtggcgtagagaaaacctggagactttgcctgccatgatggcgtacaccgagctaagctgctgctgctgcaggtgggtgtgtgtgtgcggggtggggcccgacgaggattggcgagaccgcaacgcgccctccccattggccggcctgggccccacctcgctcgaccaaccgggaaacgccacgtcggacgcagagcggtagctaatgattcgtggcggtccggccgtgggtaaataaccgcaggtaattaccccgtttgtggggaggctttatgattgggcttaaaaaaaaacctagacaatatcctgttggaacggaatactcttatataagatagtacctgatatctgttgtggtactagctgtatggtacctgatacttgtgatacctgttacccgatacctatgatatctaggacctgatacctgtgaaactcgtgcaagagaatagttaatatgctttatcttgttgtaatgggatcccgttttgtagcagccctcttaggcttaaccaccgccgcattgtaggagagatgtgtttttaccgcgatggcggccggcacgtcgaaagatcaaacgacacgcgtatgtatgtacgtatgtagatgtgtaagtaattaaggattaacagcggattagcctgcaacttagcgagtggtacgtaggttctaatagctgtaaacgacttgactatgagtggcgttttgatgcgttgcgtgcggcggtgcaatatttttcgaaggctcgcttttcttaaccggagaaagttacagctcgtactcgatgggaggaagaaagggagaagaaaaaaaaagttacagctcgatcgttcgctagctaactcgtccatggccttcccataattctgcatgcaagtggataagatgttgcgtctgtgggtcccacgttaccgggacgggaagaaggaaaagagaagaagccccatgatcggtccatcgatcgatcattccatatgttcatgaccatgtcgccgcaccaggcaaaaatatacattgtggttcaggtctgcatgatcggtagcattggcatggatgcagattcttgtaccactaaaaatctgctaacctgatttttttttctcaataaattaagttttgctaatcgatcgcgaacacaaaaattcctaatcttgtgttaattaacactgcctaatgcctgcaacccaggaagttaattagcctcttcatacgcatgcagctgcagccggccgccggcatacttgaggtctcttgctggccgtttccaaactcgtcgttgatgatcatggccatagccaccgcatggtgcatgcatgcgcgagaatatgtatggccgcaactgctgttacgtacactaatatacggagtataccacaggagtgcatgccaagcgcttaaacctaggtgcaaagttccaaatcacaagtcaaaaaggccaaacaaacagtacgcacgcacacgccctcgtttgggcagcacgc

SEQ ID NO: 66579 - DNA, 14824 bp, Oryza sativa
  unsure (1)..(14824): unsure at all n locations
ttccccagtctgatggtagttgcctacttgggacagccgaatctgcgaggatcttcggtgatccggatcagaatttccatgtctgttccaaccgctatggatcggctgcatgtatcagcaggagttcttttttttaatgctacaattctccaatctctgaacatgtgaccaacaaccaaacagttttttttttcttttttcatagaaacttgaaacagggaaatcaatcagtggaatattagatcgaccacgatgcagcttatggcatactaattctcaaatcaaacatgcatgcagttcacaggatctgaggaatttaagctaagcattgacgcgggataatcttgaattcttgacaaaaataagaggagcagtttatgacagcaaatattcacattttgaaagtgtattcctcaaagattcattctacaatgttctgtagttaaaaccacaaagttccaatatcctacagcaaatttggaaaaaaaatatatgatgcctttagactcttgtttaatgttcctcttcaaagagtaggcaaagctagcagcaatgcaaaaatagcttatcttggcagaaacagtcattttcacgggtccggaactgagttgaagacagcatgataattggagagatcatagaacgaagttgactagtccctgttgccccagtttcagacgttcctcccaactctagtgctcgactgagggaggctaactttgactctactcccaatatatgtccttctaattcaggtcggttttagattgcataaattaattaaggcctaattatgctacagcagctagtaattagcacctacgattttgttagatatgactacacagatataaaatctttcgatttgccgcgtgtaagcactaaacaggacaaaagtactactctagtacttgcaatgggtcctttggagcttcatagggccagatttaagttctatattagttaataaacacagaaaaaaaaaacccaacgctagctataattcgtccaaaacaaatcgacaatggagtactacgcttgcacgcatgataaaagttaattagcaacgttaacaatcaccaaaacattgttttgaagtccttaacgtacgacgccaccatcggattggttggcttttgagttggctcttctcccactagactaatctcctgaaaatctaattaatctttgcattggcctggtccaagttgctgatgactaggattggcacgatcaacggatcaagcctagatcatgacgagagccatttgccggttgtcttctcccaagtaggcttgtttagcaaacttgctctatttgttttcggcaaccagccaaccacggctcttatcaaaatggaaaagggaaaaaaggtaaagtcgcaatgaagccatcgaggctgatcactgatctgttctttctctaccgatcggccggtacggtcagtgtacggctctaaagaatcaggcgagctcggcgttgtcgcgttaccattgcactgaccccagctaaccacttgtttaattaacccgaaaaaaattggacatggtcaccttcttgatcgctgctgactcattttttttgagagagagagatgtaacatatgcagttgatgtaagtatattattactctaatgctaatgcagtggttggccattaggtcagtgcatggcgatgcaactagcaactaggcagcaccagctagatgctcatcgtcggttagtgctactgttgccgtcatgtgcatatcagcagatgcatatggagtttgtttagtagcgagggagctgactttttgagatggcaagtgatcgatggatcgaacgatacgattcagggaagccctatcaggctatcagccgatggcgtgtaaagtatagaagacgctgatcaagctgtgcgtgctcctaccgttctaacgtacgaaaacaatatgctttttgcttgattaaaaaaagaaaaaaaatcctgccttttcaccctacatacatgcatgctcttgcttgattagaaaaaaagacaaaaaaaaatcctgccttttctccctacatgcatgtacatacatgcttttgcttattagaaaaaacaaaaaaaattaatccctctagaaaaaatatatttgatgtataggataagatttcgttaaacttttaaattctaaataatattatgataatatttattaggaaaaatatacgatgccactttttagtttctacactagcatttaagaaactacttataattaaagttttataagtttaactggtccgaaacattaaatatattttattgaagggatattgatcgaagagcaagagaaggataaatatcaataattatgtagtgtatctacatttaaacatagagcttacctattaaaaatacaagataaatagttcggggtctttaatgaaatgaaaggataaatagatttaatttccatgcgaattcaangtaaactccttgagaaataaaattaagaataagctacttgggagttattttcgtgttgtttgacagctaaggggccatggccagcttcctttgtgcttgcgtaactgttcctgttagctgcaacgctgttgcagccaggtagccgagcagttacaatttattttagaaatgttattggtaactaattattttacgctaagtatttgctttccttaaaaagttagccaatctctgtaggtagccgcatccagctggctggcttctccatctcatagagtatacaaatcgtgtttataatagtcctactaccactctcagttagtgccgtacggcacgccccgtaattttgaacggcaacatttcttcctaactctgcatctcacccaacaagagcacttcattcgtcaaaaaaaaaaaaaacaaatctgtgataggacatggaccaatcttaatatatatatggccaaattcgtaataccagaatattacatttaatatggagtagattggtttttaatatatgtatgtccaaattcgtaataccagaatattacatttaatatagagtagattggttttttatggaatgaagagagtactcaagacttgattatgcaataaactactggagtaatggccatccttgatttttttggtctgaactctgaagaaagatttcgcccacacgtttcctaccaataacatgtgaccagtccacgcaggctctggagtaccgtgcagggtttgggccatccgtaccgtaccagcagtccagtccagccccagtgccccactagctcactagcacacgattttgctaggttacacatggctttcgctgagtgcaagcgtatgtgtaaagacgtggatccaccaaaaggtgtggctctatttcaatcaaacttataaagccgattaagtggtctctgtagtactcactctatctatttttaatagtaatatttcatcttgtcacatagactaaggataagtaattctacttatcattcatataaacatgctactagtcattcctcgtaaacaagcgattcattgatatttacgtttctcaatgcccatgtagccaatcatgtgtggaagaatggagagtcatgcattaaatccgagaaagtcattaaaatgatatgttgttgaagtgaaatatgcttatcaaaaataaaacttttagatttggaaatatgactatctaaaatagatggaggaagtaccatttaaaggaagattaattgggttcactcgttttcaaaggcctacatcaaactttacataaagtgagagaaatgccctatatctcagtaaccagaatcttccaagtgcaaaaccgaactagtacaaagaaaggaaaagaatttgcacaatttctggccaaacaatccagcacaggcgcgagtgactccgatccgcacgtgtactacttgctttgctgcttccaaatcttctacgactactaaacgtaccatgatagtacatccaaagcgatcgaaaccggaaacctcctctcacgagtcaaaaacaagttaacatcacgcttggaaaccgggcacccgagccatctagcagtacacaagtgtaccactcaagagtactaccgttccatgcatccatccggccaaaacgccaaagcgcgcagtagaaaaccagcagaaaaaaaaaatcctcgcgaaagttgccgtacgcacagggatgactgacacggccgctctccccgtcgttgccacctccatgtcccctacagactaaccggagatgcccccgccgatgtgaaaccgatcggcagcgtcccgtacgccgtagctttccgcgcgacggaggcctctacacgttcgccttcgcacgcgtgcgcgcggggccgtcgatggatggagcgagctaagaatcgaagaatcgatgacacgggcgccggtgtacgctccggccctccttcgatcggtttcttcctgccgaccttccacttccaaccaaggcgtcgccatcggcagtttgggtagatattgacgtgggattgtagtggtgcagtgcaaggggtgtcctttgctggcgttactgcgttttgctcgttcgagtgcgtacattctgatttctgcatcctctggctctgtcccgggatttggacgtacggcctacggcgcgtgtacgattggatggaccgggtgacggggtgagtgaggcagcttaaccaaatcgaactccacaagtcactgatgaataatgctgaggagctgcacggtcgtgggaaagtcttccagcgaattaaggacgtcttggttgagaggcggtatccaaatcaaccactacactaataactagctgccttcgtttgcattttgcacgagtttgagagagagcagcggggccagatccgcatctcgcgctttattcgtttctatttgaccggcgaaatgttactttggacttgtggaggattaatatatagaggtgttacctaaaagtttcagtttgcaatttgccagtagtgtgcatgtttaagaaaattatctacgggggagctttccaaattttatctcagggttgcatggtaaaaaaggttatccatgggggaactttcatactgtttgctcccaaatgctttgatgacatggatccatcagtacttttacggttactagtagtacatttctttaaggaaagattatcgcctctttcccccttgctcgctttgtcgacgcacttgcctacatcaacagcaccgctttttgacagatatgactgcgaaatatgatcttctaccgatttgctagtaatgtactcctacgtagtacgtaacattggatgcaaaaccattggtacaagattatcaaacggagggaattaaacggacgaactgtgtgtatcacatggaagagctcgtgaacagaacacgttgtagcactgtacggtacccgtcagagaaaccgtaaccgagtaaccgaccacgctcgggaggtcgccagtggccacatgaccgcaggtccgcagccgtcacacgaaccaatcatgcatagatagaaggccaaatggacaagcagacaccaaaaccaggctagaaacgagagcgagcctcgcgcacatgaaacccctccgttttctcggcctcgcacggggaaacgacccgtacgcgcgccacgccgtgtctgctgctcgtctcctataaaacaacccgttgtcacgctcgccttgccattacaacgtcgctagcttcttccgctcgtttagaaaacgccaccaccaccaaagtcaggcacccccgccgagagagttagctagctgcgcgcatgcaggcgaggcggcacagaggattccggctaggccggaagctgctcgggctctggcgatgggcgctctgccaccggcggcggcggcgcggccgcggctacctccgcctgcagccgtgcccgggagctgcaggcggccgctcccctctgctggccgccgggagcgtcaagaagcagccgccgccgccgcagcagcagatcgtcgtgcatcagcgtggtggggagaaggcggtgctcaagtgggggcggtcgctggcgcggcggatgaggctcctgcggcggcggggatccgagcggctcctggaggaatcccccggggaggcgacgacgcccaaggggcaggtggcggtgtacgtgggcggcggcgagcccggggagtcgatgaggtacgtggtgccggtggtctacttcaaccacccgctgttcggcgagctgctccgcgaggccgaggaggagttcgggttcgcgcacccgggcggcatcaccatcccctgcgccgccgcgcggttcgagcgcgcggccgccgtggccgccgcgggcggcggcgggaggaaggtgcccacctggtggtagcacgtggccaggccgcggccggtgtacatacatacacacgtgtcatgtgtgctcgatcgagtaggactcaaacgtgtacgtgtattctttttttttttggttttgttttttacttcttattgttcctcccctttctgtgtggatgcgcatccatctctgcatgcgatgtgaggaggcctagttagatttacagacggaggatgctactaaagtaatactataattctttttgactcgatcaacgtgttcgcatctttgcaattaggactgtgtttaattccacgttaaagttgaaagtttgaagaaattaaaacgatgtgacggaaaagttgagtttgcgtggataggaaaatttgatgtgacgaaaaagttggaagtttgaagaaaaaagttaaaatctaaacagggtctagacgaccatgttggagaatgaatgataaaacgtgaacgtccagtgagatcgatcctgttcatgatcttctttaatttgctcctccgcacgagcgacgaattatattgtttttttttgagaggacaaattatatgttcttgtactccataggagtagtgttgctccagttcgtgcaggaattgattaagctgtggagttctaacgatctgctacttcctgccggcttcctgacctccagtatcgctgaagcgtgtgcagtggtgaagtacttgcgtagtccgtacaaactggtcagtttggcgatgcagcaagcaacttccacgcaagtggcccgtgctgtactgttaagccttccgaagagatgcttgcataggccctgtttgaaacaaagaatggacaacacaggaacatgaaaatatacaggaataaaatataaggctcttttgaaacaaatgattttagaggaatttaatcctacgaaaaaatttcctatgtgatcatttgggtcaaagaaatagctatccaaaaattctgtgaaattgctttggattggctcaaaacatataaatttggaagaattctaacatgagcttcaacctctggggaaaaaaatccattgtgtcagtctctcttttcaattttttatgtttttaccgcgctccatcgtaatttctataggtttcccacatttttttcaatctataggatttgaggtgctatgacactgcaatcctgtatttttcatgcaattgtgttttgagaatattgtgtttccgaaggagcccttaatttgtgtaaggtaaaaaacttaggaattcaagtacatgaatagtgaaaattttgtgttgtttggatcacatggaaaaaaatatacgagagagacatacaaagccatgaatggaaaaaaaaactgagaggaggaggagaatttcctttggctcacacagtcacactgaatgcttttctttcctatggaagtggaggatttgctacctttatatacaaaggaattcaacaacatatttcctttgtcccaaacaggtctatagggaaaaattccaaagcaatgcaagcctctaaacttccttcaaaaatacattgtcccaagcaggtactgtagctgaagccggaaacagagtgcagcttgtctgccgttgcagcggctccggggtcgtggtcactgcacctgcacctgcaccccaatttgagcacatcgcgtagagtaaaattcgtttattcgcttgagacatgagaaggtgtttggtatctgtacttctccatggcacctatcatcaagtgagagttcagaaagattttagtgctaatttgtaatttgagattaattggccatctaatcatcatctgctgaagttgttcgggattttggacatgatgagccatcctataacatcagggctcatcttctcattgagcttggaacttgatttttagagaaaagttcagaaacccggcttttaattgaaagccgcatagcttggaacttaataccatgaacgtaagaagtttctcgtctacttgtgttgagctagacgcccatggctcgtacaatgatacaaatgatggagatgtaatggactatgagggacaatcatgcacgatatacagtatgttgatgtccattctgaatcccagccccaatctgacttcctgtgctcgcgctatttttgcacgacggcgttacgctatcgagacgggcccggggacgtgtgggcacccggcacacaaaaagatcttactgatgaacatctgaatgattggcctctccgaattaattgctgaaactatggtgaaagttacaacaaaagaatgaacgcgattgacctagtaaaactgatcagaaaactggcgcaaaaacagagtagaggagcttctggccaattgaagacgacgactagtgggatactgcgttaattataactagcatggtggcccgcgcagattacacggctagtatcattatattttatctcatataatagcatatatgttttttaattatattattcaaatatattaaaatgacaacataattttatattttgcaataactttacaaaactactaatgtgtaatattcatattgtattttttatatgtgttagttattaattatttttaatatcaaattttagttatttgtaaattatatatattcctaaatggactctagactcgtcttttaatatttcttttttttatttcgaattttctgtaaattgtatttctatatggactctacgctcttcttccaatattatttatttttatttctgaatttttattatttctaattgtatttctatgtgggctctaaactcatctttcaatattctttaatttttaatttcgaatttcagttacttctgaattgtattcctatattgactttaaactcttcttcccatgtttttcttaatttcaaattttagttatttgtaaattattttttatacggactctaaactctacttttaattttattatatttattttaaattttagttagttttaaattcctatatggactctatattctacttctaatattccttattttttaattttgaatttctattattttcttaattgtatttctatatggactctatactctacttctaatattccttatttttaattccgaatttctattatttcctaattgtatttctatatggactctatactctatttctaatattccttatttttaattccgaatttctattatttcctaattgtatttttatatggactctatactttacttctaatattccttatttttaattccgaatttctattatttcctaattgtatttctatgtggactctatactccacttctaatattccttatttttaattccgaatttcagttatttcataattatatttctatatggactctagtttcctcttctaatattccttattttttaattctgaattttagctatttctaaattgtatttctatatggactctgttttttctttttctccgattaatgtgagaatttctaggccatgagagcgaacgtggaggctcctttttctattcctttaataatataatagatagattgttatggcgatgataaccccatccactggataaacttgtaagctactccctccatctcaaaatatttaacgccgttgatttttttaaatgtttgaccattcgtcttatttaaaaaaattaagtaattattaattcttttcctatcttttgatttattgttaaatataattttatatatacatatagttttacacattttacaaaagattttgaataaaacaaacggtcaaatatgtttaaaaaagtcaacggcgtcaaacatttagagaaggagggagtacttcctctgttttataatgtaagactttctagcattgttcacattcatatatttcccccgtttcataatataagtcattctagcattgtctatagatgttaataaatcagtatgacttatattataaaatagagggagtacaatatacctgttatggtgaggcacagaggaagttccttgaagaatctgagtacagtcaggacctatcatagtatcttgtaccactatcggaaaatttgggaggtagtacggagtagtatactaggactatgtcatttttgtttcctttccagaagaaattagttaagtttcttttttttttgaagggaagttaagtttcacaccagtgagcagctaacacactaatgaaatgggagaattatatagtatttatatactcaacggatacatcaagttggcccatcaagcagacttaacaacgggagtacattatgttatctatcaaccgggtctgtatttctttcttctttttttttaaagaagcctgtatttcttttttttttctttgcctgatgaataagaatcaacaagaaaaacaagcaccatggcccatgggatatcacctctaccttttctactctttaattgcaacaacgataggggaagacaaataataaccatgtgacgttaattttttcttcacgaacatacaaaaaggattacacgtagttctataagaataaagtagtaacatgttacacagcgtgacagtaagaagccatcgcagcgaggatgtcaaactaatatatatattcaatgaacttttgtgagagttccaatcccaatcctgcgtatctagacatcgactagtttagtacatggaacaaacagaacttctgttcaatctatatagtatagaaatcgatttgtgggacccactagaacccacacgtaaagaaaatctcagcctctcccgcgtcttcctctctcacgctcacccctaacgtttctttattcggttgtatgcgactcctatctggaactcgattttttcactgacacacatgattcgactcccacagtgtatttggtttggccttttcatgctaggttagatataatcctcacgttggatgtgctcttagacgcatctggctaggaggttcccctgaaaacatcaaacaggaaaaactatggaagcaggggaattctgagagagaaaacgacagacaactgctcttgtgcagtactcccttctgctattgcgagctgaagaatcccgtagttctctcttcttgtaagggtacatcatgacagaagagaatggtgcatagttgcttgaaggggacagggtcattgtccaatgtccacaccaggattgttcagattctgcgaacaaaggtcacacgtaatcccaatcccgtcttgggccagcatacataggcctcacggagcccgcattaccgttccggcccaacacgtataggccgcacggaggtcgagctcccgttccggcccagtacgtacggtggcgcgtggcttttggtcgccacggtgtacaggaatctctggtgcgagcaacgccgcaccaaccgtccgcgtcgtccgagataagtagcttctagacacgagagggcgcgatcaaaccaagccaaactaattctcgtatctgcatgagctacactggtcagtggtcgctgcacgctccctgatcagctacgcccatgcatctactcagcggctgcgtcgtcgccacggccgtcgtgctcgtcctcatcagcctcggcgccgcgccaccggctgccgtcgacgcggcgacggccacgttcatctacgcgggctgctcgccgtccaagtacgagcccaacaccgcattccagagcaacctcaactcgctcctctcctccatcgcctccaccgcgtcctcgggcgccgcctacaacagcttcaccgccggcggtggcgccgggccggacccggcggccggcacggccgcgtacgggctgtaccagtgccgcggcgacctgagccccggcgactgcgtggcgtgcgtgcggcagacggtggcgcggctgggcgccgtgtgcgccaacgcgtacgccgcgtcgctgcaggtggacggctgctacgtgcggtacgacgccgcggacttcatcggccgcgccgacaccaccacggcgtaccgcaagtgcagctccagcacgagccgcgacggcgcgttcctgagcagccgcgacggcgtcctcggggagctgcaggcggcggccgggtacaagctgagcacctccggcacggtgcagggggtggcgcagtgcctcggcgacgtcccggcgaacgactgcaccgcctgcctggccgaggcagtggggcagctcaagggcgcgtgcggcacggcgctcgccgccgacgtctacctggcgcagtgctacgtcagatactgggcaaatggttactacttccgccctaattcaggtatgcgacattgtaattaaccaaccaagcatgtcacgtactactaatcgcgtgcacgttctaactattcatttcttcctataagttggaataatagttaacctttcttattataatttatatcgaacattttttttagtatttggagaagtttgaagtgcacgaataattcgaatatttagtatttcaaaaagcaggggcgatccaaatcttaaaagagaacctgtgtgtaagggccctacctaatgggcaaaatggtagtagttggctagatagtgatcactagtgagtgaggtgaggtctctatggaagtgagaataagattccaaactggtaaacttccaaagctgataaagaggacacgaagaatatattcaccggcataaacttttcgacccttttggatcgatgttaattaagtatttaacactcaagacttgatgaggcgttctagctcatttagtcgtctagcttagcgctttttagccgctatggagaaaagctagcgcgcgtttgctccccgtgcgtgcgtgcggatcgctttgcatatatatggttgttaattagtcatcatctccctttggcttggtgacagataactctggagacgatgttgggaggactgtggcgataataatcggtatcttggctggactggcactcctcgtggtgtttatttctttcctcaggaaagcatgtaagttctctgaattatgtccacagagagatacactttaatatagccaagtagctaaccaattttccaatgcactatacgcaggttagcagctgtcggcgtagccagcttgggttgaggacgtgaacaacaggcgatcgaactccattcacggcatcgcattcattttgttagttatagcagagattcactgatgctctacttgcctgagatgcactgtcttgtttcagtcggtctgcagtctgcaaagaaaaagaggttgatctgcgtgtaacgtaccatttgtttgggttgcactgaagattggagtattgaactgcaacggcagttctctcctcactgccgagttcagctacaacttactccatccgtcccaaaataagtgcagttttagcactgttcatgtccaacgtttgaccgttcgtcttatttgaaaaaagattataattagtatttttattgttattagatgataaaacatgaatagtactttatgtgtgactaatttttttaatattttttataaattttttaaataagactgatggtcaaaacgctgagcacacatatctgactgcatttattttgggacagggtagcactttcgtacctacacaattcacatcttgcttgctgcgctggagattgaaacaatacacgtaacgtacggccgcgttgccagcccactacaaatcaccatggccccgtgccctggcccacataaatcctgttctcgaccaactagaatgggcctcaggtaagtcgcaattcgttcccagcccactacaaatggcccaacgcaatcctaaccatgcagggaataagtccactttaactcccttaacagtgacccgaatttaatccatgactctcaaccgtaaaaccagataggaagtctatccggttaaagtgcactttctatctagttttacagttgagagtcatgtattagatttaggtcatttttaagggagtcaaagtagacttgttccaaccatgcagtcccccgagacgggagaaaggagcagccggactcggtccactaaaagaagggttaactggatcgagcgcatctcaagcaagcagagcgcctcctcttgccgtccttcgtccaggaggacttcagctgccgcagcagcagtggcgcaggtagggaggtgccaaagggtgccaacaccctcctatctaaacactatcaccattacacccctatgtttttactctatattaagttagctaagataagtatttatctagtttattttgtatagtttgaaagtattatcagtttagttagttagcaagtctaaaaatattagcaaaaaacatgatatacaaaattagtttgtgatttatcatctttttcaaagtaaaataaatgatacttatttgtaagattatttaatagtttacattaaaagaatttagcaaaaaagactagtttcaaactttcaatgatattattaaagagctaaaattcaagtttttcttaaagagctacgtattgcttattattgacggtgactatttaacctactttactatgtaaaaactctctttatataaaagct

SEQ ID NO: 66580 - DNA, 10395 bp, Oryza sativa
tgtagccttcatttgccctggagaatgtccatcgacccccgacttcatccacctccatccgtgtacttttgtttataaccagactgagccacaaactaagccttacccactagacatgtggaagtacggtaatgctttgcaacagaggcccgaagaccggtccttatatggccgaggtgctactatcaaaaccatgcaccccgagcccagcctaaaaccattttggggattttgaatagaaggagcggtgtgaagccaattccacagtaaccaaaccattccatagtgtccaagtgatatgaatatttcccaaagtctatagttgaaaaaccacctaatgttacctaattaaattgcgaagcatctacctaaaatcatactagggataccataagtagagtgtccactagttgaggttttgtttattctaggttgaacaaggtaataataacaataacaataataataaggtcataacaaaggtaaataggcatggctaaataaaacagtgataacgcgggaatttaaataaagcgataatgcaataatttaaatcaacataattttataaactgggattcaatatgctcaaagatgatgtgacttgccttgctcgctttcccaaacgtcggcttcaacttccacgaagagcgggtcttccgaagctgcagcgtctacacgaccaacggaaaagaaaaggcttttactctaataaactccacataacagcagaaacaaagcataaaaatgggttcttgacttcttaaggaaaaattagagacttgaacggtccaattccgagttcaaatggccaagttatggccatttgaagtttatatgctctttaaatggatatttgcgaatttcttcatttaaattttaattttaaatcggatttattgcgtcagccgaggggaggggcgcgcggaccgggtccacgggagtggggcccacgcggcagcctcacggtccacggtggaccgggtgtacacggcttacgccggccggcgccgtgggtcccacgcgtcagccgcacctgagggcgcgggcggctgacggccgggccccacatggcagccgcggggcgcgcccgaaggcggcctcgccggcacagccgactggaggcggcgcgcccgcgcccctatggtcgccggcggcggccataggcacggcggagcggcggccgggagaggggagggaagggggaaacgaaatgggcggtccacggttcaccccgggtcgacggcgacgacgggaacggcgaccggagcggaggaaggcggcggcgcggctcgggtcgacgaggacggcggtgttccggcggtcggcgggcgaaacggaggggtggacgaggtcggcgaggacgcggcgaagccgaagaaggcgacgccgaagcaggagaaggtccggggcgacgacggcggcggaccggagctcggcggtgacggcggagagagggagcgacggcgcgagctcgattccggcggagagagagagcggcgagaggcggaaacggcggagggaggcacggggagtgtttatatagggttgggagggggagagagcggccggatgagggggaatcggccgcggaagatccggccgccattgatgcgctggcgaggtttagggggaaatgattccgagcgaatccgagggagagagagagggagaaatggggggaaagggggagggaatcacggggagtgatttccccctctttattgcgcgcgtggacggcgggaggcggcgggattcgtggcgacggcggcgctagggcacgggcgaggcggcgggagcggcgcgaggtaggggatgacgggtgggccccacccgtcagcgagggtggcgggcgggcccgcccgtcagcggcgcgcgcgcggggaggaggctgattgggccgcgggggagaggagagagagggagagggaggtgggccgagccggcccaagaagggaaggggggaaaaaaagactttttagggtttttctttttataaactcattttaactttgtttatttctttttaattattatttgtgctctgaaaattccactaaaatttatttacgcattttaggcttttaggaaatatacaaaaatcctccaagccttatttgacttttaacttagcacattttaattgttggaggctttcacaaggattttacttattctatgcataatttcgaggatgtattttagagtcgttttgggacgcgacatcaccgcccgcaagagtacctccaggcccgagcttgttcgtcagtccctggcgtggacatgcttcatggagacccctcgcgccgagcccacgcccttggttcctcaggaggagggagcctctggcgttggtagcacggaggatgcgctgctgctcaccttccgccctggcccgtcgcagaagtagacgagcagttagtaggcttgcgcgtgtattcttctcgtttgtttttctggttgagtcatgtggggcatggttataccggtgtgtggtataactgtgtcgaagcctgtctttattttatttgcttaagcaacttgaaccttaatgaaccaatttaatagcagaaataaattcaagaattatggtagtcgtgggtggttagttttaatagtcagctctctctgtttgctggttctgtgtggtattttcagatggtgacaaccaggagaagttctgctaccggtgaaggcagtcaccccgaaggcagcaaccacaacaaccaaggcagcccacctccacctcctcccccgcctccaccaccaccaccagacaccaactctatcctcacccaaatcctcgcccaacaggccaacatgatggctgctttcctccatcacatccaaaatccgccacagcataatgctccacctccaccaccacccccgcaacattctaaactcgccgagttcctccgcatccgtccgcctaccttctctagctccaataaccccgtggatgccttggattggttgcatgccgtggggaaaaagttggataccatgcagtgcaacgatgaggagaaagtcatcttcgccgcccatcaactgcaggggcccgcatctctatggtgggaccacttccaggctacgcagccagaaggacagcctattacttgggcccgcttcaccgccgctttccggaggacccatgtgcccgccggagtcatggcccttaagaaaagggaattccgggagttgaagcaaggcaacctctccgtgatggagtatttgcatgagtttaacaacttggcccgatatgccccggaggatgttcgggaagatgaggagaagcaggagaagttcttggcaggaatggaccctgagctgtccgtgcgtctggtctccggggattatccggatttccagcgtctggtggagaagagcatccgcctggaagccaagcacaaggaactggagtagcacaagcgtcgcctggcgaatttccgcaaccaacagggggctaaccaaagggtccgctataccaatccctacccagggggatcctcctcgcagcagcagcagcaaccatgctccgtgccccgacctcaattcgtggtgcgcgtcccacagctgcagcagcagcagaatcagcaagggacccgtgcgccccgtcctcctgcgcccgttgtgcagcctggtcaaggccgcagagacgctcaaggttagaaacgtttgtgcttcaattgcttcgagcccgggcactttgcggttaaatgcccaaagctgaggcgccagcaaggccaaccgcctccccgccccaacaacggtggtaaggatgtcattcggggtcgtgtgaaccacgtgactgccgaggatgtgctgacaactccagatgtcatcgtgggtacgttcctcattcattctattcctgctaccattttgttcgactctggagcttcccactcgtttatatctgtgccattcgtggggagaaatcagttgggggtagaaaggcttaggaaccctctgctcatcaccacccttggcgggttatgacagcaaagtactatagccctgccgttcctatagaaatccagagaatcccttttccctcggatttgattcttctggacaccaagaacttggatgtgatccttgggatgaattggttggctcaattccaaggagtagtggattgcgcaagacgcactatcactctgtaccgagggccggaacaactggtggttttctttgcacccccaacctctgtcggcagttcagaacttcatcagataggactgtcggaaatccccatcgtcagagagttcggagatgtgtttccggaagaactacccagtatgccacccaagcgagagattgagttccggatagatctcgctccacgaaccactcctctgtacaagcgaccctaccgtatgacagcaaatgaactggccgaagtcaagagacagttggaagagttgaaagagaagggatatatatggccgagcacttccccctggggtgctcctgtgatttttgtggagaagaaagacaagacaaagaggatgtgcgttgactacagagctcttaatgaagttactatcaaaaacaaataccctcttctccaaatcgatgatctgttcaatcagcttaaaggtgccactgtcttttctaaaatcgatcttcgttccggatatcaccaattgcgtattcgtgaagaagatatcccgaagaccgcattcaccacgcgttacggactgtatgaattcacgatgatgtcgttcggtctgaccaatgctcctgccttcttcatgaacttaatgaacaaagtgttcatggaatacttggataagtttgttgtggttttcattgacgacattctggtgtactcacaatcagaggaagaccatcagcagcatctccgtctggtgttgggaaagttgcgggaacaccaattgtatgccaagtttagcaagtgtgagttctagttgtccgaagtcaagttcttagggcacgtgatatctgctaaaggagttgctgtggaccccgaaacagtgaccgccgtcactgattggaagccacccaagacaatcactcgagtccgcagctttttgggtttggccgggtactaccgaagattcatcgagaatttctccaaaattgccagacccatgacgcagttgctgaagaaggaagaaaaatttgtgtggagcccgcaatgcgagaaggcgttccaaactctcaaggaaaaactagggtcctcgccagttttaatcttaccggatactcgcaaggacttcctggtgtactgtgacgcttcgcgccaaggattggggtacgtattaatgcaagaaagtcatgtggtagcctatgcctcacgccagctacggccccatgaaggcaactaccctacccatgatttggagttggccgctgtggttcatgctctaaagatctggcggcactatctcattgggaatcgctgtgaaatatatactgatcataagagtttgaaatacatcttcactcagtcggatctgaatcttcggcagaggagatggttagaactcattaaggattatgatgtgggaatccactatcaccctggtaaggccaacgtggtcgccaacgctttaagtcggaaaagccgttgcaacactcttggcgtccgtggcattccaccggaacttaatcaacagatggaagccctgaacctaagcatagttggtcgtggattcttggctacgctggaagccaagcctaccttgctcgatcaaatccgtgaggctcagaagaatgatccagatatgcatggactcctcaagaatatgaaacagggtaaagccgctggtttcacagaggatgaacacgaaaccctatggaacggaaatcgggtatgcgttccagacgatagagaacttaaacagttgatacttcaggaagctcacgaaagtccttattccatccaccctggcagtacgaagatgtacttggacttgaaagagaaatactggtgggttagtatgaagcgggaaattgcagagttcgtggccctttgtgatgtgtgccagtgtgtcaaggcagagcaccaacgaccagccggacttcttgtcacacccagaaattctcgaaccagaatttctaagctgaatgtgcattaaatccctgtccaggaccagccagggtacacaaacgacaattgttgacatacagacccacgtcttacaaaaatataaaagattacaaatgcagcgggaaagataaaagcgagctaaaccgggaagcttgacttcagcagcgggcgactccactccacaggcaaaccttgacgacagcgacgaaaccaacctctctgagatggctccaactgagaagaacttcaactttggtgtgggggaaaagagagcaagactgagtactaccccctgtactcagcaagtcataccggaagaggaggtatgatgcaggatataaccaaaggaagctatgggttcttttgcataaagcaggcatttcaaagcagtagttgaaagcaataaaacagctatagtaattaatcaatattaaccaatcactgtccaacgctacaccacgttgcaacaggcccaaccaaccacctgaactacacaagttcattaagttaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagacccttcacataaccctcccctaaccatccacaccacgctaaggtttcacccccacccctcaaaaggcagtgggcggtcccctcttgcgccgcggtgaatccggcagctggacaaccgaacacctcggccgacccaactccatcacgcccaccctcgccaccggtgcctaggaaagggtcgagctatacttcagatcaagcagttacccactcccgcttgtggtaagcacggtaagtctcccaggtttcccgtgaaccggtccttaactgccatgggtgcgaccagcaaaaccatgcactcacagcccgccattcagaatattttaattaactgacacccttgcggtggcaccaatctaaagctatgccaatagtcagagtctatgtaataatgtgatccccatttgtgtactagttgaactaagcatggctaagcatttcctaagccaacatctagtcattttgatacccaagttatcaatggcataagataaccaatatgtggctgaggaataggacccatcccacattacattgtaaaagaatgcaacatttaatagaaatgcgggatattggtaaattgggtacaatatgatcaaacgtattgcatgacttgccttgctctcaaactgatgagacctcagcaacgtcttcgagaaactgcggatcaacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaaagtccttaattaattattgcgcaataatacccggggctgacgtcagcgaggggggcggcgtcgacaggcggagcccgcatgtcagcggcacaaggggagagggagggggcgccggcatgtggaccccacgggcaatggctcaagggggaagacggggtggcgcccggttggctcggctcggcttcaaagccgaccggcgaccatggcgaccggcggcggcgcgcgagcgccggtaacggcaagcgacggcgcgggaggcggcggtggacggcgcacaggccggcggcggcggccgaaggcgatggcgagcgcagggagcggcagcgcgtgtgggacagagggaaggagggaggagaggagctcctcaccgtgagcacggcggccggcgcgaaggatgaagacgacggcgatgaccggtgatgcggaggcatggacgggcggcggtgacaccctaggagaagatggagaggcgttaggataggagacgacgaccacggcggcttgaattgccggccggagatggaggggagggaaaaactcaccggctcgcgaggggagaggcgctccggtgggattccggcaacgcgaggcggtggctgggaaagctcttgcggcggcgaagctaacggcggtggcgggttggcgcggcggcgactctagcagcgacggcgctagcagcgagcggcacgagcacgataggaggcacgggagagtgcagtgaatgagggaaatgggagaggaggtttgggggagcgtttttacgggcgagggaggggcggaaacagccggggatggcccctatttggctggcgatgtggggagtggagggagagagagaggtggattcgaatgcgaatccctcccatttttgggcgggcgcgagagcgggaagaggtgggggaggggcggcgacatgggcgcagggcgcgggagaggcgcaggaggcggggaaggtgggcagcgtggggagcggtggtttcggcggtggttggcgccggggcgtgggcggctagaggtaggggacgaccccgacaggtgggccccacctgtcggtgcccgaaagagaaagggagggagggaggacttcagggaggggaaatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaataagataaacggcgcggacggctccactccacaggcagcttgaccaaggctacacctaaacctccacaccatcagcatcattgtagaactcttcctctgatgaatgattgcaaggtgagtatatgacatactcagcaagccacgcagcaaatatgcaagtgcacaggataacaaaggatggcataatagggtttcatttgcaaaaacagcatttaacaaacttttcagaatttaataaaacagttgagtattaattaaacaatattaatccaacgctatacaacataccctgttgtataggcccaaccattatgtacaaccatcccagctgcacagttctatctccaaaccaggaatataccattccaaaccaggagctaatcaaattattaccaattatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcgccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgctccgcaatgaaccatgttatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaaatcattaaataatagtgagtcataagttatcccaatagtgtgctaatgtttctaagcagggctaagcaattatatctaatatctagttgaaccaatatataaagctcaactagtcaaattataataacccaaggtatcaaggaataaagtaatcaagaacaaaagggctataacaaacaataggttatttccacccaatgacattcgaaaataaatgcaatagttgaatagaaataatagctttaaataggatcaacatgctcaaagggttgtttgggatctgtgtgacttgccttgctggccttggaactcttcaaattcttctcctgcgaaaacggactctccggaaacaacggaatctaagcagaaaagagcaaaatcaccaaaacagcacataaacaagcatgaacagtacatgtggatatttttaacctgtagatctcaattttagaaaaatttagagacttgaaccaactaaatcggagctaagatgaattagttatgaatttttgaagattaaatcggatta

SEQ ID NO: 66581 - DNA, 10276 bp, Oryza sativa
caggtttttgtggggtgccgcgccttaaggcggtttcattgagaaggaagtgcggagcccttttgggacattgtgtaagagcgggaaggctaaaccttagtgttatgcgggatttttgacgctaccagcgacctcgttggaatatggttaactgccgggctgtcatttaaggttaggtttcgatcgagtctctcacccggaaaacaatgtactatcgcagactgaaccgacttttcgcagtctattgttaaagtagaaagtcgcaggctcttccctgaagccgttgggccattttggcccaacatccctcccacatcccgtggccgagccggcccatccggcccaacccgccaccaccgcccttcctcgcgtggaggccgacaggtggggcccacctgtcggtggtgtctcctacctccggccggctgcaagccgagcccgagccggccgagccgccgccttctgcctccgtttccgccccgatctctccacccctagtccggatttttgaggggtttttatccccacatcttcctctatctttcccctcaagaatcggagcaaatggttgagtatcttgcccgaatcgaactcgttttcgagtttatctccaaaaccgagtttttgattttcccgagtcgatttcttgcgggaggagtccgatctcttcaatccaaggctataaataggaccccctagtcctcctctttcgtttgccccaactcccgtcctttcccgtgctccgtagctccgtcgccactgccgcctagcaagccacccgccgccggccggactccggttgcgccgccgcgccgcctccgccgtcgccgtcgcttgccgtcgccgccgctggtttcgccaagaggtggggaagctcggccgcctcctccccttcgccgccggccgccgtagcctcgtcgccgccagtcaacccgagccgccgccgccgccttctcgacgccggctatcgtcggtggtcgttcggtgtgttggtaagtaccgtcgcgttcgtctcgtcgttctctacgtgtagatgccctccaaagttccggccgaccgccctagctccggcgaggtcgtcaattcgggccggccaccattgatgacgtcatcgtgacatcatcatcttttctttttcccgtttttctaatagattaaaacttcagaaaatcataactaaataaccgtagatccgtttcaggtagttcaagttgctaaatttttctaaaatcaagatctacatgttaaaaatatccacatgtactgtgtatgcttgtttttgtactgttttgttaatttttgtttaattgctttagtttccgacgttccggaggagagcgtttccgttgaggaaggttccgaagcgtttgcggaagcccaaggcaagtcacacagatcccaaacaaccctttgaacatgttgaacccatttaaagctattattttatttcagctatgcattgttttcgaatgtcatcgggtggtaaacctttcccaattaattaatggccgaagatgatcttattttcctataggttataatttgattagcatgaaccttatatgttggattggttcagctaaatgctatatgcaagtttgcttagccatgcttagaaacgttagctaactaaagggattaattataaactatgttacattattattttaattatggttacattaaatggtagctcacgatggttaatcgtgtgatgttaattaattgatgattaaaacctggttaaggtgggttgtgagcatatggttttgatggttgtgctcatgacaattaaggaccggttcgcgagctactgttgtaaaacttttaccgtgccaaccacaagccagcgtgggcaacggctttatcttttgtatagcatgattcattatagtgcgccagactgtgaagcggcgagaagtccgtgggggtcgctggggagtccattgcctctggttttgagggggagattatgatccaggaacggtgcactgtggtgagttgtgttgtgcaaggggtattgtcacagttcttttccgaggtatcgtggtggtactaaggcgcatggtaacatgttgtgggattgtgtcttgtgggtacagtggtacacctctgatcagagtttaatctattcgaatagccgtacccgcggttatgggtgagttgagcaatgtttttcgtgattagtcgcactactcattaatggtaataatgtggtaattaatttgactcctggtttggaatggataattcctggtttggaggtttaatttgttcaactggggttggttgttcaaatgtggttgggcctatgcaacatgggtgtgttgtatggtgtttatttaatattgattcattatacaactgttttactattctcttaaatatttgttaaatgctgttatgcaaatgagctatattatgccatcctttgttatcctatgcacttgcatatttgctgtgtggcttgttgagtatgtcatatgctcattcttgcaatattcaatcatcagaagaggagtatttcagcgaaggtgatgatctgaaggattgagcttgttctggttaagatgcctgtggagtggagtcgccatagctgttccgtagtttgttatagttttatttttccgctgcgtagaatgttattctttgagaggaactatctacctctgtaataatttattatttgcgaatattaaatagttatttatttgtactctattatcaatttgttattgtgtgcctcggttgattcctggacgagggtttaacacacatgtaagcgtttggaattttggatagaaattccgggcgtgacattggtcgcgcccatggcagttaaggaccggttcgcaggatgccctggaagaacttatcgtacttaccacaagccaacgtgggcaacggctgggcttatagtgtagctttcctctagttgacgcatccaggcaagggtgggcgtgatggagcggggcgggccctgcgacggcctctgtcgcttccggattcacctaggcacgagaggggactgcccgttgcccgctggggacgggggtgaaacttgaggtgtggtgtgcttagctagagggggttatgcgaagggtcctgtcacagtctctttctggtatgtcgtggtggcatgtcggcgcacagaaacgtgttgtggggctgtgtcttgtgggtacagttgtacacctctgatcagagtaaaactattcgaatagccgtgcccgcggttatgggcggtcaaccagattcaccgtgattagtctcaccctagtttagtctaatggaattagatagtataggtggatggttgggcctgtggcaacgtggtatagcgttggacagtggatgattaatattgattaattgttacaactgttttactgttctcaacttctgtttataaatgcccgttttacgcaaataaaccagtatagctatcccttgataattccctgcatcatacccctattccggtatgacttgctgagtacagtgggtagtactcagtcttgctctatttttccccaaaccctagagtatgagtatgcgtcagatggtggtttctccgaggagtaggcttcgtccgtgccgtcgaggatgcctgtggggtggtgttcccgctgcagatctagtcaaggcttagccccttttatcttttgtttttccgctgcatttatgtaagacttttataatgtttgtaagacgtggatctgtatgtcaactttgtcgcttgtgtaccccagccagtcctggacggggattttaatgcacattctgcttggaattctattcgggaatttctgggcgtgacacgcatgggagaggtgtgtgcaaagctagggccacctatcggcacggaaaagaagcgtcgtaggggcgtgggatcggatggtgactttgcctgtccaagtagacatttaccaccttttagttgtagtgaccttttagttgcagtgacagagattttgactgttgcgcctcgtgagccatgtgggccacacccatcacccacccgcacgcactcgatcgattaaccacccaaacaacgccaatgcaagcagctcgttcccaagttgccacaacacaccatgcatcttcgagttcgactcgcgggcgcacttgtggagattatgggtaccccatacccacacggcacggttatccgactagttataggggataacttatatatatgaaatatgtaacagatcatgacttgggtattacgtttccttgtatattacggaacggcctaaagtcctggtttgataagattgtaaagtagatttaggaaaccgataccgtattggataaggtttctatcttgtaatcatgtcccccatcctatataaggtgggcaggaggccctctagggggcatgagacaattagatcgtcagatctatactacactcggcggattcaaatccccaaacaggagtagggtattacctctcattgagagggcctgaacctgtctaaatccttgtctctgcatccatatacttttaggtttcgtgcgctaccccgttttattattgccgaattcatgttttgacagctggcgcgccaggcaggggatgcgtcgagtttcccgtcgacgagtgcgatggaatcaattcaagcattgagattaatctcaacgagttcgacgactccaaatgttaatcggtttgtcgtttcaatatattgttatcagattgatctataatcacaattgattttctgttgtttttcctctctggttacatgtgccgccgcgctgtgaattcttctgatcactgcgggttgaaaaaaacataagccatggggaaaacggccggagttacgcggggtcatcagatcggttctgtccatgcaagcacgggatcaatcaactgaattaatatgaatggcttttgcacctatctatgcaaatatgcatctacgttacatgcatatacagtataagaaacatatatttctgtgtactttgccattgctaatcagattgatttgtctggttgcatgtgttatcggagctgtcatcggattcttctgagttatggccacgcgtgaacgcggctatgccacctcgtcacccgagttcgtttcccatcatctgaaccctccggctagaatttaatccagactcgggtcaatgatttacacacgcatggcagcagcatggatcggtccaatgacatgcacgcatccgggaagaccaatcttggcgagttcaacgatttaatctcgacttcgccgggttttttcctttcaacttattgttgtttattagattgatctctaaatatcagattaatctcttggtattttctgatgtttacatgtaataccgcggcactactgttgccgactggtgccttcgtcctcatggctggcctgctatgccgctgctgacgggcgtattgatcttcaccgaccggtagcctccgtcgccgccgactggtgtcctcgcctatatggttggttggtcacaccaccgttcatgggcgtccacatcttcaccgaccggctggccttcgccgccgccgactggtgtttccgcctgcacggctggcctattatgccgccgttgttgggcgtctacgacttcaccgccggcctgcctccgtcgccgccgactggtgccctcgcctatacggttggttggtcataccaccgttcatgggcgtccacgtcttcaccggccggttggccttcgccgccgccgacaggtgtctccgcctacacggctggcctattatgccgccgttggtggacatcttcgctttcaccatcgaccgccttcgttgccgccgactggtgtcttcattgttattgatggacgacttttttcccacattggccacctctgccatcaccaaggggaatattacaaagctaagtcatcattgttttattccttatatgatattttccttttcctctgcctcactacttcaactggttcgctgttgactagtgagtcggaggctacagatgttatatcatatttttcaacatttttcataatatttatcctgattggttgcaaaatactccgagttcaaataaagtgcctatcgagttatggagttctatcttcctatgccttccatttggtttgtcgatggatagttgcctttgggccgattcctagcacccgggggctcgttggatggaccaagtaacgcaaggtgctaaatattattcggaataaatcaaaagcatagagataagataaatctattttctgctctctacaattgcaaaagtacccgagtagtaaattctgattcgtgaaactttgttccattaatgacgaactcatgtcactcatatgcatgtttgggaagtgcctaggccgactcccgatgctcgggggctatgactagtcggacagagtgtttaaacgtacggagtcatctgctcggggaaatcaaaattgagtagaggagaaatacatatttataaatattttaaaatacttgaatttttctcgagtattatatttatatcagatactactcatcctatatgtttgttttacaggatccagatccagatatgcataaaagggattcatggctttaagcttatctcttacgcttcaggaatgggatcagtcagaacatcaccaccggcttgctttcgccgccgccgactggtgtcaccgcctgcacggctggcctattatgccgctgttgttgggtgtctacgtcttcactgaccggcttgccctcgtccgccgccgactggtgtttccgcctgcacggctggcctattatgccgccgttgctgggcgtctacgtcttcaccgaccggccgcctcatccgccgccgactggtatctccgcctgcacggctggcctattatgccaccgttgttgggcgtctacgtcttcaccgaccggccgcttcgtctgcagccgactggagtttccgcttgcacggccggcctattatgccgctgttgttgggcatcatcgacttcaccgaccggccgcctcgtccatcgccgactggtgttttcgcctatacggttggttggtcacaccaccgttgttgggcatctacgtcttcatcgaccggccgcctcgtccgccgccgactgatgtttccgcctgcacggctgacttattatgccgccgttgttgggcgtctacgtcttcaccgacaggccgcctcgtccgccgccgactggtgtttccgcctgcactgttggcttattatgcctccgttgttgggcgtctacgtcttcaccgacaggccgcctcgtccgccgccgactggtgtttccgcctgcacggctggcctattatgccgtcgttgttgggcatctacgtcttcactgaccggtcgcttcatatgacgccaactgatgctatcttcttcacggctggctacgtcgtcgtcaccgctaataggcaccgtcatcttcaacgcaagctgtctacgcctgctgccaactggtttattcacttccatggctggatgattctgcccctggttattggccttatcgtcttcaccaccggtcgtctcgtctgctgttgactggtgtcctcgcctctacggctggtttatgccgctatcactactgatggacgtcattgtttttattgctggtcgccttgtctgccgccgactggtttgttcgcctccacggctacgcgtcttcgctaccggtttgcttctgttgccgccgactcgtgttcacttcatcacggctgtgcaactttgtcaccatggtggagctacttcatcttcattattttcggcaccggcaaactctatagcctctacttcgcatgatttgccacttcaccaaccacgacgtctacaatagcctcgacatctcggcatgtgtcacaaaatatgatgccgtgttattttactacaacaagtgatgttccaatcttcaatatttatcttcactcaagcaatgattacacgacgacaagaagctacagttctcgactctatgttcagttgtttcccaactaactaaagagtcgggggctacacaaatacaagactctcaaaattcgacaagctgaagcaatcaattaatcagccaactagtcaactccaggagtcattatcttcatctttgctttagagcagagttatcaaccaatcagctcagtttcgatgagatggacaacatcatctactttcctccaagtgaagcatctacaacagctataacaccaatttgatggattattgtcactgacttcatcaccagcacctctacttcattggccctgacatctctgccgttgctaatggatgactacgtcttcgccaccggttgcttccgtcattgccggcttgttatttcgccttcacggttgacctactatgcaaacgctgatgagcgtcttcatcattatcattggttgctacactgctattgactggatcaccgacatcgtcatcttcatcatgttggttgcgtttgtcgtcgccgactatttccttcatcttcatgattggtggatttcgtcattgcctttgatgcgtgtctacatcttcaccgttggcttgctttcgtaaccatcgattggtatcctcgccttcacgaatggcttattatgtcgccactaatgggcatcttcatcttcttcaccagctgcctcgtctgtcatcgactgattatttcgctgccatggctacacaactttatcgctgggcgccttcatattcattgctggctgacctgactgctaccgactggtttcttcgcctccacggctatgcaacttcatcacttttgattggtatcattatcttcactaccaccaatatttttgccacctctggtaggcaatattatctctatattggtcgtcttgtctctatgccaactgcgtcagctacgatcaatggacaactgtgattacgacagaaggacaagctatatgctcaggggcttagctcaaacacaagtatcataccttcaatttggacttgctctggatacatgcaacatgaattcataaacatgggtctattttctatgctcaaagactggactatttattattccctataagggttatcaaccgaatacttgtgtcagtcgggattcaattattatatctatttcggagtatcccataagggataatcactcagatcagaagctattcatatgagctatacttggtctatatcacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcatctttttgcttaggcaaaagtgcgcgtgattatgtgcccaataccttaaaatccttttatatcgcagttactcaactttttaggagttggtacattgcattttaaaaggtgccaaacagtaatgctttatatagctgcccgctgacttttttatataaatcaaggcgttgtttgggttcataaagcaattgattggatacaatatcattgctttttgccacgtaagtgtgcacttttattgaccaatattatggcttaggctgattatatattttggtcattttccaggcggttggtaaatcctttatgagtttatttactcgaattttacaccacatatgccgtatatttttgggtgtagtgaaaccatgtgtcttttagggacttaagcacatctgttaaagcagtgtgcgcatggcgtatgtccaatactttggaaatttctttactcacagcattcgagcttttttatagttgttttgctatgtgaattttcaatgatgtagtcagctttaggttgcatgcatcaatttttacaaagcagtcggtatatcacttggatcatgttgctatatattaatattaagtcacttggttgactacaattatcaaaaccacttggttggttggattatttattccttgactatatgcttggtttgttcaattaaccacatgatcgggggctaaaccaattaggtgcatctagtcgatgcacctgactttatttttcagccatccacagtcttctgatttagtaaaagtactcggaggtcatggcgaagatgattgaagcactcggctttggagtaatctagttcgagagaagattatcttttcgactgtgaaggtctcaggggctactgtggagattatgggtaccccatacccacacggcatggttatccaactagttataagggataacttatatatatgaaatctgtaacagatcatga

SEQ ID NO: 66582 - DNA, 30374 bp, Oryza sativa
  unsure (1)..(30374): unsure at all n locations
agctaagtgcctttatttttcctctttatgtgatattttccattgagcaatttttttatatctactcatgctaactactcgtccagcgccggacgcctagttttatcattatttatcatattgatttttaatctcagattaatctcttgttattttttgttgttgttcgcatataattacgcggcactattgaggcgattaatgctggtcatggagtcgaggcgtctcagctttccggtcgatcggccgcgagtccactttgccggcttgtcttcgccaccgccattgctgataacaacaacgacttcaccgccggcctgcttccgtcgccgccgagtggtgcctccgcctacacggctggcctattatgccgccgctgttaggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgctgctgttgggcgtcaacgacttcaccgccggcctgcctccgttgccgccgagtggtgcctccgcctacacggctggcctattatgccgccgctgttgggcgtctacgacttcaccgccggcctgcctccatcgccgccgactggtgtcctcgcctatacggttggttggtcacaccaccgttcatgggcgtccacgtcttcgccgaccggctggccttcgccgccgccgactggtgtttttgcctatacggttggcggacttcgccgctgttaatgggcttcatcatctacaccactggcttggttccactggcgccgactggtgtttttgtcaccattgatggactgcttcgttcccacatcggctacttttgctgtcatcgagggaatacgacaaagctaagtcatcatttattttattctttatatgatattttgctttttcctttgcctcgctacctcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccggggactcgttggatggaccgagtaacgcaaggtgctgagtattactcggaagaaatcaaaagcatagagataatataatttattttctgctcttaataattgcaaaagtacctgagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccaccgccgactggtgtttccgcctgcacggctggcctattatgccgccgttgttgggcgtctacgtcttcatcgaccggcttgccttcgccgccgccgactggtgtttctgcctgcacggctggcctattatgccgccgttgttgggcgtctacatcttcaccgaccggccgcctcgaccgccgccgactggtgtttccgcctgcacggctggcctattatgccgccgttgttgggcgtctactagtatgagtcttatcccattatagattgctatattctgggacggagagagagagagagtagcttttaacaaagatatgacacatgcctgtacatgtacggttcttgttgcctggctgccacaatataattcagatctgaactgggttggcaactgctgcctttgcctccattctataaaaatgtatggctagatttatagtattaaaatgtgttatatcagtactaggttgattttttatgggacggaggaagtatatcatactaaattacatggagtcatggatatatatttttgtacacctaccacgtttcaaatgcataacttaatttggaccattgaacgactaggctaacacacattttgttgttggagtgtgacgtggagtatcgtggagcacagatatatatgagcagcttaattagctagctagatcgtcatctttcgctctcattaattcccattaccgttagcctggatatgcaacagttttgcatttaaggcgccaaagctccatataggcatcaaaattttgcgaacctttaatcactgtcactgtatgaatgaatctttaattaggctgatatatatatgcggcatgtgtctaaattaattatgatcgatcagtagccatgaattaaatggttgatgcatttgcttgtaccttctgttggcccgttggagcgcgagtatcatgtagtgccacaatatgctgacataacaaatattgcattatttattattattattattattattattattattattattattattattattattattattattattattattattattattattattattattattatttcataggttagtttgattggatgcgcgtgcgcgtgcgtgcgtggagaacgagttacagtggagtacttatataatcgtgtatactgttctcacaacacgatacatcagtctgaattacgaaagctctcgagcataagtaagcttaataatgttgtgcacatgtaactaagatcatggactcgtggatgtgtgtggttgcccaaatttattttagttattaaaagaaaaggaaaaataaccgtgttcgtctatttatatttatgaacgaagggagtttgttacaatgatttattcgtgaactgtttctattcttcaattaatcgagagaaagggacacaaagtaacactcctttttgcccacgaaccgaaaaaaacactgctaattagtcatccatggatccatcttctcccttccgacaagggcaatagagacgacgacggttgctccactgctctccggccgccgtgtcgtggtggtcgcctcgtcggcacggtggtcaacttggcccatctatgtaagtcggttgatcgtcggcacggcgccattaattaattactccggccgaaagtgaccatatatacgtactgtacaactctccggcatgcagatttgttgatccgctataagttaatatcactcgcgttgttcttttcatctacttcatcgaatttgaagtaattatgtagaaattattggagaaatgttgtgattgattgacaagataaaaatagatgaataatttaaatggagaatgcttgtaaagaaatagtattattttgggtgaacagctaaagtgatcctccaagttttattctaggctcagtttagtccttaatgtttcaatttgtccatattagttcttcaagtttttattttagtttaaacttatccttaaacccacttagaagccacatgactaaacataacgaacaactcttaataaataacgcttatactccttcattcactagaaaaaattgcatgcaatgattttttttatagataatgcatagtacttatgtaaaacaaaaataaattatgtactttcaattgtatagatagccattaggcttaagtttcatgtgcacatattaaaataatagaaattacatctgcaatattgtttattcatcttgtttttctcttttatagtgtagtatacaaattaaaggcgaaagggacattttctaataaaaatgttgactaaaaatagccatatggcacatcaagtgggtaaaaggatgattttaatccaaaacaaatacttagaggacctatatggacaaaacgaaacctaaaggatcaaattgagccttcggtgaaacccgagggactgaattagctattcaccctattattttaagacaaaatactatactagacatatagctatattttaaaatgaaggtggtagagatcaatataaactgttgatttgattctatgtaaggggcaacatttatttatactatcgtctcaattaattaattgaaggtataaatattagagggtatatataatcttcaataatacaaatatatagaattgggtacttcaaaatttgggaccaaaatagccaatcgatacttcccaaattgtagcgataaaataagatatcaacgggtactttctaaacagtccaaataaatcgatatacttcacaaaaataaatgggatgagtagtaagaaaaataattatcgttcaaactatttcttctactattaatagtagaatattatatagagaaccataacaaataaagctcatggaaagtgtccacgtcgcaatgacggtgggaacatgtgggcggagtgtccatgctattttaatcccagcagaacgggagatgtaaccgacatacgggcggctcccctgtgatgaaaaccaacgtgatcatgatgcgtgcattatgtcagcttacacgtaatgtatgtacccctctgtctaaaaaaatattaatcctacctacgaatttagaaacatatatgttcgagttcgtggctaggaattcattttttaaggatggaatagtacgtttgaaatttggctggatacatttctatataaaattagaatcacccgtagtattctaccgctagtagaatactactatataaaccattaatttatgggcatgttcggctgcccgggctgcagctgcgccgcagccggcacgaacagtgccgcactcactgtgcgcagccgcagccacggctgcagctatcggcctgccgaacaggccctataagggcacgtaatatattctattaatatatagttagagataattgcaacattatttttttcttttcgagcctcgctacggtgctttctactagtagccgaaaacaatctgaagtgttaattttattttatcgaaggattccgatctatttatactaccaccccagttagcggtagtagaaatatggagatacattattgtcaaaaaaaataagtgtggagggatatatatacttgttatttagcaatgactaaactttttttcctcttttttggctttttgatgaaaaatgagtgatgccggcgtaatagatgatatgattacagatggatttagttgaaaaaaataaaagataaagtaacttctaatcattatattaataaattactctctttgttcctgatatttgacgtcgttgactttttttaaatatgtttaaccgttcgtcttattaaaaaattaagtaattattaattctttttctatcatttgattcattgttaaatatatacttttatgtatacatatagttttacatattttacaaaagttgttgataatatgaatggttaaacatattttaaaaaaatcaacaatgtcaaatatttagggacggatggagtactattttagctctcataatatactaccaataaagttcttttctttatagtgaccagtcactggtcctttcgttcccgcgtgcgctcaactccagcggcagtgccctctctcctccgtcgaacagacaaaatcaggcaagctattactatactgaacaaatcaatatatatagtcaacatcgagcagcaagaacacaagtaattaatgttagacactccccatgattatctttaaaacacatatatttgattagtttctccacatgctgtgttctgttcttaattaagtcgttaacagtgctgaatttctccaaaggatcgtacccaagtatttcagttcagaatagtcatttgcgcagttcagagtgcccattagaatggtgctcaaaacactgtaatgttgattggcgcttaaatccttgaattgacaaggtttcttgccctagtctcaaggtgcaccagccctggccagcgcatgacctaagtcacaaaagttaatggatggatggattgagaaactggaatgcaggacattattttctaaaaaaataaaacgacgaggtatacctcctcctaaaatatggaacgttagttggaacgtgttcctaagttatttggaatgcccctctatctcttcatggtcatcgcacagcgcgacaagagcaatgcttgtccagtctccactgcatgatggtgctgacgcccgtacatacacaacatgatattggcgagcagtgagggagcaacaacagcgcttgtcccatccagatgagttcaaatttagtgaaagttaatcaaattatagattttgcttgatttggattgtctttccatcattcgctccatcgtgttgtatttctttatcagaccgctctattgttactccatcataccttgtactaggatgacaagttccatccattttcgggacaaaaattccacatagttcccgcttctcaatccggaacgaggaacacacttaagttccacgttctatgtgacatagcgcatgacctccttatgtggtttccaacttatatttcaaaagtacaaatttacccctccacacatctgtattaatgtggactattataccctcttatgtttttattgttgttaattgaggtggtggtataataagatttgatcccttttgtagaactagcatagtggctcgcgcagattgcgcggctagtatcattatattttctctcatataatagtatatatgttttctcattatattattcaaatatattaaaatgataacataattttaaattttgcaataactttacaaaactactaatgtgtaatattcatattatattttatatacatgttagttattaattacttttaatatcaaattttagttatttgtaaattatatatattcctatatggactctagactcgtcttttaatatttctttttttttaattctgaattttctgtaaattgtatttctatatagactctatgctcttcttccaatattatttatttttatttttgaatttttattttttctaattgtattcttatgtggactctaaactcatctttcaacattctttaatttttaatttcgaatttcagttacttctaaattgtattcctatattgactttaaactattcttccaatatttttcttaatttagaattttagttatttgtaaattatatgtttatacggactctaaaatctacttttaattttattatgtttattccaaattttagttagttttaaatttcaatatggactctatactcaacttctaatatatatttttaattccgaatttatatgtttttcttaattgtatttctatatggactctatactctacttctaatattccttgtttttaattccgaatttcagttatttcctaattgtatttctatatggactctagtctcctcttctaatattccttattttttaattccgaatttcaactatttctaaattgtatttctatatggactctagtctccttttctaatattccttatttttttaattccaaatttcagctatttctaaattgtatttctacatggactctgctttttttttctccgattaatgtgagaatttataagccatgagagcgaacgtggaggctcatttttctattcctttaataatataatagatatgatcaacggattagattaatttgtaataccagtatagtgcattgtagtgtggcttaaagaaaatctaaaatgacctgtgtataatggaacctatataacatgttcacttctttttttttcttttttttttgaggagaacgacggcaggagatctgccggaattttattagagggagaaaataaagtgcttacagtccagagaaaatatgagagacttgcaccgaaacaaattaagattttcacggaatttcattagatgctctctgtttgttttttccttttcttctggcaatgaagtatcacggatgatgatgacttgttgctcacaacaatcctattatagtcacgaacaattcgccctgattccaagaaagttcgtcaactcgaaatatggctagaaaagcaacaagcagaactaggagctttgggtattcagaagctgacaaacacaccgcccacacacaggattcggcttcagaatagcccctgctttagtgttcaggccaaggactaggcaggattagttttctcaatgaacaaccaagcaaagctgattaacaataatgtgttcaggaaacctagctgtaatgaatgtgcaaggggaataagaatccatcctaagttgttcttagcctctgatgaggaatttgctatattacagtcaaactgaatggcctacattacagtattacactgaaccaaccctctgctgcttctgtcctaagctggctacgcaaagaaactaaacccgtcatcatcttgtccaccttctcatcatctcctaaaccggaggagcacataatctattaatcttgtccagaatcctcatgagcttcttcttcttcttctcatcatctctggacacaaaagttttgtctctaccaaatccacaaaaaccaacaccttcagctgccgaagaagttgcattttgttctgatgatgatgatcatcatcagctccggttgtgtatcgggtcggagcctcgccggactcgccacttgctcgtctgcgccgcggccgtcgtcgccgcgaaccgctccttcgccgcgtcgacgccgacgacattgttggccggaggcgccggcgccggcgccatagccggagccggagccaggacgagctcggctctcgtcaggccgtgcaccgccgtggcgtggtgcagcgccacaaccacgacgacgacggtgcagaccaagaaaaggtcgagacggcttgtgtgctgcaccatgttggcttctgctgctgctgctcagatggagacaaacaagtctctaccttggctctctctgtagctagaatggtttgtacaatgatcaatcatggtgatgtcttgtctctagatatagcaggggcaggcagtgtcgagtccaaaagcacaaagggacaagtgaagccaagcacagcatattagcatagcatgcctaaggctgtgcaatggaaggttctgaaaacctgaaagtttgagggaggcagattttggcaaagtcatgaattggggggggtacttatctcccaacagacaaaacctaaagttgcaattgtagatttgtaggggataggaggagcaacagtatgctagaaacaaagacttgctttagctccttgttgttgttatcttccccttcttggccactgtctgcagtaaaacccccaacactaaagcagcaggcacagtggtgagtgaaacaagtgaggcttttttgcttttctatctttttttttgttgttgtttgttgttcttggttgaaacacacttttctctttgaatcttcttccaagctaaggccaccaaagatgggggagcattcaaaacttaaaaggaagtgcaccaagtttcaatagcctctttcctcacaattttctatgtgtgctacttgccatgcatcccaatgctttagttgctctcctagctttggtgcaggaatggaaagaatggtgaatcttaaagcattttcaggatccaacgacggttgtagcttcttggagctgtgtatgtgttggactggtcatggtctaaggaggccgttttattggtaccaaagcgaaaaaagaaagagagaaaacagtagctactgaatccttttaaagtggaggcaggccaccttagcttcaaatttgtaataaacacagcacttagatgcataaattttaaaccagaagaaaatcattataaagagatggaagattatgtaaagattgcttcttgctaagtgggttagggagcccacaaaatcttcctagcaagctgcaaaagaaaaaaggaggggaaattaaaggtaacagaatgaattatcaatggtttgcccttttgtttgaagagattcttaaagtgctaactcaaatacttggtaaagtcactatttgaaatatatgtatacttgctaaagtgcccagaaattgataatgggaggcttttgtccgggacagcaatctacaaaataggattccattagaaaaggagtaatcatattgtgctggttcatgacactaaattaggtctataggaatactctatcagaaagggcacagcaaataaattaacaaacaaatatttacttctaagttaagcaatgcagcatacaaggaattgatacaatgctggaaaagatcatgatcttagcagagacaagatattgatcttatcagagtaatgatgacaccgtgattaaagcagcagcacagttcaattcaaaaaaaaaatagcactgttatttttcctgctttcgtagttacatggaaagtttatgatgtgtctttaagtttatgatgttcataaagacactcaagtacagaacaaacaagcttttaccaaagattgcagagaatctaatactagtagttttacccacccactctttgagtatgaactgtaatgacctcccactttttgctatcggaggtaatcaaatatgaaacagtgaagttaagaaggtgcatttgtcatgtactcctgccagataaagttagaaccgaaagaacagttaactgttcacaaatgacacgcattgaactatagtacagtaattaactagccacaggacgaatctctatgtaatccacgatgcgtggcctggccaccttgtaggcttgtacctcctccccttgtgattgtgaggatcgaagcggccacaggagcacacgtccgtcgatgtacgatgcggtcacgcagactgtggaatcacggcgccggcatggctcctgttatggctcctgttgagccgagtttagcgcctgttcagtttgatgctattttcaatcttaccaaattttagtaaaattactaaaaaaaataactacatttagtttgctaccaaattttggtaactatataagaaatcctgccaaaactttggcaaatggcaactataccaaaattttgaaatgtgtaaggtttttttagcatcaaagtgaacaggcccttagtttcaaactatttcttcaaacatccaatttttccatcacatcaaaactttcctacacacacaaatttccaatttttccatcacatcgttccaattttaaccaaacttctaattttggcgtaaactaaggccgagtttagttctaaactttttcttcaaacttccaacttttccatcacatcaaaactttcctacacatataaacttccaacttttccgtcacatcgtttcaaaccaaacttctaattttggcgtgaactaaacacaccctaaacacacccttaggtgtcgtaaaacacgtgaatgttatggaaggatctaatatcaaataaatagaaggggtgaggtttcgaacccaggttgtctagcccaccaccttgtggagctagctggaatacctaggtgtttctccactttaggtgtcgtaatttgtcaccgagttcaaaattaattcctaaaccgtcgtatccaagggtggagctagaacgaaatggggagggggtggcactgcttgctttactctgctttaggtcgagtttaagctgatatgagtgtttgagtttgggttgaagagggcgcatatacggtgaaaatagatgaaatataactaaaaaatttcttgaccgggtttctgggcaccccctcttttcaatgtagctccgcccctggtcgcatccctcaacttccaaaactagaacacctcaaagcgttttcggctaacgtggcgtctaagtggtgtcgacaaagttagaaaaaacataggatgtcccgtcattttccctcttctttccacatcatcggcctcggcaagaactcctgcatcagcagcggacaagggtagtcctatcaacacatcctcctttcggcgaccacacgaacatcagcttcacgagcggcatatccggctgcagcgccgccgaccgggagatcacctgcaccacctctgtcatgctcggccagtccgacgggttaggattgctgcacaccagcccaagcaaacagtaacctagtggcatcatttgcatcaaattcttcggtactagtatagaagaagaagaaacgccattgtcgacggcgttaagcaacctccaccccagtcgacgagcaaatatcaattcagagcaacatatccgaagcatagctaaccaattcagagcatcatatattacatctaactgttcattgatttgatggttaactgtgcttcggatatactctctccgtctcataatataagggattttaagtttttcttgcactgtttgaccattcgtcttactaaaaaaagtgaaattgttatttatttttttgacttactttattatccaaagtattttaagcacaacttttcattttttatatttgcacaaattttttgaataagacgagtggtcaaacagtacgagtaaaaactcaaaatcccttatattatgggacggagggagtattgctctgatatatcaattcaatcgacggcagcttaaacatctcctggaacatgcagagagctcgttcgtcggtgacgatctcgagcaccagaactccaaagtactccggcacgatgaagcccaagcgggtttcatggttttctgtgactttgttaacgctacgtatacatcacatcagttaaaatcgtcatctaaacagattaggatcttatttgcactggttttgagagttgagggacacgtcatatctggtattgttgttcagggatgaattccagactcgacgacaaattgagggacctaaagtaaacttactacggaggaagaagaagcacttactgggccatggcccacaacatccggtccatctattttcatcgccactatacctccggcccacggacgcgacgcgcttacacacatggcccacatgccatggtgcgcaagcgcaaccctttcttcctcctctgtcgctctctctctctctctctctctctcctcttctccactttctccctcctcgctagtgcgctctccttggcgagctcgctccgacgaacgccaagcccattgctccgcgtgtggttgggagagtgagaagagaggagatattttcggtgcggtggggaggggggattgagagaggccgaatcaaccaaccaacacctgcctgattcatcttctcgatcgatcctggggggtctaagctaatgcgcgccgccccgatctcccgatccggtccgcgcgcgctcgatccccgcgcctgatttctcctccccgcccgtcgccgaggagagctccgtccaggtagcgcgcacgcatacgcaaaattttggcgtatttaatccatgatctgtgtttgcatcgaatggataggacgtgctcttttgacttcagtcggtgctggtaggatgaaacgatgcaaagatactgtgttgttgaagacataatccgatttaaaacatttcttgttaacttggaacaagttatctaaattttcggtagtgatagtttctgctgtacatttttttccttaccaaatctaattcaattgcagaatgtagtaatgtattgatgcctttggctggcaacatagagaggttcatggactcgtttctagttctgctagtttcggtacttacatattttctgcacatatctgcatgttttttttttggttgaacataattcagttgtataatggactgatggcttgattagtaagtttcattggaaatataaggagcggaaatcaagaattcattccattccttgcttaatgtatgccattgatgatgaacttcagagttattttttagagtaaattgcacagaaccccatgttttatggtcaacgttgcttaagagtaggtacaatagcaggctataagccagctataaacatattttaaagagataaaggaagagagagaacagcagcgggctacagatttgtagccagctgcagcacggactccaaaacgtaatgtgtgtatgacaggtaggaccagatattaatagtatagtaagcaactattgtatgaattggctattacattggctatagatgatttggagctaatagttggctatactattaaacttgctctaatctatacatgtggttttctgcaactttgaccatagattgaggggtgttctaaaatttactcttatttgtaacttgtcggtttgtccatacttgtgctatacacatttactgaatctaattgtatttatcttacagtgaggtatggcgcggagttcaactgagagcaggaccaggaccactgtatctgtagttgttttatttggcctttgttccttcttctatctcttgggtgtgtggcagagaagtggtttcggaagaggagacagcatagcagctgtggtgaacgaacagactaaatgcgtggttcttccaaacctgaattttgaaacccatcatagtgcttcagaccttcctaatgatactgggagtactgaggttaaaactttcgagccatgtgatgcacagtacacagattacactccctgtgaggagcaaaagcgtgcaatgaccttccctagggataatatgatatatcgggagaggcattgcccacctgaaaaggataagctctattgtctggttccagcaccaaagggttatgctgctccttttcattggccaaagagccgtgattatgttcattatgcaaatatccctcacaagagcctcacggttgagaaggctatccagaattgggttcactacgagggtaaagtgttcaggtttcctggtggtggaacacagtttcctcagggtgcagacaagtatatagaccatcttgcttctgttatcccaatagccaatgggaaagtgagaacagcactcgacactggttgtggggtacgtaaaggattcaactctaaagatgcaaacttagatgagcaatcaagcattagtttttgttgttcttatcatgttacggagtttaatcttttaatgctttttcctgccacaattttgttcaggttgctagtctaggtgcttacctgttgaagaaaaatgttttgaccatgtcatttgcaccaagggataatcatgaggctcaagtacagtttgcactggagagaggtgttcccgcatatataggtgttctcggatcaatgaaactgtcattcccatcacgtgtctttgacatggcccactgctcaaggtgtttaattccatggagtggaaatggtaaaatcacttttagaatccttactgtttaaaatgttctcatttaaagtttacacatctgaagcaagctggttgctctggttctgcagatggaatgtacatgatggaagttgatagggtactaaggcctggagggtattgggtactctcaggcccaccaattggctggaagattcactataagggatggcaacgaacaaaggatgatcttcaaagtgagcagagaagaatagaacaatttgcagaacttctttgttggaataagatttctgagaaggatggtattgctatatggagaaagagaataaacgacaaatcctgccccatgaaacaagaaaatccaaaagttgacaagtgtgagttggcatatgacaatgatgtatggtgagtgacattctttctgacatcctccacaaaaaaatatgccgttttaatctatatgatcttttttttttgccttcatttttctagcacttacattcttctgaattcaatttccttcactaaatacaggtataagaaaatggaggtctgtgtaactccccttcccgaggttaaaaccatgacagaggttgctggtggtcaattagagccatttccccagagactcaatgcagtacctcccaggattacccatggttttgtacctgggttctcagtccagtcatatcaagatgacaataaactttggcagaaacatattaacgcttacaaaaagatcaataacttgcttgatactggaagataccgtaacataatggacatgaatgctggccttggtagttttgctgctgcattggagtccacgaagctgtgggtcatgaatgttgttccaaccattgcagatacttctacattaggtgtaatctacgagcggggattaataggaatgtatcatgattggtatgtaatgcttctctgtattgctctcctggactcatgttttggtcattgcactctatttttctcacttattcagttattcttcgtgccattgtttctgcatactattttttgctttttagaggagacacattttactttaccaacatggaaaacctattttttttaatggttttcatttgcttcagaaacatgtcaaaaacggatcaatttatttacttctgtagagactgaaggataggattgaactttagctctgccaatatcagttcaagctcttcatggtgaagttgcataataataaaatcagtctgttagttattctgctattgtaaatatgtgtttgttttgactgtgctgactgttagctttgatcagttgaaatctgaaaagcattggttgcttcttgttacataggtatatgtgttgaccatagtttttttattctttgtacaggtgtgaaggattttctacatatccaaggacatatgatctcatacatgctaacgctgtgttcagcttatatgagaataagtaagaatgtcatacattgcaaaaacaagaatgtgctcctaagttggtacatcttcctaattgatattttctatttacaaaaaacaggtgtaaatttgaagatatactattggaaatggaccggatcttacgaccagagggcgcagttataatccgtgacaaggttgatgttcttgtaaaggtggagaaaatagctaacgccatgaggtggcagacaagattgactgatcatgagggtggccctcatgtgcctgagaagatactctttgcggttaaacaatactgggttgttgaaagcaagagcagctaattacatatgctgggttgtttttttccactgagctcccaacaagacctaagacatgacttaattacatatgaagggtatgcatcatctacctcctctgtaaacttatagccactgtagtcaggaatgaactcttggcagcttgagttttccgaaaagttagcacccttgcaatgtggccttgccagttcttttcaaggtaaattgcactgcaggtataaatctttttcaaaaccggctgcctcagtcttgacaatctcaaccacaggtttcatcttttgatgtaaatggcttggatttgaaagttcatgtatgcaaggcttgtcatgaccgtatttcttttagccagttttgtctagccttagctggtgcgacaatttgagaatgctcaaactggcctctaatcttgcttgtttggtgcatttgtgctctaaggaggtgtcgcactgtaatgaaactgagatccataagattctagtattctgatcgtctgaaccgaggtgaccaataatcaaatttagctacgtatgtaatagttttttttctgttggtaacagacgaacgatttatttttagtgctatttgaggctgtccttttgagattcagttatacaaatgttgttcgattttgatggagctgcaacttgcagttcgtctgttgcaggcatttctctactgaaaatctgaaatgggtattggtctgtcggagtgttttgttttaccgggaaaaacaatttttctattgccagtcacctgtttttttggagggttttgcttatgtgtccgtattaatagtaattaccaaaattcaaaatgattttattctaaatggttttaacttgggctaaccaaacggatggttagatgtattcactctcgtgcatgcaatgtacaaaacttgcgtgcaggaattatgtactatgccggatggttagatggttaacttgggctaaccaaacggatggttagatgtactatgccggtttagaagcctcatattattttttttttcatactttgatggaaattcgggttccatgacgcctcacacttttaaccctaaaaatagaagtgacggactgtagattatcagttaacaaatagttattttattattaaataatagtcccagcaacatattgcaaccaagaaatagaagcacctttactttgtaataactggaagtccctaagacaatctttagcctttacaccatcttgcgcatgcaatgtacaaaacttgcgtgcaggaattatgtagcaaggtttactcaacaagtcaatatatactgccagagaaaactaataatggatgcatgaataataatttaacaatttatattttacacttccatcattcataactcatcatcgagtctaaatgtatttttgtaaaagaggttttcctaaaaagatttgaataacaagagaaatgcgtgaatcataatttgttataacattgtgaaagctcgtgggccacatcttttgtcttacaacgtatcccctccatcccaaaaaacataattaaaccttaggtttgaatctggacacacacatgtgatgtgtttagattcaaactcatagtttaatttttttctgggacatagtagtatatgctcataccaaaatttaaatcttaaaacttaattttagaattaattttaaggtttttattatggcttctttttttaatatcggagtttaaatcattaaaaacacatatgtaaaagttttaaccatatattatttttttacgctaatatgtcttttggcgtattatcagcaattggccaactgatggcagcttgtatcgcattacaaatcatgtatttgtaaatacttgctttctcttttttatataatggaatgtacttccggcctttactcaatgagctatagccaattattacgtcaaatcgctcaaaagcgctcacaatctaataagaccacaaaacacaccaatttaacataaagcaacacaaattaataagcaccaacacaagatgaaagacccataattattgaatcatatttgtaaatacttactttctcttatttttcgcccatcgaatgcatcatcgcaaaaaatattttctctataccaaacaataaaaaataggtctttttaatgccctgtttatagtccagataatttatatgaattttgaagaaatcaacatatttagccaaatggtagtactaggcttgacagcaaggtgtgacatgcatagccattatccagtcaccaatatccccattgttttacttatgcttacccttctaagccaaaatttaaattttaaaatttaatttcagagttgattttaagggtttgtcatcgtaatttattttacactatttgcttttgaacgctaacgacaagtatacagaacatttatcataaataagattttcttacctataagcgatatggataagcataagtgaaacaatcgaactgcaaaactactttgcgtgagagatgatcacgagcacttcgatgccaaacttcacaacgctgccgactataaatcatcgtatatcactaactttgtgttcatatatcgaagaaatatctatttctaaaaaagtgcctattttcaaaactatacttaaaaaatttaaaatctaaatcttttcatgtatttggattaggggctaaaattttagtccatgtcacatcggatgtttgacactaattagaagtactaaatagagactaatgataaaacccattccataacctagactaattcacgagacgaatctattgagcctaattaatctagtgatactacagtaaacatgtgctaattataaattaattaggattaaaaaatttgcctcgtgaattagctcttatttatataattagttttattattagtctatatttaatatttttaatatattagtcccgatatccaaacaccacctttaaaaaaaaactacggaggaactgggatagttgatgcgcaccggggcacgcacgcgccgtgcgttgggcgtgtggcgcaaccccacgcaccggcacgcgccaggccggcgctcccgcctccagaggccgccaccggccacgcgccccttcacgtggctcctggcccaccaccagatctctccaccgacccccacagacaggtgggcccgttcactcccgtggcccccacgtgccagtgagaaaccacccgccgccgcaacgcgcgcgccacgcgccgcgtcgtgcccctcccgcgcttgactcgcctcgccgccctctcccccttgctgttattgctcccttcgcggctctccttcttcttcttcaatcttcgccctcctcctcctcctcgtacgcgcccacgcggttctctttctgccccctcgatcgatttgaggtttgcccttgtttgctgtgatgttttgcgctgttaattgggtgattaatttgggggggtcgggttgggttgggtggatcgatggctgatgggttctttcttggtcgattggttttcagcagggaacggaagggggaggtttttggaggaggccatggtgccgtcggagaggggggacgtcgccaccgccatcagacccgccgctgccgacaagctcgtccatgggtgagtgactgaagtttcttggttgtctcgtttggggacttgggggatagttcttgttcttggaggaagcaaagagatagatgctctggggatgctaaaatttttgtttcatgatttgtctcgaggcgcagtttgtttgttaggcatcataccatagtgaatctacagaattagtgatgatgctcactactcaagcagcaaccctgcaatagtaaatgtggaagcctgccaatcatactgcgttagacgccgttggtggcgtagagctatatagtggtattggcaaattatttgtcgtcaggtttattgacttagttgttatctctgcatgtcgatttaattcttatcccttttccatttgggaggaaatgaaagttgagaattgtgcattgttgctaatgttgtaagttcccattgaaaccttgtgcaggcctatctctgacaagaagtgccggaagaaggtcccgaggaaggttcacaaatctgagagggagaagcttaaacgcgggcatctcaatgatctgttcggcgagctgggtaatatgctaggtaagctgttttgatcacaaggcattgcgtcagttctatgtgtctgaattggaaatttattatagcttgttgcgcagaaatacaaaccacatatctctctcttgaatgtcattatataattcgtattactagcaactggattcatcattgcttaaatttgctgctatttagcatctgatcaaatacaacaaccttctgcagaagcggataggcagagtaatgggaaggcatgcatactaactgacaccacccggatcttaagagatctgctttctcaagtaaaatctctccggcaagaaaacagcaccctccagaatgaatctaattatgtaagtaatatttgctatggaaaaaaaaaactgttgatttgttgcagttgtagaaccatttccctttctttggcgtgcttgatgatttacattgctaacttgtcgtatgcataatgcaacactcattccaacattgttttttctcccacaaacaggttacgatggaaaggaatgagttgcaggatgaaaatggtgcgctacgcagcgaaatctctgacctccaaaacgagctgaggatgcgtgcgacagggagtccaggttggggccatggcgcgactggatcacctctccccgttcctccctctccaggcacggttttcccatcgcagcagccaatgcagccatctcccatgacaacaagcacagtgttccccttgcagcagccactgccacaaccaacagtcattgagccctctgcaagacagccactggaactgaagctcttcctagaagcaccccccgccgaagaccctgaaccatcagaagaccaggaggctccgaacaatgtggcacgaccgcagccgaggtacccaacagaggcatcttcttggcctattagcctgggacttccaagaatggaagatgagcaaatgtagtggtagcacgatagatgatagcacaggtagagattgagagggtctgtttttaatgcatgcaggaattccacacgaaaacacttctgtccttgcatgaaaactggaaaatttcctgcattccaagtaagacctgagtagatcagctccaaccaatcagaaactcactttgagcctagaggatatactactgaatgatgtgcatgtaaatatttcaatctcccttttgtttctgtaaactctagtgagaatagaacccgttttatccccttgcaaatattgatgtccaattaaaatgcatttatgcgataattgcaatcgaaggaaaagttatgaaagaacaaaaattgtaagactatacgcctgtaaccagcctccaagccaacattatcacaattctatcgagtctgacgaaccagcaacatctcaatacaactatgcagcacctggcaaccaaacaggctgatatatagtagtatagcattaacattgaacacttgaatattttccattgctgttattcagaagaacaatccgtacaaaattttatgaactactccactccgtagctggaaaaagtcaccatgtcctttcgcacataatgtatctactgatacatcttcaaacacaccaacggaaatacgcgagagattatggccggtttcctctgaatggcgaaccagatgcaattgcaggtggctcttccctgtacggctgagtagcaggatcagtcacactgggcagtctctgtacgctccccttcccttttctagcattagggccaatttcttcgatcatgtacttccatccgtcaataggacgcctccggctaaatatgtgtgttttgatgaagctagcaatctgcagtcgcatttcaacaccatgtcagaaataactagaataacacaaaaaaaattgtggagagagagtgattgtggacctgctgtttactgaaagcaatccgcctttcgaattcttggagaagaatgtcatcttcccgctgtgagatatcccatatgctaccatcctgtcctctagaggtggtttcccaaccatcaggcttggttttgatctcagcagtgcttggaatctttgaatcgccaaaatctgtatttccagaatcgaaaatcctgtatttcacaaaattataagccagctacgtgttatagattgctaagcattttgctcacatgaaaaatatgcattcctaacttagcaaaaccaagagcttacggaaactaaaacattgtacaagccataaagcctccccaatcatgcagcaaaaaattgttatggcaggaagatatgcaaaaatgacaaatagactgacagtagcattaggagttttggagtgctgccataataccgagactatgagagtttatgttttaatgcctgatatgctgattactaagcaattgtagcaaatgaaaagaaaactgcataactaatgtcattccaaatgctcctgcttctatcaactaaatggtgagcagcaaatgacgctaacatatgcttgttcctaagcaaaatcaagtaaacatcgaagcacagtacttcctattttttgagaaaaaaataaatttgagggtgaaagatgtgaactgtactagatccagaagaaattcacatagtacgcataatttgtgaaaccaagctgctacattggaagcttggagataaacaatatatgcaacacggttatattttgaatgaaccacaccagatcaacatttaatttgtacatcatgcaacaaaaaggttatcaatttgacatgcagcaggtgctatgcatcaaaaaaataatcggaggcataatatacactattcaagtcccaagttatcaaacatatcagagtttcaccaatgagcaactataccagatgaaaaggaaatcacagcttttccaggctctagctacaaatgaactagccataattcatagtattgcccgacagtctaacacaatacctatctaacttataaaatacagctgaaatttgatacagattcatggtctatcagctccagattccaccaccaagtgcggtgcacaacgaggaatcaaataatatgcaagcgacattttggcaggcaaatacagtttaaatcgcaaatttgtctaaggggggaaaaaattagagcagcaacttactcagagcacgagtcgaggagtcggtcgatgtcgtcggcgccgccgcctccgccgccgaggcgcgcctcctccatcttctcgatctccttcacccacagcgcggcgtgcacccgctgcttcctcgccctgtactcgtcggcctgcgccttcttggccggggcgccgcccgcaccctccgcgcgaggagcggggcgcggccgcctcgacgcggcgcggcgctcggcccagcgctcgtccatgtcggccacgaaggccttggtgtcagggtccacctccgcggagatggccgggacggtggcggcccccgaggtgggggactcccacggcgcggcgggcgccggggaaaaggtgggggagtcgcccgggagccatgaggtctcccaggcgtcgttccactcgtcgtcgccggtggtcgcggtggcggcgccggcggcggctcgcgacggcggaggcgcgcggcggttagaggagaggcgacgcaggccagaggcggaggtggggacgcggagggcgcgccggagcgagtgcatggtgtgtgttcggtgaaatgcgcgcagagaggctctcctgttccggagtataggtagcaatcaactaagaaatcctctgcaatttgatacccatcttatcataagccctcctaaatacatttagtttggtaaaaaaaattcttttcagaaagccaatccaaatattgatgctcacagaagcgcgcacaaccacctctatgaacgtacattcggaaaactcatccgacatacgttgacattaacgaagtcatcacaggcacatcgttgtcgggtgcatcatccaccgctggaaaaaagaattagtcataaatgcaagccctcgtatcaagtttaagacttaaacccgagtggactatttccaacctaactagtcaaactacgttacagtgcaaaattccattaaaaacaactattttgaaaacgttgttataacgtcattatacccatccacaaaactcaaaaatccaaatcattaagaaactaactggcagagatgggggagatcgctcctctctcccccctcggtgctcctctcgacaactgagtgatattttgccaccgcttcacattatatattttgtacgctttgatcaatgagaatccatccctctcgctcttgctcccacactctcagctgtcttttcaacacaaattatttcaataacttcaatcaaaaccttttatgtacttatggacagttcgactgaccatgctccttttataagatttgcatatttggactctactactgtacttcctaaaggattagattctgaaggtatttatcctacagcatatcttaagatttaaacctcaatttgccaacctggtatttcttttttcaaacattatgaaactacataacaagttgaataaactttacagtgttacaaagaacttcaagacattatcacaattcttaggtttaatggatcatcggatcagtaccgtttaattgttgcaagagcacggaaaattaagtgcttcttatcacagttgatagcatactaggattaattaattggaggtcatataaaaccaagattcaatgtattatactacaccagtgttagtaaaatatttgtaatgattcttttttatgcatatagcttcttctttagaagaatttggaattcctttaccacacgtaaagagtagaagagataaagaaaaaaaaaagatagaggagaaaacaaagcgagaggtgttcaaccataggcccataagacagcccactatatcatctaaaaggccacaaaagataggcccaccaaggcaaaagctctagggttagggtttagcgcctgctttataaaggactccgcccccaactctcgtccgcctccactgcctccctaaccccacaatccatctcgccgcggcggcggcggcggccgagaccggcggcgagcggcgggggcgggggcggcgtcagccatggtgcgcgttagcttctatcgcaactgtaagcaacatccttgccttgtctctctgtacccgtgatccattggatcacagaacgtgatagcagtagcatctgatcccgagctagcctcttcagcagttttgataagttttgatacttaattacttggttccgcatttgaatctggagtccgagatctcgtcatttgaatctgttttggtagtccacgggcagattaagggtcttgcctgatttcacaaaggtaactgatttggtacatttgagtcgttttggttaatcggcttgctcgagtttgccagttgtcaatagttcgtttatgtgaattaataatcacagtagtcgtgcttgacgtggaaatgaaaactgcactctgaaatgcaccttttgaatcctaaccgaaagagtaaagtgtttgactataggggcatatatcttggagacgttcgctcatgatatgaggatcagtagctcttgatataaattgactgttgtttcaaacgtggttttttatttgatgccttagattttcgtacatttacctgatactcatggtgtgttgggctatacatgtctaatttcgcaatattaatatttctcagatggcaagactttcaagaaaccaaggcgtccatacgagaaagagcgtcctgatgctgagctgaagctgtatggtgagtatggcctcaggtccaagtgtgagctgtggcgtgtgcagtaagccctaagccctatccgcaatgctgcaagggagctgctcacccttgatgagaagaacccccgacgtatctttgagggcgaggctctcctgcgccacatgaaccgctatggtctccttggtgagggccagaacaagcttgattacgtgcttgcgctcaccgttgagaacttccttcagtgccgcctccagaccattgtcttcaagaacggcacggtgaaatccattcatcatgatcatgtactcatcaggcaacaccacatcaggtatggatttcaaatttcttatatgactggtgatttaacttaggtacactgctgaaatgcatatgcataaataaacatgggcttgattgaacattgattttctgttttgataacctcatagctcagtattttcgaactgcacttctgtttttcattctgggtcatgtgatgagaaacaatatgcaactcacgacggtcgtctgagacacttagtgtgtaatggtgcagtcatattatctctgatgccctgccatttctctttaaacttcttacattgctagggtcatgtatgtttttagttttatgtgaaccacatactatttttgcagaattttataatatcttattgttggttcataattgtcattaagttggtttggcacttggcattatgtagtagttccattttgttgcccttttttgcacatttttcttggagtttgtatttggtggcacaatgaggaactaactttgctaatgtatctatgaggccattaggctaatgactcaaaatgtccttttcattctgagtgccacattgtacatgactttgtttttctcttaataatggatctcacttgtctttcattatttgcatgttaaggaattgcgtgatcccatcatgtccacggtgattgctaggatttaatttgtgtttagtctcatattgatgcataaagctatcacagctatagtacttgtgtaaataggtcctgcaaaatgtgcaaaatggatttagtttgtctttgcgtagttgaagcctagattacttgctaaatgttgggttgtgcagagtgggaaggcagcttgtcaacatccccttattcatggtgagacttgattagagaagcacatcgacttctcccttaccagcccactggcggtgagcctggaagggtcaaagagaaagaaccagaaggaggcctctggtggtgatggtgatggtgatggtgatgaagaggaagagtgaatatgtgatgtcagctcggttttgttataggacctaattttgcgggaacttgtcttattagggacctaatttttgttacatgagtagaaaacaaaaattagccaccgagggttgtcaaaaattgttgtttgcgctgttgaaattttgatttgaagtttatctcctcatgaacatgtgaattcagtgtacccaggaaatatatcccaggtctcacaagctaatactgttgggaatatttgaagtgttgggtaccttgtcttttgaaaactggctttgattatactaaagcggatactaaatctggcctcaaaattgttctaataaatctggaattcgaactcgcaaataatttgttgtcacgcaggcatgtatattctagggatcttttgagtttgttggtgcatatgcgaaaagtggaaaccgctactgctgttgtgaagcgcttcagaattacccgttactgctgttgcgaagcactccagcattacacgttatcgcacgacgaaacgtcctaatttcagcttgttgccttcgttcctctgccttgccgaaccctctctgtcttcttcacttttattttttctatgatggattaaaactgcctctacaccacaaccaactctcttacggtgccatgcgatgtgttatcgttcattcgtgttattctaccatctaccgcctcctaatcactttcccagggattcccctagcgcctaaccactatatcttagttgttcgatagcctccactatccaacacccttctctgcttgttctatacccccatggcttcaatggtaccatcttcatctcatcacgttgtgtttacaccttccatattgctggtcctccatcaccttgacctccccctctaaacctagagccagtagcgcttggcaatgaccctcaacccttaccccgtcttgtcgatagagaagataaggaactctccaaagataaggatgcaggagggcaatagtaacatgaaaattgactaacctgacattgttagccaaaggtgtatcttgcatttctggaactacaatggaagtcatagcatgtttagctatctaatctaagctctcaaatttttaagtggtcctgcacttggaaaagtttggagattgagataggatcattatgctagagccttttgtaattgctctctaagtttatttccaatgcggtaagttggtaagtaacttcaactcagtatgttggagacatattgctttggaggagagagtggaatatgttggcgacatactgcctaggagaagaaaggggatgggggcaagtggcttcatggggtccttgtgccttctgcaaggcacgttaacctcacctggcattctatgtgtggtccaagaaggagggagcattgacctaagcatgaggaagtggtgatggagatcttatagcgatagatttggcgagcctgtagccacatcaggcgtagtcattgagctccactcaccatccgcaaatgccatcgggatcctcatcgtcatatccactccaccaagcccctagtctgagaggacaaacaacggcggagatcatcactgcagcaccaaggagatctgagataggatagctagccaccacaaatcttgtcaccacagtgcttaagaagggagcaagcataggcgaagaggagagaggcggcgaccatggtggcagcaaagaagggagaggagagctgatggagtgaatgagtgggagagagtagttatattgtttagtttatggaatttaggaagtgtagtgtaaaattttgaacttccttgtcatttagaaatagaagaggactaaatataaaatgttagaggctttgaagctacctatataggtaatcaaatgagccccatgacatgattaggcatggctagtgctaaaatccataaaatccatgccaatccacgggctacaccaacggctcaggcatgacctaataagactcgggccgtgccgtgccgggccgaaggcacgacaagcccagcgggttcttccttggaatatatntttttgcatgnggggtacggaatgtctactac

SEQ ID NO: 66583 - DNA, 60601 bp, Oryza sativa
taattatcactgaatttgataacgccatgtcaatggttgctagcggtatttctttttggaacttgaccttgctaattatagtaagaccatgtacaatagcagactattagccagctataaatatatattaatgagataaaagatgagatagaagagcagcgggctacagatatgtagccagctgcagcacggacttcaagacacagtgtgtgtatgataggtgggactatatatactaataatatagtaagcaactattgtatgaattggctattaaattggctatagatgaattggagctagtagtgggctatgctattgaacttgctctaagagaagtgcactgcttatttattcgtgggatcacattaatcagatgggttcagattatagcagtttagatggattgggtatatccgtatatgctagagcactgctaaagatgaatgagataaatatttttaaaataataaaaatggttcatatttcaggcttccgcccataaaacacacataaaaaaaagtcccaaaagataaaaagattcgatgttatgcgaaaaattctcatctccctcctaatgataatatctagctaaaaatagaaaatataaatctgtagatcctataacaaaagttaatagaaattaactaccagggatggagaaagagggacgagcagaggcccggcctccctcaatctatgtttacagtggcttttgtgaaaatttaaaatatcagtattattgttcttctccaataagtaaaatttagtgtttttagattctaagggtggaaccagctaaaaaaatatgaaaataacatgcattgggttaattagatgatctttctttttggttattggaaactttctgagaaatataattgtatttttaaaattgttaattcaggctttcaactatatacacataagagttactagtataaaattatactccctccgtcccataaaaaatcaacttctggctacgaatatggacgttgattttttatgggatagatggagtatataacaaatgttgtacgtttgagagacttaactctaatcctaggtggttgtgcggagaattatgctagtcctttctaagaccgacataccatacaagttattccaacaactcaaagtgaaaaaacaaaaaagatgagaggatgccgagtactgagtagtactgaccagtgagtaggcgtgggtctccagtgtccccatcgaaacgcagacgagatgctccccaatgagctcagcaaaaggaccgggcatgtatagtccaaaccgttgcatcggttcagtccttctgtgcccattggccctccaccttattactgctcttccatctccatgtggcagcacagtgcccaactgaccgtgcaccctctctgcaaatgtccttggggccaagtcatgagatgagaccaaggttgtcatgatcgggatattagacaatatcgttttcctcaaagtaatatcgtatcgtaggatcgtatcgattttttttaagtttaattaatatttatattaattatatatagccattatatattaaaaaatatagtaatgatatatgtcatacaaatagagacatttatcaagagaaaccatgttggtttgatatatttaactgatttttatataaatttgagcataattatttatattattttcaaaccatgttattttaaataatattttgtagtatcgtagggatcgtagaatcgggataccacctaagatttcgtaggatcgtatagtaatgaatagtagaatcgagatactatgaaaattaggatactaggtgggatcggtatcgttttggcttggtaggatcgtagtatcgtaagatactaggatacgaaccgggatattgacaaccttggatgagaccactgaaatcatgtcaacaacacatggtaagtccatttgtttgagttacggtttaaccttactccctccgttccaaaattacttaggatgagtcacatcccatattagattgtgttattttaagacggagagagtagatctttacatactcggaagacgagttacacgtggaccgatcgaatggaggagttaattattacatagccaatgtgaatgatcaccatgaaaatgaatgttcgttcctgagatagattcagcatcagagatgaggctataagctaatttaatcagatcagggacactaaattaagagtggaatcagatgagatcgcataggataatcccaaaaggatgtgtgtggtgtagcaacaagcaggcagcagtaggggtagttagccgatcggatgccgcacatgaatctgcgtctaaagtcagccccggtgcccaccaccatctcgctagaaaaaaaagaaagaagaagaagaaagtatcgcaattcggtcgcgcgagtacgagtattttaggtcgtcgcctcaggggaataatagtaggaggaggaggagattcagaagcatgtgtggccaactgtgacaactgataatactcgcagtacggcgcacgcacagcacaggccaggcaaaacaagaaagcaacgggagacatcgtggtggtgtataaatttttccatcgacttaattatcacatgcgcatgatctgatactcagatcgatcatttacggttatatatggtagtacgaggtaatgggctaatggcagattaaacaagagtcggaacagtgtctcctctgtaataactctgcatttattttttttacagcagttctgaaacttcaggtcggttattagtactagtagtaaagcagttagccatagtaccattgctgctgctgaatcatgtctctctcgcaaccttgcgttaaagaaaaaaaaatctctcttctcatcaacccaacgctgtaaacgatgcatcatcggcgcgatggcggaggaaatacgcacgaacaactaaccaagattgtcctatcaatactgctatcgtaggtgtaatactgtagaggatccgtgtccacgaacacaagtgtttccaggggatctctccggcgtcggcgtcgtcgcgttgggttggtggtgtcacaccaaacgcaacgggggagaggaggacggggagatcgacaggtgtggcgcacatgcgcgtgcagggcgatgtcgcctcacaattgtaagctgtgatgcgtctgagtcgcggatactacctggctgcagttggggcagggtttacgaaaccgcacggtcaccacacggttactatacacggtaaccttttcaatttttgaaactacggtatgtctcgtggtaatcacgcggttactgtggtaaccaccttaccgtgggggtgtggtaaccgcatcaaaaacggtaaggagactacttgagctttggtcgtcgtcgactcgtcgtcagggtccagggaaaaaaagttggtttcctttttctgcagatcgatcggtctctgacaatcttgcgatgatactgttggtgaacttttgtcagtttacgaatgatctgtgatggaaagtaagttgggggcagactagctggcttacgtctactgcttcacttcactttcacagtttcactgtatgatgataatgtgatatctggaatagtgtagatgatggtataggacggacaggccactatgtattgctatgtatgggtattgctctgtatcatgtgggtacaaacgaaactattattatctaaaaaaacaaacgaaactattataaaaagtgaaccaatattctccgaaattgttgtaatcgatctgggtcagcagttctgctttttccttgtgtgaggtgcttcctttctgaatgacaatcagttggagttggagttggagttgatgatagtagtttctcccttcattgttcatctattttgatcttttcttgggacatttcttctgctgatctttagagctacgctacattcagtttccattctgaaatctttttcgggccaaacttttggacgaaattgggagcttttatggatgaaattgaggcccaaaactgtatatagaatattgccgctagcggatgagcaaacacagcccacagaagagaactcactacgacaccaaacgaggccatgaccatgagcacatatgaagcctacgtgtagcaaatcgattctgccacgtgtctcactcctgcacacacaagtagccaccaaaaagaacgagagcctcacgctcccctccaccaccagcgagagataacgcaccggacgaacaccatgccgccgccgtcgtcgctgccgtccaccgccgccgccgccaccgcttccgctgcgtttctccggccgtcagcgagcgcgcatccagcaagcgcctccgccccgcccaacgccgccgcgtgcctcaggcgctcgccgcggcgccgcctggtcgcggcgcgtgccgcggccgacggcggcggcgccgagacggtgttcttcgacggcggcgcgcactacggcgacctggcggcgaacctggccctcgggctgacgctgctgtggctaccgctgacgctggcggcggtgtcccgcgccttcatcctccggtaccgcttcacctcccgccgcgtgagcgtcatctccgggctctccggcgccgaccgcaccgacttcccctactcgtcggtgacgtccgtggtggtggtgccacggttcatcggcgagtggggcgacatcgtcatcaccctcaaggacggcaccaaggtcgacctcaggagcgtgcccaggttccgcgaggtcgccgactactgccgctccatggccgccgccgagggctccctcgccgccagcacgtgaggtcagctgggaggcgattgctctgctcaagtgtacacttccttcttcttcttcttcttcttcttcttcttcttcttcttttttttaatcgtgatgaatctaattattgaagaactgtgaaaaaagtcgaatatattttgatttttttcccaatcttgacgaatctgatgtctagccttttggagatgttgataaagtaaagtgtgcgtgagttcgtaaagatgagtgcattgacacatcttgttactttttaaagccggaacaaacacatatgtgaacaattatatacactgttaatcactaaaaatttaaggtattataacggcgtgatccgtagttgggatcgttgggccttggatctgccactgagtgcaccttgtgagcatctgtcagctctatcgtttggttttttcatggaaacaaaaaataatttgtgaataaaaattttatatcatgtgttcttagcgatctaaagtaaagactgaaaagtaaacttgatgcaaaaccttaaaattagtttcaaatttaaaattgaaaatttaaatgttgtccgataagcataagctaaaagatgatgcatactttctgaaatgagaaaacactcgccgttccgggcatagttgttgggaacttgggccgtaagtccataacggagctgtgacttacgtgcggcccagaacggactgtcacttacgtgcggcctaattttgttgggccggaaaacggggagtgtggcttaacgtgcggccccatgatttcgtggaccgagccatacttccttttctgcgaatgtttatgggccaggccggaatatggccgcccgtaccacttgatctctcttcttttcgaggagaacacctaacagtatttgattcctgccacgatttgtaattaaaaatgtctacctttaaactttaaaccacttttaaaaggctgattcttctcgcacaatctagaaaaatgtatgtgtgtgtttgtggcaattctactggcgatggcaattggcaagtgaagatgctccagatgattgggtgtcagtcgctgccacgccggtggtagtggaacggtctaaccatgggtatagtagctcagctagatcaaagctctcgctttcttcgattccttctttttttctctgcatttttgccccttctcgtgtggtcgttcagcaatgtcaactgcatggtgcggtgtgtcgaaaagcttttggattaatgcttcctatgagctaatggctccatgtcgacttgtttaatggctgttaaattggtgagttgtttagcatatctctgacgctttgtttaatcttttccttttatggatttgactaagcaaagcaaagcacctttgggtttaattgccgttcatataaaattttctctcagcatagcaaagccatgtaagtagtgcaacgctgcctaactcaactcgatctcatccatcatccaatctggaaacagtgacagtgaaactgtaatagtagtaataatacgagttaaacaacaagaagccaactgtttatcggcaattgctgcaagaaagagagatgacaagcttaagaaagttcttgcaagcagaattctgcaacctccatcttctagaacttgacggattctcgttcgtatcctctccttcacccgtgcactcgtgcagaactgtttcttttcgttggctccgtcttgtagtggatgaggaatgggggaatttcaggctttgaattgctggctgacatatcgctcaatgaacggatcaggccgtagctgggagttggaattgattcctgctgctccccgtgactcgacatgaatcaagccaaaggctttaccaagtccatggaacgcagccaatttgttttgttcttcaggttcagtgcaatcttctgaagaaaacttctttcaagaaactgacagaccattcctgaagaacagaccaaacacgtacgtctatgtcagccacagatttcaggttttattcatgcaccaggataactgctgatgagatcatatgatcccacaataactgtactgaactgctaccatgtgacactacgagatcgagacgaaagaaggatcaaagcagcaggatctgcgtctgtttctgtcattcccttgagtgcacagcgcattgcagtctgcagaggacgggagtgttctcaggctgagtgtaataatgcttccattattttttttataaaaaatgacagagcatcacctagaagaataaaaggttggatgcagaaatagatcagtactgaatactgatttgtttgtggctgcaaacaaaagataattttgttgctctctctctctgaaaaaaagaagaagaagcatcatgtttgtgattcttgtcccttttgggtagaatcatttctactagcactctagctatgcaactttctttgtgccctgcaattttcagtgggttattaatatataatctatgcgattatgagaatggactacctgtctgtgggatctatgtttttctttgatgaaatctgtaggatgcatgttcaggctgcattcagatcatcaacactaacagcaaaatctggttcatataatagcagtagattggtcttcctccaatggtggataagacgagtattagaagtacggatgcaatgcatctgtgaaaacaaaactgaggctgctgcaaccaaaaaaaggtcagtgaggtccaacaacgtgcatcagccataaatcaggtcaaccctgacaataaacaaatctatttcgagtgtaaatgctttgacgatctgtagtaaaattgaggtgaggattatctaaactgttacattgactctcctgtcagtgtcaggcggcgacagaagcaaggagttttttctgcacataagtactctaatctgacgctgactgatccggggtgcatctctgaaagtctgaacacatcgggatacagataaaaaccggtagatgccacttcaaaacagttatcaatcagtcgaataattgtagagacagatgttagctgggaagtcagcatccggatcacacgagaacagacgccgctaaatatcttgccttcacagcaaatctgatagtatcaacaaacaactgaacgacacctctgaaaagtattccaaagcaaacaagtttgctgttctttttctcagaatggaagcgttaaactcgcttacgcatttccagctaatcaagcatgtgtctgactaatgaattgatgaatggaagattgggagtatgaagcaaccaagagctgcagaaaactggggattacttgcaagacagacaaagaacaaggacaggaaactggggaaagaaaaggaaaaataaagtggcagagtcagattctcgatttcctaattagtataggagactagggctagtatttaagcgatgcgataaggttgttgaatagaaaacggtttaggaaagaataagctaaagctattgaaattcgcatacgtttgcatttctgattatttattttcaaggagggataagaaaccatgaagtccacgtctacttgctacaagtgcaggaatctgctcactggagcaacttcttatttctcttgcttaaccagctaacataggtttcagcgtgattgtttggtcattgctcatctctttcttgtgttttagtacttctagctcactaattccgagtgcaagtctgcattttaaaagtttaggatagtacaatagtaaacttttttgatgataatcatggtgaaatataatactaagagccaaggggacacatttgctgattgcttgatttcgcaaaaagagaacaccaccttgcttcggcaaccatgaaatgttcactagtaagcacccattctttttatgctaaggggtgacggattgtcacaggcacgattcttaagctcctaaataatatgatttctaaataaaacttcctttatctgtatttcttagataacatatttaaattagatttttcaattttcgcctataaattattactacatccatcccaaaatataagaagttttgggttggacacatgtattaaaaaaataagtgaaattaaatgtgtgaaggttgtgattagttgagaagagaaagtatgggaggaaattaagaggtgaaatattgtgattggttgagaagagaataatttatcatattttgggatagatattagaggctaaaaattattatattttaggacgcaagaagtattatacactcaattccatgtatcatccatcggcacattattactggaccgagccaagagaatccgctagattattaaccaagcaggagtatatataaaatatcataatacatttttttaaaaaaattcttcattagtattcctgaaaaaactttaaaattaaaatttcttttaaatctttaactaattcgtttctaccctaaaataattgttataagctcacgctagtagcgggcgcagtaaaagagtatttgatggattattgactaaatatgagtatctcttctctctactacttaaaaaaactagaagagaaagtcggccttcttcattctctccattcctcacttacatctacgccgtgtttagttttcaaaatatttctttaaactttcaacttttccatcacatcaaaactttcctacacacataaactttcaacttttccgtcacatcgttccaattttaaccaaacttacaattttaacgtgaactaaacacagccctaaaaactaactatttctatctcgttctccacttccatagaaacattttctctcccataaaaaccattcactcttaaaaaaactgattctttttaaaaagactagtataaaacccaaacagcataatcggctcaaattcttccactaaactgaataaaaagaccgttacgacgcacgggtctacagctagtatataaaataactgaatattgaatattgtgagggtttatatgtaaatcttcccaatggaggagcaagaggtgtgttcaagtgagaaaggaggagaaaaaggcaccgcctctccatgcattaaggggctgtttggtttccagggacttattctaagtccctgtcaaatcggatatttggacactaattaagagtattaaacatacagtaattataaaatccatttcataagtttggactaattcgcgagacgaatcttttgagtctaattacgccatgattttgacaatgtgatgctacagtaaacttttgataattatggattaattaggcttaaaaaatccgtctcacggattagctctcatttatgaaattagtttttttattagtccatatttaatactctaaattagcgtccaaacatctgatatgacatgggcttaaaaagttttagccccatctacacatcacacgcttgccttcttttctagtactgaggtggtatggtaggtcggtctgtagccagccagccagctgattttgcttccgccgcttttctccgtctcttctcgctcccttccctccctcccatctccctgcggtctccgagccatccacctcgctgcctctgccgccttcgtgtcgtgcgtccctctcctcctcctccgcgtgcagccacggcgtggcaggcagctaccacagcagccgctattagctcaaatcctcgctggttgacctcagctgcgacgactcttcaggatgagcgagtagagtttctgtggcctcgtttctttcttgcggattgggggtgggttcgtttgtttctttccttccttcccgcgtgtgaggcagtgagccagtgacacgcgggaatcgatcgaaaggccggatctttttttagcttgggaggaggaggaggaggaggagctgcgcgtgtgcaggttcgagttgactttcggggttggttggttggttctttgcttcgtttgtcgctctgcggatttttttttccggattggtggtcgaggtcgatcgaaacctcgcaaagattggacctttgccgcttgcctgctcggttcttatctcgtttggctgagttttgtgctcatttggagcccctgttcctcttgattccttgcattattggccatcccttgtctcgagagagcttatctgccaaagattcttgggctagaaggtttcttggttcattgcacggttgagtagtagtgcccaagaggatttgcagcagaggcacaaagtttgatgggtggctgatagtttggtggattggatagagaggagaaggagcaagagggagggcaggagagatggggaattgcatggacaccacggcgcgggtggatcacagcatgaacaatggcgcctgtaagtttccttgatactctcttcgtcgaaattccaaatttgtcttgtatgtatttgtcactttcctatcatagctgtaaagctgatattggttgcttgggatgttgggttgtttgtcctactagatcgtggatttattgtgtgttgaattgggtttagtactttggtttgactatgttgaagataaaattttaagatcagagcatgtgttctgcaactagttatacctgttggcctagttttttttttttttttgcatgataattttttttagcctagcttgttagttgctgcttttgtgcagcttcacttttgtttttgttcctctttcttacttctatagagtaaacaaacaatagcatggatgcatggataaaatcatgttttctctagtccttgggaggcagaggtaatttttcgtgttgatcagactggattaacactatgaggtacatgtaactctcaatacctcccaaggaccaaaggaagactctgatagaacatagaaatagggttcattgaaatatcataagcttctattgttgtaaaaagggagtcggatattttctttaaatgaatggcaggaaaatctgacttggtagtcctgacgacctgaccatacatatgcagagttctgattgaatttgaacagaagcggtgcttttggatacattttgaatttcacattgctttgttaataacaagttgttcttatgcacatttcattaatttcttgttgagatagcagacccatcaaaagtgaccagcaaaacaagtttatcatctgtcccttccacgtttaagagcaattcaagtcgctcgactttgactctgccatctatgaaggacagaagtgagcttcctactcctcggacggaaggtgaaattttgtcatcttcaaatttgaaggccttctcgttcaatgatctaaggaatgcgacaaagaacttccgaccggacagtcttcttggtgaaggaggatttggacatgtctacaaaggttggattgatgaacacacgcttgctccttcaaaaccaggaagtggtatggttgttgccgtcaagaagcttaaaccagaaggtttccaaggacacaaggaatggctggtaggttcagaatgttacccaccgctgttttctgctgttctcttaagacatatttcacgataccttattcctatttttacgctgcagacagaggttaactaccttggccaacttcaccacaaaaatcttgttaagctgattggctattgctctgatggcgacaaccgacttctggtgtatgagttcatgccaaagggaagtttggagaatcatctgttcagaagtatgttctctattaaaaatatttatgccttcttgatttcctggtttctcatgtcttaaatgttcacatagttcaaataacattttttttctattcttgtaggaggtgctgatcctttgtcatgggcaataaggctcaaggtagctataggtgctgctaggggcttgtcgtttttgcatgacgctgagaaccaagttatatatcgtgatttcaaggcatcaaacattctccttgactcggtatggttgataattaatgttgactctaatcatcaagcttgtatagcttgttgagatgttctatcaacatttttccccttggttaattgcaggaatttaattccaagctctcagattttggtttagcaaaagcaggtcctactggggataagacccatgtttccacacaggtcatgggtactcacggatatgcagctccggagtacattgcgacaggttaaattttaattctttgctttgaataaatcatgggaagtcttttctgttatatagcatcggtttaaactaggatcagacatatgactgccaggtgctactgaagctttgaattatctaaaaatattgctaatgaagcttggtgtcattgctttacatttcccaagctcactggaatttatcttgctgcataaagcatcttatgcatattgccaaatgcccagatacataacagaaggcatatcactatattagttaagttagaaaaaaaattattatcatgttaccatttttcaaaggatcatattttgtatgttttttcccttaattccagcgcaggagagtcagtcatacctttccttttattttgtcttcattttctgaattcctggcacattgtcaaatgccaagtcaaactaatcttttcattgaggaaatgtaccactctgcgtagcaattaaatagatattgtatggtttatatctggagcaaccagttctcatgttacttaacctaaaactttataggtcgcctctctgcaaaggcagatgtctacagctttggtgtggtgttgcttgagttgctcacaggaagacgggccctggacaaatcgaaaccaggcatagagcagaacctagttgactgggccaaaccccacttgggcgacaagcgtaggctgtaccgtgtcatggatacaaagctgggaggccaatatccgaagaaaggcgcccacgccattgcgaacatcgccttgcaatgcatctgcaatgatgccaagatgcgcccgcggatgtctgaggtcttggaagagctggagcagctgcaggactccaaatataatatggcttcaccacaggttgacatccggagaacctcaaacgccgtccctaagtcgccgatgagaatccagccatcgccacggcgctcacttggagcagcagcatccccattgccaggatataggactgccaaagtgcactagaagtgcaacatagaagaggtcttttatctgcacggctgtatagtttgttatgtaagcagtgtttttttgtcctttttttctcgaggaactttctgtttctagtgatatttcttttatctgtgtgacacgagaatctgacgtccattataatgtaaattgtttgccgagataatgggtgccgaattctggtgcctgggttgctgctatgatactccctttgcatttcttctccttgattttgcttcacgctgctctctgccatgctgggatcatgatgcagagaaccgtactcactgtgttatacttcatccgttctaaaatataatggattttagtttgattggacatattccagtactatgaatctgaataggtttgacaaagagtttgtccagatttatagtattaggatatgtcacattcaaccagaattccttatattatttttccacggagggatatttttttatataatggaagctttattgatctcagtcaaaaggattatctcactatgaaaggtgacaaactgtgaattggatatttttcccaggttttctcagcagttgatttgagatagcaagttcatgcacttctctattcacatctgacagctccctttgaacacattctgacggaactgtttttcagaaagagattgccagattacggggttgagacagacataaccagctgaaaaggactgattacccatagcgtaatgttatgatcctatcagagaatgagacccatcagatcgtttcacatccaaatggaaatttcctccttgacttaaaagttactagtactatagtatatacagatgtacatggctcgaattcaatgatgattcagatagtcccctatcataagttggtgtgaattttcactcccatgaattagcaaaagaattgtttgggaagaacaaagactggcctgctagcaggtaactgaataactgacgcagtctcatttctcaacaataaactcctgaatctctattccagtgtgacgggcaccgccctgtttcctcaccaaaacctcatcaccaactttcagtgaagtcacaggtatagcagttcttccactagatcctacataaaacaatcatatggttccagaatgagttgattgaatatgtgtactaatcacatggtgattagcatcattcaaacataactgaaatttatggcttattatagttgcagctcaaaacttacagtcctatcttcaaaagttgtccatatgggcttacctttttcaggagtgataagtgcaactgtctcggcattttgcaggaaaatgctgtaagtatcatctccaccgttctcctgcagcaagcccatacgccatgaaattgacaatccatgaatgtacagcaatcatttgaagggagatcattgttagttatgtacctttgcttctacaaggattagaggccttgattcaatcttaacacgaccaacaatcgcagtacgccacaaaccattttgatcaacaactattacttcccgacctgattgcagctctgagaggtaactagttcggccaccagggactgcaacatatgcatgaacagggccctgaatggagaacacataaattttattagtcttagtttctcttgttgtacagtgatacctgcaatagcttgctgcaacataagttgttgatatcttaccgcattgaccctgaaaggcctgcttgcaatataatttgtctccaggcattcagagtgaacaagaaacattcctcttgcataggagccaacctgaaaatagaacatcatgtagaggcagactggtgaagcttgggacaggtaaaatgctaatgcggttctatttgggggcacaatgacacattcacgtggaacgattttaaccaactctgtactgcaggatatatgttaattatttatttatctacagtgaacaagtgagaaatatacacaaaccagaaggccttcaccaggtcgcatcatactgcaaagatccacacaaacacgatcacccataccaacaacttcaacctttgacacagtagcctttgtcaacattaactggctctttgcctcgttccttctgtcaaaataatcctgagtgattaaaggaggagagaacaaacaaacatctggtgaatcgtacaatcagacaaatgataatcagtaacaataacaggagctgtactttcacacttagatttagatatctatatatatgtatatatatacacaccacggtacttgcctctatacacaagaccattgtagtcccacagtgttttaataatttaaaaccaaagaaatttcaaagagttgtgataaacataccttgagtttgataatatcatccatgtcctctactttaagtataactccatcaagcccttgctccaaggcctgtaaagtaactaagtaactgggggaacaacttcacaaaagataattgataggaacacgatacatcattatacacaggaacttctattgtatgttgaaacatcttgacagttacctcaagaaaaacctgagcctcagttgagtttgttgaaacagccaatacagttcctctacatccctggaatgcagcaactatattttctgctggtataacctacgaaattcaggaggacaaaggaggcacctgttaacgcttgttgggttttgtcaagtgtactttgcaagttgcggctcaaatatgaaacagtacagcatgtcaagccaatgatcctaacaacacagaaaaaacgtatactggacactcattcaaaccattgatggaattcaaataagctattcacacaaacaaaaagacactcaagatgactaaacagcatagaatgcattacaaaaatgcaagtatgatgacttatctcactatgacaattgaaattaattcatatgtcatggaagtaatttgctgatagtccaatattcgaatatctaacctgccatccacctcggaagtctatcacgatgttttccacttccacattgtctggttgtatgagttccagctctcctggggaagagacttcagaaattacagcaatcttttgttttttctcatcgaatatctccaggccatcgataaaaagaggattgatgcgagcagtagctgcaatgccaaagagataacaaactgtcgatttcagaattccaagaaaatggcatgcactcactgatgcatactatcaagtatatgattatattgcattagtttaaaggagagcaatgcctagacatagttgtttcttcttatggcaaatcatcagtgaaatgtctgtcgtttcttctaaaatagctaaattgttttttttttttttgaaatctaagccagccgagctggttttgtatttagaggtaagcaaaatagctaaattgtgccttatctaccaaaaataaagaaacaattatgtaacctaacatcgctgtaagaaaaaagaaatgctctcacatgaccaatccttgccaagatctttggatccaaagaggaaagtgctccagcccctctccacggctgccgtcatcacctgccgatttgttgtccacacccagacggtcttctttgactccgacggtgaggctgaagaagcgcacatcttgatagaatgggagcaagccgaagctaatgctgcatcaaagaatccccattacagagtcaatattgcaaaaaaaaaaaaaaaaaaacttcacagcaggttggggatattcactgattgtctgtcgaataaatctcaagaaatcaatcatgaattcttgggttttgggttttgggctagggttaggtaccgacaccacactcccctagcaacaaaagctgggaaatttcgaccagactgaaatccgtggatctcgattttgtaatgcaaatagtatcgcaaggactacttttaatccgaaatggagcaaggaccgaagagatggattgaggaatctagtcatctacagatgagcagcagcaagaatctatcttgtgcaaagggatagaaagatggggaagatttgggatggtttacctgttcttggagatggcgggacgaggactctagcgaaggccaaagaggagactgccattggatacggatgcctttgcgtttctattccccactcttctcttctaagaaaaaaaaaatgttcccctctatcttttcttctctgttcctagttcctgctgtattcccctttttttttctttttctaaaaaagatgctgtctaaattttcacttgcaaacaataattagaaatctatgtctatttttcagtctttcagaagcaagttttaatttttgaattactagaaaatcaacgtggctaaggcaaaggcacgctcgtgttatatcccggacagattatttcaatgtttatgatgttagtttaattttgcaaatgtttatgatgttagtttaattttcatacattttaaaaatcatcaattatcttttcgtaggtattgcttcgagtctgtttgttgtgtttaattataatcaacaaaacaaataaaacgtctagtaaaataggtgatgttatttttaaggtgttttaggttttgtttgcaaatttatgtttgatgggtggaattcataccacaaaacctaccacccgtcccaaaatatcatttttgcctacttccgtttgtcttaaaataactttattttttaaaataattattgcattgtagtttgtgaaaaacaagagaacgcattgaaaagtatataaagtaaaaatatttgtattaagatttaataaagtggggtatcctagtatttttactttttatttgtatgtgtgtgataggttaaaatatacttattttgaaggagtatttccattacattacttggatcgctccttaattcaaacacttttagctgccatggattcttctagattaatacatagtcattcctataagagggctagcacctcagaacaggagagctgcaacgcagcaacactcaagcctatttttttcctattgtttttttttctttcacataattctaggatttattttgaaagtaaaggccgtcaagtggcccaatcagaactggtaaacactgccagcattagaatattagatatatgaaaactgaaattggaattatgcaaaaaaaaaagtgagagatatgtacatggagatttggacacggccgagttgttggcttgtgctggcattcggcttggagaattggaggcccagatggattccgtcggttggagaattggacacgatttcggagcagtagcgggctggtgcgtgagagctgcgagcctgtgacaacccactgcggaataagtccgctcgacgttcctcatctttttgtcgagtttttttaaatacaaaagtagacgctcacatcacgcgtactcatctatcctataattcaccaactcgtctatctatctatctattctataattcaccaactcgttttactcatgttttactcttacactcttacattcatcattcaacggttcagatcatccgcgtaaaatccgaacggttcagatcgatcccatatccacctccctcaatcagcgcacgacccgcacggcccaccccccttcctatcgctctcccaccacacctgcgtctccgccctccgccggaattccgctcccgcacctccgccatcagcgctccgctccgtatcagccgccgcgccgtcctctgcatcgcctgtctgccaccgatccccgccgccagctcgctctccacgatcctccgcctccccgatgcacgaggtcctcccgtcaccaggtcgtcgccgccgttctgctccaccgatccccgccgcacgaggtgctcccgtcgctaggtagccaccgcgccgtcctctgcatcgccttctccaccgatcccctctgcatcgcaggggtgagctgcagctatggagttcctcgccggtgggggagcagcaggtgaatcccgtgagaggtgagtagttgaacaaaactcatcatgcagttcatcagcaggtgactagtccgaaacttggcatcgtggaggttcatccggattcatcatgcattctgaaacaaaacccatcatccagcgcttgccgcttttcctcagagtacaatgaacgcggggtgctcggcgaaatgtcccgtccggctcctcacctgcaatgcatgtgttctggagagtgtttatggattctggatcttagatcccctcaacgacttggatcgtcagtaaagcttcatcttgaaggtgcacatctgccgttgtttcgtcaaaatactatgcatgatctttaggtgataaaatattgattgaattgtctactgctatcgctcagaatccatactccatcaatcttacatatacacatatttgttgcgtcaaacacaagcttgctttccatacatccctgaacaattcagcctcacaactgctcttgacatatctcattcagaatttttttttctcaaattagttggactgatagaaaaatattgcttttcaagattgtaaaataaccaactgactgggaagttgatgtcatatgttggaagcaatctgctaaaatgttaaagaagtgcatctaacttttgtacccagtgaattgcaaatctctatctcgtttttttttgtttacagtttctttggttttaaagtaaaataggttgacatgggaactttactagcagaggaataggcttatattcttggaaaaaatacatttctccatgcagaatgtgattacaataatgatacttgctgccatgatttctatcactcatgcacgcattgcccttgatgattgtatgcagttgggatatattggtgagttcaccctctatctctctctcaaaccattatttatcttcattcactattcacttacaatttccctcgtattagtgatatgtattagtgagtttatgaaaaaaagatcagatatttaaaaacagagttagctcctttggaacgaagacaaaatgctactttgataacttgacttctcaacaccactcttatctgcacacaatttttttaatgaccagtttgaactttcatctctttacagtcatcaagcaagaaaatccttggcggttctgcttcctggaagcagtaggaacaacaagagttactgaaccagaaattgaacttgccttcttcatgcatcagatgaaccataaagggaacaacactactaccctctccaaaattgagctgctcaggacttcgtagaaatttacagcttcaggacatgtgatttatccattctcttttactgtttattctaaaatgcaaaaaaaaaaaagaaattttgttgtagcttagattaaggcagcctcagctttgtggtttgccaagccatgtaatgatatatgaatgtgatactttaattaatgttgaaacgcatgattatgtatttgaacttaattgactgaatgtgtcctggaatcggtttagaacttaatatatcaatcagacttttgttctttggttactggtttttctgtgacgtggagaaaagacgttgaagacataatacatcgtcgactgaatgggtcgaccttatggcttgttttgcaaattttgaaccttgtcctggatgtagtttatttggcttgtttatccctttcgaatatataataactgaggaacttctaataagcttcttaactgaactcgctcatctgtaagtcttaattaatgtcttgaatctatccttgatagcccaaacaatatattgtatatctttttgttgtttcaccgtagcgttagcacgggcatgtaactagtcctataaatatacacacactcaggtacgttgcctatcactaaaataatagttagccgtaaatgagagcacccgtgtcaagtctaggacttgaacccggatgagttggttctactacagaaacataaccagttgagatacgtttactttgcttcctgtcaagtttaaatcatagtaccctcaacttgcaaaaactgggttaaattagggtgccacgtcagagaaccccagctatttcatagatcgagttttgtaattcagtatgtgattcagggatacgatttaaactcgatgaaaatatgagagatgacaaagtggatttatccacccactgcttcgtatggggtgggatgaggcctttggcgatttctcacgccctcgcggggtcgcgcgcatgtggacgtacatgttgatggagagttggagatgggggagccaaccaagtaaccaacagacgcggccacgcagcagggatgtaagccgatcaacccacgagcctactaataagcaaacttagcaggtaccgtgtagattaacttgcgagttactttttaatttggtatgtaaacaggtttatgtatcaatccacttgtatctttagatacgataagtcgaaccatgatgcgaaaacttattcactatcacttattcgggctgtatttaattagttccacgtcaaaattaaaagtttaaaaaaattggaacgatgtaacgaaaaggttgaaaatttatatgtgtaaaaaatttcgatgtgatagaaaagttaaaagtttgaagaaaaaaaagttagaatataaacagagcctcgatctataagtgctcacaggccagcccgcgtgtatccctaccacgcagacagcgacaagcagccatgccgccccggcatcgcgatcccgtgtcgcgcgactcgcgccccacctttttttgattccgcctcccgttttctactgtttttccgccgtcgtcacgtcgcgcggcccggacggcgcgttggttggccggccacagctatagcggatgcggaagcttctctccgcttagccaaagccgcaccagcgcaccgcgtcaggccgtcaaccgtgtgagtaccccaagttgatcggcatcgtaatcgtcgtgcccgcctccgtgccggtgtcgcttgctgcacacatgttcctgatttgttcacctctctccgttgagctgttgtttgtttactgtccgtggtgaaactctcgggccgagtcatgtaatgttacggactcgtgagatttgcagggagcagaagaagaaggaggctcaagtgaccgggtccaccacgacgtcgctttccatcatctattgtccaggtccaacggctatcccgagacgacgcagtagcatccgatggaacgcacatcattgcaaacattttcagtaaaacccctctgtttctcactaaattacatatatccccttgatgttagctttctctccagcaagcttaatactccctccatcttaaaaaaactaaacttctagagtttaaattttgttccataaaaaactaacttataccatcctacttaatattagcacgaaaaacgagaagttttattccttcaataccctttaactatctatcactcttactaattttttaatgattaagagcattttagttattcttactctccactaattccaccttgagatgctaggattggattttttatgggatggagagagtagtattagtcttgtagtagtgggctacctatcatatacatattacgtcttatagtttgtgttgcggctgtctacaaatttgtagcatgctgctattttctgtcctcatctatcttctcaatatgtgcttatagctagcttataatctgctattataccagctctcaattctctcccttccagtatgggttatacggtaaatcatgagaagatgcaggtctgatctgcaaaaaaacacctccaacggttcattcaacctccactcccccttgttataaacgagagacttcgctccctctccactcttccttccacagtcccatccccgcgacgccgccattagagccgcaagaaaagctcatcaagagaggagagttcgttcgagatggccggctgctgcgtgttcctccggtggccgtcggcctcgccgtcccgcatcggctaccgctccctcgacgacggcgacgacggcccgtctccggcggcggtgacgacgacggtcgtcgtcgggaaggagcggcgggtgttctccgtcgaccagctggtgctcgacacctacccgttccggctgctgctggagacggcggtgaggaaggaggagagcaaggcggcgctcttcgtcgacgtcgacgccatcctcttcgagcacatactctggctcgccggccaccacgaccgctcctcctcctccctcctccacctcgacctcaaggagatcatcgacttctactcccaggacgcctgattcttgatgatgatgattctgttcatcagattcttttttgatcacttctttgttttcttctcctttttgttattacccccttaattaatcatgtgcatatataatgatgattatatcttctttacaaagacgatattggcaatggaaatagcgaattataaagcattcgtagtttgattgaattgctgtccggttctttggttgtttcttggttacgccatttttttttctgaagaagattaccagttctctgaagatgtcatggtttctccttttctcactatgcgtgtgtgcattcacgtcgctgttacaggccaaacgaagctggcatgatacaattaccaatcagtttaagaaattgttgtggtcgttttcgctaaattcggctgcgaacacgtcaattcctagttagctcaaaacgcgctgttaagatatgctaccgtctgatttttttttaatcgagaaccggttgtgtttctgaacatgacgtccaacaactcgaatacatgttgaccatttcgttggcatgatttctcgttgagctaattgttaactaccagacgaaaaactgcatactacatcccagcacgacagggtactccctatgcaagaactgcacacacacgtttcctgccatttcaactgtttattcatcaaactagacatgttttttcatcgaacttcaagattcgaacagatgctagtatgtcagagaaaccctgttttattttattttgtttgcttatcttcagctgtccatcatttgttttgtcccgcatgttcacaaatgattgcaagatcatattcctttgccaatcatcatccatctctgatatctggatgtatcattgtttcctgaaggtatgaatatgatttcacaatatagcacttgtccaggcggccaccagaattaggcccaactgaactgcctgtggtagtttaggccccaataacaacttggatgtttctattaaaaaaagcaaagatataatatttgtctatgttgtactgcaatataaaaaaaatgcgaatattagggaatgacctaatatcaaataattagaaagggtgaggctttgaacccaagtcgtctagcccaccatcttatgaagctagccgaaaaacccatgtgcgttttctcgctgtactgcaatataaatagttgatatatcaccacattgaccctgataagcctgcttgcaatataggagtgttttctctccaagcattgagaatgaacaagaagcattcctcttgcataggagccaacctgaaaacaaggtatcatgtacagtgagactggtgatgtacacatggatgcttggaagttggaacaagtaaaaatgctatgcttcaacgattgcagactgatggtgcaatacacatcatcagtttacaaaattagcattactctagataaacacatccagtactgacgacaaccacacctgaccatgatgtgcgtaaatttaccagcattcgcacgcctatctatcttccattcatgcccgctttaacatcttcagcagtgtcaacgctacagtgccacatacccttctggattgatgatggcttcgtagttcaggagcccttccgagcagtccaatgttgtactccctccgattcaaaatgtttgacaccatttactttttagtacgtgttcgaccattcgttttattcaaaaaatttaagtaattatttattcttttcatatcatttgattcattgttaaatatacttttgacggagcgtggggctcctcaccgggagaccgcgcaggcccccctttgccggttcggccgggggagctaagtgaggttcttcgccctcgatctgaggaacgtcagcgagagaggaagtgcacaagacacgggcgacgtagacaggttcgggccgctgagaagcgtaacaccctactcctgtgttctggtggatctgtgcgtgaaggaatacagagcgccccggagagggagagagagttcaggctctagaacccattccccaaagtcccaaccctccttcctctttttttcttcctctttcttttctccctctttctttttttctctcctaggcctgggcctcctttttatctggtcaggggtcaccacatgggcctctagctgtctaagaagggaaacatgctttttacaatgagggctagtctacagccggaagtgacctctgacaagcagagtacacgcctcctgccccgctcgcctgctttcccggtggacgtccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgatcggtcacacaccgcgaccggtcacggaccggataagcgtgcgctgcgccgcattaaatgcggcgtggtgcgctcgtccaatcctgctataaatgcggttatgtgagccacgctgtgctcacctaacccacacgcgtggcgccaaaaccacagggggtcggggcgccccagccctcggggccgaaacgggggcgccccagccctcggggccgaaacgggagcggtccgacccctcggggagacagagggaggggtggccacgtcatcctcgggcccgacccccccccccccgagggggtctggccatgtgggtgaccgcggctacccaagcctctagtcacgatacccccggtcccatgtcaccgacaactttcatatacacatattgttttacatatttcataattttttttgaataagacgaactgtcaaacatatgttaaaaagtcaacggtgtcaaacattttgaaacagagggagtagttctaaaatggatatgatctcccatcattggtcctgagggaagctaagaagcagtggaggaatgcatggatcacacttaactgtagttgatccaactctgtctttactatcatccccatggtgaacatcagtttccaatgccaccggaattacaatgtgagaccaactgcatgtccttcttggatgcataacaatcagtacattaagagctgtagaatacaaaagacgcaagaagttatttattttaacacctaaaaacagcctatgacatcagtatttgtttatagctcactgatttttttttggtgaaatgtttatagcgcggccggagtagcggcagttcacctgtgccttctgccgcgggctcgtcggcgtacagcgtactccagcggacggcggggcggcgggagtgtggccgcgggaaggaagacgggacttggaggaaagtgaaagtgatccggttcgatcggacgtttccagccctcaatgggctgggctggacctgggctttaaaaagcattttaatatctataaaagtatattttccatttcaagttttacaactactcaccgtcagttaaacaaaccggtgccaaatatcacacatcatatccagattcgtggtcctactaagagtaggtgtcacattcgatattatgtttgtttactttagaatggacatctaatatttgattagagtattactctatgtctaaaaaaaaaatctaaaactgtatgtgacgtattctagcccaatgaatttgaataggggccagtttggttcatggcctatatttggcttaccaatttatgggacacataaacagtaggaacacaaatttggtttggatccaaatatcggccggcctgaagagaaagaatcggtaacgtcattgatgggagccgaagtgcgggcttgaaatttgaactcctacgcaggctttggcagtggcacatcggccatatgtattccacgctgcacacaaaagttggcaccaaaccaaacctggtttagccaaaaattggcaaggttagttttggcccttaaccaaacacaatttggccttgtcaaatattggccatgctaaattgtacctttggccaaatattggtaaggtccgttttggcctcaaaccaaacttgccctatatgtatgactaaattcgtagtactgtaataggatgtgtcacatctagtataagttttttttatgggatgggagaagcagtagcaaaaaatcgaacttttacgcacaaaacggtgacaggcagaaatagaatatcatctaatcttctattagagtataatggttgatttcagaagggattttagagtagtggcacctgactttcggcgagcaatgcagcaagccagcaatgaagctatcgctgttttaggcaaaggagcatggctgccgatcgccatcgccataaactatttttacgaggagaaatcatctaaagaacgagaggacgtggcaccggggcttgctgctgtcgatttggtgaccttccttatcctcaatcataacttggatgttttcattaaagaaatcaaagatgctatatttatctctactagggatgaaactggttcggatagttttcgtccgtccggaccattttttggatttagatagtttcggtcggaattatccggaaattcttggattctgaaacgaatttggatatttttttctcggaaacgaaaacgaatatagtaagggtattatccatcggaatcgaaaaacggtcaaaaattatccggaatttttttcggatatccacagacattgagcaaattttagaaaaaacacgtatatatacataactttttcatacggaatcagatgaagacaaattttatattcaacattgtagagctcgatgagatctacaactttattattgactattttattatttgaggtcatttaagggtctaaatatttattataatataccatattaatttttacaaaatctcagatctaccattcaaacgatatctgatggagatgtgttccatattaaaattgtagggctcaacgagatctaccactttgtagtttataacatttgtatttgaaagaatttaaagtataatacaaacattacaagtttcgaagatgtgaagtaaaataaataatatctccaatttatacaatggtaagtaagttatacatctagtaaaaggtcttgggaatagaaaatgataatcatatttgtatatggctctcttagaggaacaatcatgaaaatcgattttcacatacggttgtgggaccgtctacaaaattgacgatataaatgttggagatgttgaaataaaataataagcgatatctcttccttaatcaagaaactcaatttgagaggtttttatataccggtaaatattcgttaccgtattcgttccgtctcgtattcgctccgtatctgtattcgataatattcgatttcatttacgtatccgagttttcgattacgattccgattccgaaaaaaaatatgaaaacgaatatgataaagctagtttccgtccgtttctgatccgtttttatccctagtctctactatactgcaatataaattatcgatacattaccaagagatacactcgataatgagtgtgtcccgtgttcaataacaacaaactcacaatttattcttaaaaaatagttggagggagtcaaaatctcactttttttaatattaccgcattgacctgaaaggtccgcttgcaatcccatttaagttatctcccaacaatcacaatgaacatgaaatattaattcctcttgcataggagccaaccctaatttaccgtatgcttgaaagttagtctctctaatgaatcacacgagtggggatattatgcagctagagaaccgaacttgtataatcattctatatgtttttcttactccagagcaactcttagcacaccaaaatgcctcagagcttcactatgatctcccatcatagttccccacgtttatagaagctcgcccctcttatgatagtaaaaatggaaaaaaaagaaagatcaataagaaataatgagaagagacaccaatgtacttacatgtaaataagaaatgagagataagcatcataagtatatgatatagtgagaagttatactttttagttgatgccaaccatagtagtttgttgaagatgaacacttttgagggctgcaaaagtgctcctcaataatgagcaaaaagattcctaacaaccaaagggaaatctttctgcaatatttttcatgtagtactaacttgtagcggtacgtgtcattatggaagtaaaaacacccaatatacatttctgaaaacgacagtgttctctaagcatattcagttcccaacaaacaatggctgacaacctttacaaccgaattcatcaccaatatttgtgagaagaagtgtcaggactcaggacaaatgctcgaatcaaggccatctctgttgcatgattgctgaagaatattgcttacatgcatatccagcattttcagatgatggaaatctttccaatcagaacatatacactcattacgtttgctgttgacaggctatcaagatgataaataccagccattacacttttggtaattcgcttcgcagtgctctcttctcctagaattgacacaggaaaaaaccaagaatctgtctgaaacctgcacatgaatctgaaagggagaatgcattaggaaaccgatgtggacatgagcatttctttcttttgcaagctgcaaagcttgtgagttgggcaagaaaaagacgcattcgctggcgcccccaattagcaaggagttagagctgcgatccactgaattttcgcagcgtaatgccgtgtgatgtgaagagagaagaagctgtgggtaggtcacgggcccacctgacaagtgggcccatcctagtatccccagcttcactgttcacacacatcaatgcatcaccagctgtagccttcgggccttcggggacgcgtggtgtacgaagagcagtaatgcagcttctaatctcagctgttaagctgagtgattaactcttaagcaatcacttagtagtactgttagctcatgaccagctggtgagctgcgcaaacatcaatttttttttcttctcctcattcttcgtcaacatataagtacagctctatcgctttcttctctccagtcgccacacattcttcgctaccacctccaagacaagttgagcactgctcagcttggcagcttgccatccaggaggaagaagatattctagagataatctagagagatcagttgcgttttgcgaggctgcgtgagagagatcatcattatccagcaaaccaccatggagaacatcaagggggtaagaaactgccaagaacggcttccatctcaattccctgaaacgaacccttcttctcttctcgttcctgctgtttcttgtctgaatctttcgctgcgttcttgcgcgcgtgtgtgagcaggggcatggcgcggcggcggcgggcggccggaacgggtggatgacggtgccggcgttcggggactgggacatgaagaacggcgcgctgccggactactccatggatttctccaagatccgcgagatgcggaagcagaacaagaaggagctctcccgcaccagcctcggcggcgacgacgacctcctcgcccagcagaagcagcagcagccgcagccgcagcagaagcccgccaaggccaacctcggccggccggccgacgaccaccgccaccggcaactccatggccgccacggctcgccgacggtaaggctcattcgccctgatagcctacccggttttgatttgattctcttttttttattattcttggaattaagtcacgactttactgtcatgtcatctaacggtcaatgaggatttacatgatctcattaaaacccatttcatttctggatcgtaaaaatgctttgtctttcgatttgtgcggtctttagctgaatcatggagtgcaaagatttgatctttcttttgtttgatacgaccagtacaagattggctttaactgatagtagtacaagtcaaattgttaaaaggaaaggggataaataaaaaaataacaagtggacaaatccagttcttgaaatgtagtactactagcattgtggcatgtaaaaacaaagcacaagcagagcactttcagagggcagcaccactgtagaagcttcatttcctaacactgaaacagatttcgaagataatactgtaaataattttgcatgtttcttaatccctacgctagagaacagcaaccgcgtgaggctttgtcggtcaaactcttattccaaggcatggatcatgaattgtttttaccgtggacggtggagagcgtttgaatgtgcagactgcattactgcagtacagtagattagtagtactgctgtcctggagctgtagaatcaacatgcaaatattaatgtctagacatttttttccctggagtaacaagagaaggctaggacaggatccgaggagaggagaaggttacaagctgatgcagccattctgtaactgcatttgcctggttattttacctaggcagctctagcttgttcttgtaagatgtcaacagggagaagaatgacagacgatagaaaatttgagaagctattggacatatagtttagaaaataccatgttttaacgtctcctgaattactagaattaatcacgggtaagcagttagctgatcaactaatacatatatttaaacaatttagaggtggtgacctataaccttgtactggatcagcatgcacagtggagtcagttcaacagctataggtgggttggcgaataggagtatatatgaagtcatatcaccggccattccagctttatgcatatacatatatagtgcactgcttcgatcaaatgattggcaaggacaaatactcatattttgtaaatcaaatgcatgatatcctcatatctgtttgccttttaaaggctgtaagcctgtactgatatgcattatgcatagtccagagtacaaccaattaatatattaagcatcttggtggccgaaagatgattagaaggaactaataatgatttgaatcggttgatagataagcaactcttaacacgtaataaaaagatgcaaagtacccacgggaacacttggatttagtgactaacaactaagtaaagtctgccacaggttggtggtgtcttagaaaaaatatgtatttgattatgctattgcttgcggaactggagaaattaattgtcaataagtgtatttaataaagtatcacagttctttccatgagacaatttgacatgtaaaattctgagttgcaattcaattcttctacatactctgagatgcaggtactttcaaagcatcatttttttggaaataaaacttagcatcaagtatgaacttatgcgcaaaaactaattccgcagatatctgcattcttctgtgtaacattaactgattttagtggcctctgagtttctgactggaacttctgatgcagggaaggaggacgtttctgagctacttccagtgctgtattaaggcctgaagaaggactgtcaactactgctattggctgtactgttgtgtcacagtgcaaactactcagcttatttttagattaggcttcttgggctttgtcaagcctagcaagatgtgtaatatattcgtcgtgatgcttaatcttttggtcattcagagaacaaaactatttatgagtggcacagattgcttgcgaattgaggtgcaaagctgtaatatattgaaggataaatggcatcttgtgtttttgtacggttgcagaggcatgattgatttggatttgtttctgctatcacgaggaaagatataatgcctttttttggggcgaggaagaaagatgatataatgtttactcatcacgtttctttgtaacatctggagataacactgcaaaatctgtcatttatgtggttctttggttgatttttctttctttctttttgagtttggacaatttgacagaactgtctgacctaattattaggaagatagttcactacacattgtcttcaggcttcagtgcctacaggaagataatttgctttacatcatcttcagctctctgtgagtttcttgtccaaagaaaatctgctcatatgttagtcacgggtacaatgattgtttgggaaacatcaaagcctgggctgtcgaatgcttcagttagcagaagagtaggcatgattaggcaatactgacgagaaagctatatagccttcaggcagaacattctgcttgaatttagtgtgtgtttaagcacagaggacagcagtcaaagaactgttgttaactagagatgcccaaaatagatcatctttcttgttcaacagattccatttaatcactagaatgtacagagtaacagagaaaatgagatgaagggcttgtttggtttagtgccctactaaaacattagtagtgtcaaaatctagacatattttggcactacaataatttggtagggcagagttctaacttctaagtaatatgtttggattaataccaattggaattgaaagatcaagaacggctatagggggggtgaatatagcaattcaaatcttgcccccgaaaatactcatcaagccggatttctcaaaatccttactagaaccgcggttattagagaagccggatctagaaaagaagagagaaggaattcccgaaactataagagaaagagaaaaggaattcccgaaactagaagagaggtgaggaggagatagcaaaactcatcatcgcaaagttcaaattgcaagcggaatttaaatgaacaaggcaaaaacgaaatccttcaaatcatttcattcataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacactgaaactctctcaccgagcatctcaaaagaattacaaaaggagcaacctccacccttgcatccatctggactccgatcacctgcacacacatgaaccaaacaaccgttgtcttggcacagctgtcgcaacctgaccaatgttagttcacgcacacatttcctacacttccggtacttgtcaatttcccatcacaaagaactaaaaccacccatggtttcacatgaatccaaattttatgttatgatgcagaaaattctagaattatactaccaaattaaatatgggcattaccattcatttggtttcgaaccaaaccatcatatttactattcaaactaccaaaaaattaacatggcatatattggcatcaatccaaagtggcccgaaaacaaagaaaaatcgccatcaactcacatgatcttcgattgcctgtagcttctgaactgcaacgggagagctcctcgaagaacgcggcgaagctcacttggtagatttgagatcattggcggcggcgccgtcctggtcgagcatgcaacctgctcgacgaaatgcctccacggcgatcctatccggtgggccccacctgtaagtctcacatgaaatccaaataggagagggaaaaaaagaaaaaagaaaaaaaaccatcgaatccgaggagatagggagataatggtggggaggaagccgctgcgccggcggcggcacgacgcgccgccctcgccgccgttgttcggggccacgcctcggccgacctcccctcggtcctcctccgcctccgtggccgcggtcgcggaggagctggacggcctgctcctcacggcgccgcggccgtcggcgtcgtcgtcggagccgcggagcttcccctacgtggtgaagcagcggtgctgggagaaggcggagcgggtggccgggcgcgacccggagaggtggcgccgcgacgcgctcggcaacgtcgtcttccgcaagctcgtcggctgccccggatgcctctgccacgactacgaccacatcgtcccctactccaaggtcccaaaccccaactccaacactgatgaatgagttcgtgtaacgctgctactttcttactttgatgtctgatgaattgatgatgtgaaagccccgggagatttcagtgcttcatgttgcattttcattcgcttaattgtactgttcttagttagaacttagaacatgattttatttgacgcgttgcattactaatccttttttgaatggacagggtgggaagagcacattggagaactgccaggttttgcaggtacatgcgtctctatagttccataccctgatcgatcactccactgtacttgtgcatacacagaattgtgctaagtttattgtttgtcggagtgaggtaatggggagtgctacctggttctaactaattgatacaaacaagcttcctatgtaatgccgatggcccacctgtttgcacatttgcgcctctcttcagtcacaaagaagttactcatgattttcctgttactattgagcattgatgaaataatgaaatcgtaaattgtttacgatgaaaccttgtctgtagtgtgttatcttgttggaaaacattgctagtagtatgtgatggggacctatgtgaattgtgatgcacagccttctcatttgacacggtcggttctttcccacaggctactgtaaaccggtctaaagggaacaaaacagagttatccaaatctgagctcatacagaagagtgcctattgtagggtctcaggtgagtagtatggctaccttgagttttccacctttactgaagctatcattgatcataaaattaatcacccaactttctaagtaacttgtttgatatctgcaggacgtgatatggatcttcttgaactctctgcatatgggaatgttaggcgagggccagattcaggtggttgcagaatccaatgaagacgatgggtacgtctgaagagtgatgataatcagtttcaaaaggctgcctgcctacctcaaatctgataggaaaaatcccagctgatgtttgtgccaaatatgtatactcccagctttatgggcattcatcatccattttctaaggattgaccatcaggaatgttatgaattttgtcatcttagcatacttaacggatcctgatttaaggcatattttattttgtattacataccatagttccaagtgcggtcagtgtaaacatgtgtcgacgcatttgttttaaatgtgacatcacattcgtgccatctcttcccacttctgcatatatatactgcaaattttccacacaaattgattgagctaacatttatatccactcatacatgtgtggatgaggaggcatggggatatatgatcttaatttgctacacataaatgatgcaatatccagatctaagccatgatgatgccaccgaagcgaaaatgattggtaagatcttgatattttattcttctttggtactttcagaaatctttacatttttacttttgttgttcaaccttgaaaattcaaacctggttatgatgtgtcaacagtatcttaaatggagaccattgcaattaatgccatatttttctaccatttcaaatacagtactgtagaaaaacccacagtattcttgtcattttctaagtgtgaaaagatccatgcttcgtacactaagaaagtcaacaagtcgcttcgtattttctccatatgtttatgtattaatggtaaattaaattatttttcagtagtcatcattttttaatacccaccatttttgttttactgtccaataataacatgccacatatatttgactgtttagaaattaggtgtaaatctcacgtgataaattttagtttacttttaaaaagaattatcacatgatcatccccataatcattaactgttagctacagagttttgggaagaccagtggtaacggtttgggtactagccacctttaaaccagacaaggtgactaagtaatatgtaagtcacacctttttacagctgaatattgaattgtttgatatgttatttgaaaacatggggaaaccatgaaccactcgattttgtgaacaaaaaaattctgttgtagttttgggtactatcatcaaaagcctaacctagtggaaattacttggaactaactagaatcttgtgtaggtcatctgatgcctccagatccacaagaactttacgaatgattatatacaacctaatattataagatcgaaacgagctcttttttttttggttcattcatggagaaatatggaaattcactgtcttctgtttgttcagttgcaggcttgcagccaaacactcaagagggttattgtttgctcggcatactttgttttctgtttttgaggatggcgtgctcaatgctctaatcatgctcccgatggtgggtaggctgaaatctcactatcatattattttcctttttgtctttttaaaaatttcttattaagcttgacttcatacatataattgtatgcaaaagcatgcatgatgagtttttaaaatttaatctgaactagaaaataggtttctcctagtgaccatgtgtcacttcagcactctagtgcaacctttgcgttacttgcctttgatgggaaagtgcactcacaaaagtttattattaaagctattgtccttaaggtttctgttgccactggtgactggtgtgtagacaccaaaaagggaactgcttattgggtttgaccttcaaatgtcaaaaggggtcatttcatttgtttcatgccactgccgaaagtcacaagggtagagatgatacatacccaatacttgaaaaatacgattaattactttcctgtcacgttctatcatatatgagatatttctcgacatgcatagttgcatacttaacatgccctcacaccattagaaggctgctcaaataggaataaaggtcagagattaatcatcataagtatgcttagtcagaaaatctttaatcatattttttccttcaaatttttattacgtgtccccaagttttcattttgtttcttttttcccgagggagttggtgacaaaaaaaaaggtgccctggcaatatatagactagaaataaggtgcacattggaattttgatttaaggtcaaacatgctggcttagtaagttggctggccaatggtgtaggtggaagttccgttcaaaaaaccgtgtaagtggaagtggcactaccagatgtcaatgagtgaaaggcaggtcgaatggtggtaataatgcatgtattgaaaacgtttcaaagcttagatgttttctgtaatgcatgtgagactttattttaggagtatctaccagtaatatgtttcttgatatgattggtagagcttctcgtccatttccatccataatatgtttatataagcaataataaataatgtaaacaaatttgtatatgttacagacacatgtctagctgaaccaattactgcatgctagcttttccatattttgatactgtttattcgaagtttaatgttttatggagaatggaatttttatcatttttgttcttaattattctatggtaattatcacattttgcttaatcagaaactattgttcttttgtcagaacataatgtttctttttctgatcgcatgctgagtactgaagtgcaccaatcagataatcacatggaaatttgcacggacctaaaactttattttttgtgttcgtcttctcttattggttagattttttctgcgggacagtcggcagtatgtgtgaaggagataacatatattccgctctcacatttaaggtcagtgggacatccagtagttgtctatcgctttcttgctttctttcgtgccttccctactttttgcatcactttcacgatccaattatctcaattgaaaagtagaaagaaacacaggaaaagagagagagaaacaaaaggatatatagataaagggaacaaagaaaatttggatactgtttctgctgtctctgccaatcctgataccgaaagaaatagacaaataggaaacaagatgaatatatgcagaaaagtatcacatttccagggctacagtgggactggtttaatacactggaatcagacagcgacgaattattcagatactactgcaaaaggaaatccttttgatctaaatattcaaatcattatattatttatctacatattataaggggaacttgctctccctatctttctcaaacccacatagctatgtacaagttatctaatacagctactgggcttgcttgtagctatgttaagttatacaccctgacactccatctcccatacctactttacaatcctctaatgtacaaaatttcagctgtatcacgctatgtctttatagcagcagaaggcagcataaaaatttccaaggcgttgttcaagtcaagatccctcttggaaggtcaccgagcgtgttagggcagccgggttcccctgcatgaatggcaagctgctgatcgctgtgtgagttgatgcctttgcctcatcctttgactcaaaaacctttgcaagcttgcatcctctgccatgatctgctcccaccttgtcacccttgatcccaataagcgaccagatagagctcctggccacctcgtcgacatcgtcgatccgaaccgtcttcggcacccacaccttgccattacccttgctatccagttcctcatcaccatctctagggtgctttcctaatctgaagcagttggtcattgtggatactggagaagcagcacttgatgatgaaaccgattgggattgggactgcggtggccatggagcgttccaagctcctggaaccatgcagccccagtatgcagcaacagcagctgctgcagctggatagaatggaattgcaatgcttgaagtgtaataagcaggtggtggtgccacgccaaatggccacatggctcctccgttcatgcatgggtgttgtgcaacatttggagatctatctgctgaaactttctcctttaggttcgtttggttcgattcttctgttttcgacaatccttcagcacacaaaccgactggcatctcgtcggtgttcttgataccggttgttgggataaacttatcttttagatgcttcatttgttctgtgaggtctaaggtggacaggtcggagccgaagctgagaacggtgccattagtcttcactggggcatagagaggaggatcaccgggcagagcagccctgaccctctggaggaaatgggaagcggccgatacgctcttgctcttgcgtcggcctgcacccacaggcacgttgcgcatggcaccacccgctgtccagtacctctggcagttcttgcagaagtggcgcggctggttgatgttgtagttgttgtagtagcagaacttggtgtccatgctgctacaccgggggcacggcaggatcttgtcaggcttcttcagcttctccttctggttggccgtatcgccctgctgctgctgattctctgatgagttcttatcagctgaagagtcctcggtgtcgacgacctctggctgcggaggtggacttgtggagtcttgaacggtgttctcttgagttttcggttcagtcgtgctgctgccactgtgttgaaggtcctgcaagcatgtgaagaaacttgatgagtttttgggtgttaaatttgcaattttgttcagttggaaactataagcccacatggacagttttgtgttcaggttattgtaccaggaagatctgtgacagagtttgttcattgtttcagtttgttcagttgatctagtaaaacactggaggatatgattatgtaactgatagcttgtaaggccacatgttctgatctctagcttaggaaatgaaaataaagttgtgcaatttgtgttggttaaatctagttacatatgcctctaaacttttgtagtactgtaggctaagaaaagaagcagctctgctttcatccaaaaaagaaaaaaaaaacatggaaggccgaggaaaaggcctaattgaaacagtctgcacagtctagaaactcatcaagaaggttccatctttcagatagctaattcctgtattattaactgatactatctaaggaaagcatggaaacgaagcaaaaacaagatacttttgaaggattctttcgctaatggaaactaaacacgcctactcacattgatatccccaaaaatgaaaagaaaaataataagaaagtcaaagaaacacaccaacctcagacttataaggcatgtatgtacactcaagattataccgttttaattaccaattaacaatttaatatacaaccttataagtcacgaccaatatatggactcccggttgatcaccattatcatgttcaaaccaaagaaatggccaaaattaatcaatcaatcaaatcactccccattatccaagcaaaacaaaccaatcgaattatcccgaactgaccgctaattccgatcgccacatcaccagatcacaacatagtactacatcgcttgaattctcaagccctcaaaacgatactacaaaacacaaaaaggatcgccagaaaacacaccaaccttatcaacatcgccggcggcgcaggcgccgggctctggcacggggatggtcttcccgaacagcttgatcaagcagtctccgcctccgcctcctcctcccaccttgcactcccccatctcgacgactcacctcaccactccgctccaaaacgaacaaactccgtttcggaattccccgccgccgcctgcactactcctcccggagacgacaggccaacgccaacgccgatgagctcatgcggaggaggaggagaggagagcgcgagatttttggttggatttcttgaaatcttttcattcgcacaagcgaggcgatgggattggggatagttttaaggagggagggaggggggtggaggtggtggggcccacggaggagggtggagagccacaagatggatttgtggccgcaggggtgcggttttttgattctctccaccatctctccctctcaacccgccttacttggcaatcaaatccttcattgctgacatgcacacctacgatatgctcctccttttcttttcttttcttttcttccttttctttttgttctttctttatttcatttttcatttttggatctgtgagtaatgagaagcaagtgtattttttttttttgctgctgtgtaaaaaacgcttggctggtagtctttttggtcatcggagtgtttgtctagcatgatcagcgattcggttatgggaattccttttagtagatgataatatgtcgtgattgggctacagtgatacgactgaaactcagcttgtgccgcaagtttagggcatatttggagttcatactttaagatgatcattctttttttccgaggaccaatttggtttaacattctcctaggaataaattcactacatacaccttatctaggtattatattggaccaccaggaaactgaaggcttgcttcgaatgcaagaaattcacatgctttttacaataattaatccaatcctacaaaattcctctaaaaattctcctttttaaaaaaagaaaactgctgctcttaagctaagagagtttgagactttagtggggacctcccatgttgtgctctactattaaagaaaaagagagagtttaggtttatttttctttccagggaagctacagctattttcttttcggcttgaagcatgggaaatttataggctctaaaagaacactatggggggcatgctagtactccctcggtcccaaattagatatcgttttgactttttacttacaacgtttaactatttatcttatttaaagaattagtacaaatataaaaaagataagtcatacttaaaatacttttaataataaagtaagtaaaaaaaagtaataatttcataatattttgaataagacgaatagttagacgttacaaacaaaaattcaaaacgatagtaggacggaggtttgctaaaattcgtccatcttttattatgtggctctgagtgtctgaagacggtgtagctccctctcctcaggctggcagacaaagaaaatgacagtgttggactgttggtaatgtctttcagcttgcagtggcattatctcagctggtttcttttcattctttgcgtgtattcaggctttgatttgtgccttcaggggaaggacaatttgatcgtgatgtggttgtcaatatttgcaacttgattgttattgttgcactgactatactgagttctcattaatcctagttaggctaattattagtatcagacagagattctttgtttcaggtgaaagtttacctgctactggagctattaatacatcctaaatgttcgatgttaagttcaatactgaagtatacttcagacaaacatgcatgttgggatgcatggaccgtggagacttgttatcctgatgtctatatatgtagctccatcctgggatgattgcactttttagctaacgaaagtctagtatgtcttttcatgctaactgttcagtttagtaataagctaattttcgtggctaccgaacatattccagttatagcgtactattttccacttcaactgtacaacaagctgccaaacatctcctgtggatgccagagtgggtgacagtctgctccaactcagctttctgttaatctccaggtcaggctttatttatcctaactttatcatttaaacccaaggtatgactaattactggaaataatgggctaatattttcaggtcaggctttatttatcctaactttatcatttaaacccaaggtatgactaattacaggaaataatgggctaatatttataatcctttaaggggaaaaaaagatcaaaagcaaatttactccctccgttatgtactcacatgttataaatctttttaggtaagacaaacctaaaacaacttaggaatgtctttttagataagacattcctaagagttgggataaatctcttgcgcctgtaaaacatagcagttcattagcacgtgattaattaagtattagttttttttttgaaaaatagattaatatgatgttttaaaacagctttcgtatagaaactttttttttaaaaaaaaacacaccgtttagcagtctgaaaagcatgcgcgcggaacacgagggatatgtgttgggaacacaggctgccgaacacagacttataatatagaacgagggagtatctccgttatgagatcagggctatcgtacagtaaaccagggtttaaaatttcggctctgtaggaacccccatatgatattatttgggctggaatttttaaactttttcatttttggtgaatttggcaatattttgtttaaattcaaccaaatttggttagaaaattcaaatacttttggattgaaatttccgtatctcggcaccccccgatacagaatgctgaaaacgaaatattaaaccctccaataagcaccctacccttttattgtttttctgtttagtagcaaaaattaagaacagaaaattgaccgaagtttacttaaattgagtggtgtagtacaatctgactctgctgagttaggcttagtcttcctggatttatctttgtgccgctatacgtgctcttgtgtgaaccgctcgtgtgcgttgtttttgttgtatacgcttgtttggttaacttgtaaagtgcattttgatagttccctcttgctgtgcccatttcgaaataccttttgagaatagctatacttaacataggccttgtttagttgggaaaaatttttaggtttgttatcacatcggatttacaaacacacatttaaagtattaaacgtagtccaataacaaaacaaattatatattccaccagaaaattgcgagatgaatttattaagcctaattaatccgtcattagcaaatgtttactgaagcatcacattatcaaatcatggcgtaattaggcttaaaagattcgtctcgcattttacccgcaaactgtgtaattggtttttttttcatatttaatactttatgtatgtgtccaaatattcgatgtgatgggtgaaaagtttttattctgttggcaacccaggtgctagttttcgctttgtcaattcctgtgttcaaacttaaaaaatgctgctgcttggaaggaaggtcagttaatttcattagtagttcatgttggtcattggctagaaaattttggtcgtaatgtttttcctttggaaattagattgcatacgtttacatgatggaattagtgcacctttggtttcatacttaccattgcaccttatcacacttacattattagccatgcccacggttacctatgccatgcatgttaacaatggctagcgcgtcatatatagtcatgcccgcacctcattttcaggataaatagactttaggtgcctatctttttaattttaactgaaagctgtcaggtgaaagcggaattttcaaagttaaaagttgtgtttctattgaaagtaagccattattctgtttcactgattatatgaacctgttgtattcctgtgaaatttctataatcccagtacatatatttcatgaaaaatatgtccctttctctttctgttagacagtattgcaacggctacatatttatttgtcttattagtgaatcttacatgtaaaatcaaccatatatcttttgttaatactgtgaagcgtgtgcgcctaagaaggtagatgttaacctactcatatatatatgctcttcataaattgcgtcaaagttcctccataaaaaaatgcaccaaagagaaagtatcaaaaacttgatgttggaaattggcaacattggcaaaattttgatatgattggcttataatattgccaaaattatatacatattgccaaaatttggtaataaactaaacgtgactacataattattaattttaccaaataatgttatggttgaaaatgttatcaatcataaacaggctcttggttcgaactaaacgtatcttaatcaattaggtttcttgtgatggaaattgctcatcgaagcacgagatgatggttgctcgtatttcacatctattttttttcagtggttaataactaggtgacggtctagtctctctcgatgtgttcatataggtataggtgggggtaagcatgtgagtgcgtatagagacgtatatgtatacattattttgggacaaaaaagagataaacttagtttggtcggtcagttagcatacgtgggattgtctcatattttgattcctacgtgtcaagcgttgacggggaacttttggtaccaaagccgagatttttggaagtagcaaacttccaagatcgattggaggtgccttaatacaaaagattatcctaactggcaaaatttcacacaggcccaatacacgtgtaagaaacagaggatgaatgagtgtttcgtatcgatgatacgtgcaacaaaataaaagatgacttttagattgagctacttgtcagtggcactgtacctcacaagccgtgacaaaggaaggtcacgtccaggccccaactggtcggcctttttctcccattttcttgtgctctcgtgggacaagacacaagagaaaagaatggctaaggaaaagaacgagagggtcacttacatcacaggcatctgtggaaagacgaaagcctctgcagaaaagttagcatcgcaagaacaagtggcgattgtaacaagtagacagctgcgatctaactaacaaagtatagaaatcgaaaccgcaaaaagaaaagaaaagaaaaagaatagagaaatccaatccaagcgtatatagaccaacaactggagttagattttttctctctggcatgaaagcaaaaggtttgggagttcttgcctggtcttccagcttagtttgcttctgttcagttggaagacagcgatgtgtaaagaaactagccatagatgggtgatgggttctttgcattatgcatagatacgagcttcacaagttcacatgacctgtgattaggcctgatgggctctggtccaggcccatacctcagatctacacatcaagctcacctgcactgcaggggctgtagaaaatgcatacaacaatggtaaaaactggaatgtttacaggtgagatttttgtggtgagagcttgtcctgtttttcatttacaaaagaattgcttgtagttacaggatgcaatcatgaattggggaagaatggatcgtttggaagtgaagatgatgtattgctgtgctatgaacagggggtagatgtcccagcgaaaccgaatcccagagcaatgaaagcaaatgcctggaggtagatgtacaggtagtagtgcttggccccgagcaccaaatcgtaagacgcgcataccaggaggtagaacgcgaccataagctcaggaatgtaaatcctgcaagggtgaaaaatcagacagacatgtaatttcaggcatggattttcagtttttcactgctctgatatcagagggtaactggtatatgatcgtaagtaattttttttttacctctcgacgcagtctgttggcttcaatggttcaagaagagggacttcaagcttgtccttcacatgatcaccaaccttttcagtaaccacccactgattgacattcatggtctcgagcaagccggttagagctgcacgcatccggtgcatggccatgacattctcgaatagaatccaaaaaggcatcagatggatggacctggtatatattagataaaatctgtaatcttggaaaattgatgggcagattgatagacgttctctgcagggagaattcattcttacccaggatttctgatggcgttcatgatggtaatggcagtgggaatgtagaccatcccccagacaggaatgctgacttcagggaccatgacagacagcggaatcacaacacagtagaacaggaaggtcaggatgggagcgacgaccctccttacgaagaaaaagctgtagagtagatgaagttttttccatacagatacgccctgaatcacatataaccgggtaaagaaattattgcatgacaatcccgtaacatgttccattctgtcattgaagaaggcttgccttgtttttggcaatttccgttgccatttttctgaagaggttggcagcaccacaagtccatctatgctgctgatgtcggtaggctttgaaggtacttgggagttcactcttaacctgatcaagattcattattaaaacagggtaaaatattcatatatgcttatcaaaggatcaacatatacaatcctcacaaagacatacccttatatcaccaacatacaggaattgccatcccttgaggcttgcccgtacagccaagtccatgtcttccacagttgtgcgatccttccaacctcctgcttcgttaatagctgatacccgccacacaccagcagtacctgtaggcagatcagcgatgttaggaccaggcatgaaaagttcatgtaagtagttctgatattggatcttaccgttgaacccaaagaatgagtgcatagatgagcctgattcctgctctactttgaaatgatagtccagtgacatcttttgtatccttgtcataaggcaaacatcatagttcactgcaaaattgcccagcaaaggccagggcagaacagcctgtaatcagaatgaacaaaaaatctcacttaaaataaccaaatgacaccacattacccattgaaaacttgaacaaattgtgtcagagcgttaacatctatatccaaattatgggttttctgggacccgaccaaatttacttttaataacttaaaacggtgcaacattggatgtgcccttttttccaataaacttcctttcattttcatttagtgctataagctcttcatagttcagtctacttgatgaacatgatctgagagtttagtagacaaacagtacatataacagttgagtgaccaattcaacagaaacataaatcggactatcagaccaacaactgaagcacccctatttaatttgactaccctcacaaggttggaatgaaacaatgaaaatacttgcttaccaaactcccaacgtgtctgaaccagaccaatctttgggttatgcacaagaaatggtattgtttttagaaggaaatcagattcaggttggaaatctgcatcgaaaatggcaacaaaatcgcactgttgggtatagatatgttccatgcccttcttcaaggctcctgctttgtatcccttcctgttatctctgatttcatactttatgttaatttcttttctcgcccaatccttgcactcaagctccactagatcctgcatttgaccaaaatctaagtaaagaaacaaaaatcctattttaagctctaactctaaatagaaaataatgatggattgtggatttctaagcagtgaaagtacataagtacacttgatcaatcttcatctacctgaaagtaaccttatagcgcatgaagtaaaacttcatgatgtcatgttgaactactttgattcacataatgcaatcaacgcacagctgcaactattaagcagaacgacgaattcttttattttataaaaagagaaagaacctccttggttaccgcataggaaataactgcagtaattaacatgtgcaatgttgaacatagattatccagtacttcacatgatgggatcagcttacagctgcaatttttattgtcaagctgaattatcaaactatatcattgcaaataaataatagtaagcacaagctttgtgaacccagtattttagcatgtttaacttcatcacgcatttgtattgttattaatttgcaagtggtatgatcctgtggttatcctgtcaatgacctcagtttaggatattatggttaaataaaggtctacaagtggtagctatgtcaactactctgtgttgtgttacatgtctagcaatcatgagtagaccagcaattgagtatctagggaaaataattttgggcatgtactatatatctaagataggcaaaatacaggtcacactaagatcatcaaccgttctattctgcgtggtcaactcacagaaatatgtggggtgtacttggttaatccacaggattatgagccatcatccttctgcactccacaactgaacaacgtaaaccataaaaggaagcaacaagaactatgaggaactagctacttgtttgacatgaacattgcatggaccgtctcttcatctaagccctttgcaccgccaatttgccatgcatgacttctgaaaatacttggctcgagtaaaggagaaaactaagcatgtatgcagaagtttaacttaccttaatggccggatcagtggaatcatccaagacttggattataatacggtccggaggccacgtgagagcacatgcagctccaatagagagcttgtacacctgcacaagaatggcagatgcatcacattttcacatgctggaaaccaattagcaaattctttgaaacattacttggatgcttgtcagacaaaaacaactaacattcaacgcgcagtcttagttaacatctccaccaaatagacagaatgctaaacccattagatggcgattgtaaattgcccttaacaataatttcctggattagttagctcctggatattgctgaactacaaaacagttctgcaacctggtttgctttgcaaggcccgcaatgtgggccctcatccggtagcatctagcgggcacgctatgtcgctatattgataaaacaaaaccccacatgtaactaagtcctattgatctgagcacagacagggtcccacgagccattattccagcggctgattcagaggctcggaagaacaaattctaaatcaacagactaaaatatcagcgcaaatgcgccacacaattagaagagattaacaacagcgagagctgcgaagcaatgcattgcggattaacaagaacgagagctgaagcaatgcctcgcaaaatgtcacatgtgaaagtgaaaaagcgctagagcattaagcaagcctgtccaaccatcgctgggagatttggatgcacgcttccgattccgaagcggatcgtacactgatcgatcacgaaattcagcagtggaaggggggaaaagggagagttccaacgcctcacctccttctcattgtacatggggatctgcacgagcaccatcgggaacgccgccgcctcccgcccgcccgtcgccgcctcctcgtcttcgccatcgccgccgccgacgccgccgctcccagtggtaatgggctcccacttgtacctccgctccggcacccgccgcagcagcttgacggcgacgaggctgacgaggctcatgtaggccacctctagcaccagcatcaccgacatcgccatgcacgcccacaccgcgaactgcagcaccggcgccaccgcccgcgcccgcaccaccgcccacgccgccgcgatctggtcccccgaggaggaggcggctgctgctgcggcgagccgccaccgcccccactgcccctccatgcgcgcgcgcgtgcgttgctcagctttgggcgggtgtggaaatggtgggcaaagctttgcagcgggttggcttgtagttgtactacgtgagtagtttttgacgggggtttgaaattaatcgaggtttagatggtgagatgagagcacaaaatggatacggaaagaataaactcgagggggaattttgcgattacacccttgcttaagccttgtattacctgtcaggtgacaggtggggccccagaagtgaggacaaatcccattcctaaatcctaatctcgggcactgtagcagctcccaccgggattccgcgccgcacctgctcgacggattgcctgcccaccccaagcagctagccaaggtctccacccgtgggcgtgccatggcatcgctccgcgcggcccccgggctgccattctcgccgcgcccggcgtgctgccgccctcccagctcgcctggcgtgcagttcttcactccggcttctgcaggcggcgccggcggagtcgggcgccggcgctcgtacccgaggatcgaggccacggcgaggcacggcgcgaggaaggagaaccccaaggtcaggaaccgcaggctgcagaagaaggtacggctcgttccgatctggctcaccatgcagcacaaaccaattgcccttctgctaacatgtaccggttcttgccgccggcgctgcagttcaatggcacggcgacgaagccgaggctgtccgtgttctgctccaacaggcagctctacgccatgctcgtcgacgaccacaacaggaagatcctcttctacggcagcacgctgcagaaggccatctgcggcgacccgccctgcggcgccgtggtacgccgcccactccgttcctccacgaatttctttgaaacaacccgcacaagatagtgcgatgtttctattgaaggaataaaatacaagcctacagtcctgggagactatagacaggaaaaagaaaatatacaaccacaccacgcgtctacgtctgatcctactacttaaaacaaaataagcacacaacaccctaaaggaataggacttctaaacgacgcctccaagaatttcacctagtaattagacataaactgctcatttgtattgatatcttgagctggctggcttgttgtgacaggaggcagctgggagggtcggggaggagctcatcagggcgtgcaaggagctggacatcaccgagatctcgtcctacgaccgcaacgggtttgctcgaggggagaagatgatggcgttcgaggttccggtctcgcagtacgggttcctgccaagatagcagcagcaaattgttagagatagagatgcctttctgtagataggatagtaatagtgtgtatttgatgaaaaatgaactggaaacatgtgaattggtggctgtgtgttactgtgatgcatcagtttcttggagagcatgcaagttaattcaagtttcacagaagatatcgagtcagaatctgctatggaacaatacttcttcactctcgacatgattcaaaccttttcttctctctcgttaattgtgcatatttattcatgtattgattactgtccaggcaggaggtaagttagcatactgtgctgaagctgaacttctcatacctgttttgagccgtggccgtgggcacagcttcatcaacaactgattctctggaccgagccgtctggttcagcttcaacatgctgatcctgtaccagagctcctatcaatatgccaatataagcgcccttgtgcacattatcatgcaacgtatgaagagtctgccaagacacaaaagcagctcaacaagaatatactcaatatagtgatcaattgataatatgcaatatggagtcccaattaacactcagattttacaaagaacagagaggactggtatatatactcatatgagcaagcggttttattttgtccattctaagtgtaggccttggtaatcgaacaacatgttttactacatcagtgacagagtgagaacaatggtgagtagcaaattcacttgaacagtaagaccagttaattccaaagaatgaacttgaatagaaaaatccattcaaagaagatttacaaccgtgcacattgctaaatattatactggttttaagtggatatcacaatgctacaaaacgtcagtacaatccccatagaacagaaaaaggtttacatgtaacagtttttcaaagctttgcattccatagtacaagtgcaagttttcctatgttcagaaaaggtgtaaaggttccctggatgattttatgcagaaaatggtaataaaactcaaataatgacaactgtaatttaatgaaattcattataatggattttgacagataataagacatcagccccatgtggtgttgtagtcctatgtaacatgaaatgactgctatgctgtctccagaggtgacagactgacaagtttgaatctaagagattgcataattgacatgttaccaaattaagctgaaaatctaccgcaaggaattcaggtaagaatatttcggagaatcaagtaaacatgaaaaatatgatgaaatgcctacagtgccaaagaaaacccctttttccaaaccataatatgttgacataaccaagacgctaagtagtactaagtactgtcgacccaaggaattggcaattgtggagagaactgtcacatagactgctactacatgctcaggccactgtcccaataactcaactgcaaataaatacccactgactcaaatttgccatatgaactttgaaaggataagttgatagcatacatggggagctgaattcttaaagagccatgatgaaatctttcccctccaaaatttgttcaaaaaacaattccctccacaatgattgttgcgtttctggcccacttttgtaggatagcaagtatagcacattagcatacagcacctgtacagttcagattcaggattcacactttcacagttcatcaaacagggggcctgcagtaagagacaatacctgattatgctagtgatccaaagggcaaaagcaggtgaaatgcagcctaggaaaaattacggctgaggcagacagggtgtgctccagctgctctggcctgcagtttttcgggccccggcctgattcatgatccgtctgatctccatggcctctgttgttcgtccagaagcagcgtacatgtcgctgagcaaaatgtagtacccaccctcctccgggttcaggctccttagcttctggaccgcccgctctgccatgttgatatccccatgtgtccggcatgcaccaagcaaagcaccccagaccacactattgcttggaattggcatttgttctatcattttgtatgcttcctcaagttgcccagcccgaccaagcaaatccaccatgcatccatagtgctcaatggtgaggtccactttaccatagttgccactcaagattgcattgaacatggcacgcccctcctcaacaaagcccttgtgtgcatatgcggtgagaactgcaagcagtgtcgtcccatcaggcttcacagatttgccatcagccagcatccgatgaaacaaagcaactgtgctctccacatcaccatgcgatgcatatgccgagataaatgtattccaagatgccaagctcctcacggtcatgccatcaaacaaattacgtgcttcagtgaggctcccacacttggcatacatgtccatgagtgcattacggagtgacaccatccacccgaagccattggaatcaacatactgacacacacgctccccagttgcaaggtccccgagtgcagtgcatgctgacacaacgctcagcatggtcacttcatctggctgcaccggcattgcatcaaacaatgccaaggcctcctgcggacgtcgtgccctggcatacgcggatatcatggcagtccaagaaacaacatcccggtgaggcatctgatcaaacaccacgcgtgcggcatccaaatcgttggccttgaggtgaagagtcagcagccctgagaaggagatcacatcccgagcaggcatttcgtcgaacaccctgcgtgcgtccccaacagcagcccgagacgagtagccatggagcagcgcgttgtggacatgcacgtgagagctgcccgcgccaaggcagccgtgtttgatcgcctgggcgtggaggtcggaaggcaaccgccgctgagacacgcatcgcgagcaagacttgagggcgaacgtgaaggtgaaggcgtcgggggcggcgcccgcgcggcgcatcgcggagaagagctcgatggcggcggcgggcgaggaggacgcggcgaggccgcgcatgagggtgttgtagaagaaggcgaggtgggaggaggccgaggagaggaacgggaggtggagggagagcaacgcggcggcatggcggaggtcgccggcgggggagacggcggcgaagcggaggagcttggcgagtgccgcgacggcgtcggcggtcgggaggaggtggcggcggcggaggagggcgccgtggaggaggcggagcttgcgcttcgtcgagcacttgccggcgaaggatacgagatcacctggcgagatcgacggcgacggcggcgtcatcgcggagtctggctgcgctccatcggttcagagctttgaactgtcggagctgatgaagtgctgaacaatcgctgaaaaattccacacaaatggttaagttaggcggttagcatcacacattcagaatttcatgctgaaactttataaaccaaaactgcaaagttttacacattcttatttcttcaaacttctaacttttccatcatattaaaacttttctacacacacaaacttccaacttttccgtcacatcgttccaatttcaaccaaacttccaattttagcgtgaactaaacacacccaaagtttagtcgccgaaatgaggagcctagtggcatttgagtttttctattagtgaatataccacttcaactcctttttcttccatgttttttaaaatctaagacacaacttaggggctagggcaagtactataagaaagggcatccacaatatcaatcaaaagcgggcattatacaataaaaacacctatatgggctgcctctatacaatgtagatgtggcctttaaagcattaatggctaaagtagtccatatggctatgggtttgcccacaagagaatacaatatattactttttgagttcactgtttggaaatgaatataaaaacaaaagcagttgatccatgaccctgcagcagatatatgctggttgaaggttggacgttgaagttaccgttgccttgagctctatgttggctacaaaacttgctcgacagcttgagctccatgttgcctataaaaacaaaatagacagagcttcatagtacacctcctcatttcatcatggattcatccaacagaagtttcaaaaatctcctaaatcaagaatctccaagcctagaaaattctaggcactacaactctcctccccaacaattccccaaccgttttctcccatctcagttttcccaaagcttcaacccaaatttcttacataatttctacccatttggtgccccaggcaactacccaccatatggttattctcctccaagctttcaagctactcaacgtcaaggaaattggatacaagctaactcaccaaatcaagtgtttggagctgcaagcaacagagtactctttgcaccacatcaaagtcacctcagttgaagttgctgccaacacttcttcccatgggtcggagtcatccattccttgccctacaactacaagacagcaagagaagcagccacttaacatcgaagagttgagtgatagcagcgaagagggagtgaggagagcgccacgcaccaattggaaggaagaagaaaacttgcggtttgttagcgcttggttgaacaactcagttgattctgtagatggaaatgataagaagtcagagtattactggaaggatgtagctgatgagttcaacagcaatatgcctagaaatgcacatacaaggacagtcaagcaaatgaagacacactgggataatgtcaagagggatattgcaaagttctgtggggcttatgctcaagtcagaaatacatgtactagtgagtactttgaagacatgattatggagaaagcccatacatggtacaagaatcaagcacagcagaaatctttcaccttagagtacatgtggagagaacaaaaggatcaaccaaaaggcccacccatatagattgcttggaccacatacattgctgttgccctaagcccgtacatattacccctaaatttgccacatatgattagatgatgagatggaggagagtagttaggagagagagagaatgagccacccctcatgcaaggggcaacctctacacaatctccaagaaaagtgcaagatgatgtgagagtggactaatattagagtttgtgtattaaatgtgatatattgtatgtgttacctcttaattaatggactaatattagagtttgtgtattaaatgtgatatattgtactccatccggtttcattttaattgacgttttagataagcttatggtcacacttttataactttgaccatcaataactttaaaaatacttagtttaaagaaattagaacaacatatatagattggtttttcaaaacactataataaaagtaaacatgcatttatttattatatatattataatagaaaaataaggtcaaacatatattttgtagaccgtgttattgtccaaaacgtcaattaaaatgaaaccggaggaagtatgtgttacctcttaattaatgagaagataacatggtctaaattggatgtgacatccacctccaccataaaacttacccttggatcattgttttttaagtgtcatattaaaaattggcaataaagttgtaatgtcataatataaatccaacgatatagtcttcgtaacacaaatctagctaatttcaaatattaaattgctcggaatttggaaagtttgacagtatgattatctcaaatcaaataagaaaaaaatatttatatttgaggctaccaaatctagatctaatcagtactctttaaatcttgtaaaccccttacactttctttaccaaagtctaaagaactaacgtctaacgcatctatcagtttcttttctcatgcctgagtctccttttccttgttctccaatagcaatcacagcggttaagtaaatactctataatgttcttttttcacaggcgctcgactgcatttgctgcagctaggcttcctgttgtgctcgacagcgactgtgttgtttcctttagtagttagttgcgacgtaattatagtgcaacaaaccgagtgtgctccattttcattcgctcttagatgtgtttcattagctattgttgcccgctgtctcggctcataaatccttacacttctcaccatgctactacattaccttatagtactattcacttaaacagtactcctttgggacaaagttttttgaagaaaatttgaaggaactcaattcagtggaaaactttcctttgcgatcctttgagtcaaaaaaaataggcatccaaatatcttatgaaattctttaagattggctcaaaacataaaaattttgacatgaggttcaacttatttgaaaacacaattcctttcctttgtttatatctcttataattcttgtgtttttccttctccatcgaaacaatcatttatgtagtttttctacatgttcacaatccatagaatttaaattgccagggcatttcaatcatgtattatttcttctattttgttttgacaatactgtgtttcaaagagtccatagatttaatactccaagtggcaatgccaaatatgaccttttattcaactccactaaacaaataaacatgctggaccctaaagatgtctggaatgtctcatgtgtggattcctcctgaccaccactggactaatcgccgccgctcgtacgaaagacaactagacaagcagatcctttaccaaaaaccaaagccaacacacaaacggcggcggcgcgcacacacgctctcgcccccaaccc

SEQ ID NO: 66584 - DNA, 6572 bp, Oryza sativa
accagtactgccaaaacaatatttttacagagcagtttaaagagggttttgcactgggaaaattggaaaccaaatataagaaaagagttcaaatataatagctttatttctgaacacacttgagttggccaaaagcaacagaatgacaacacatataggcttggagatcaaagttgcatcttaaagatcgtgtcaatatccaaaacgacgtgttttttaacttgagtgagtggattgccaatattgacagttgacagatgcctaatccaaattcctttgctagggatagcagtagtggtagtagtacacgactacacgggtgtagagttggacggcggtgtgacaaacgtttcaggctcttaagccccttcctcatcctctgacgacgtgttgaatcgtttatttagttgcgtgaccatcgcaacacgcagagcacggctgaaactttgtgctgaggctctcgagtttctcaggaaagcaaagaatgagtaatattgtaatgaaagaacatcttcagtcttttgttttttttttctcagcaagcttttccactgctgcgcttatgttccacgttggtcgtgtttttttctttttattcaccgaattaatcaaactgattatgtgctccatacttaacaaattacgctttcttttaaagaaaaatttcttctaccgcattaaccacttgttttaagttatttattaaatattcaatttatctcttaatcagatagataattcgcgatcaacaataatctaaatcaaacatgaccaaacatagttacatgttttaccggttcaacaagacaacaactcaaaacaaagggtgtggtctccctttttttataggcccacactccttccaacctgcactggcttatgagtccaccatgggtcacacaacaagtcacaactcacacggctcagtcgagaggaggaattagctttaagctggtccatgggcccaattgggcctgaagcacacttggcattaaacacgatagtcatatagggaataaattcactttatatccctcaatttgtcgccgagtcttaagttcatccctaaaccgaaataccagatataacatgtcctttaactccttaaaacagtgcaaacttgaccccaagatggtttggatgacgtgacgtttatatggttgatttgactgggtcctcatcccacgtggtgaggcacttgcaatcataaaaaatgggtgggacccacatgatagtgttagattaaaaataaagaattattgtgagaccaacttcatcaccccttcctctacgctctctctctccctcccctttgctctccctttcctcattgtccccgacaccagcgcacgttgcagctgttgccgaccctgccgacgggtgtgggatgctcgctccccaccattggttgcctcatcctctcctacgcactgatgagggaagaaggctggaatccattgggcaatgttgaactcgagcttctcccacggctaggagtgaacctcgtcgatagtgtgggcccagatgccaagacgggcgacgctcggctgccgcccttctccacacctcccgccgtgcctttccacgccgcccgctgcgtgccgccctaatggagatgggaagggagaggaagatagagggagaggaaaggaagtaatcgaacaacacaggcggagaatgaactcctacacaatggtgcgaaagttggaggtgttgatgatgagcacggtgttgggcggctggtaggatgctctcagacgcttcttcggcagctttgacgacgtcggagagggagggtgcggctgcggcgcttgcaaagagggcacccgcgtaggcaagagccacgcgatcgaccacgacaggagaaggcgagacgggagatggaggaggagagtcctaggagcacggtggccggtcggtccggccccaacatcgaggaaggagtggagggcgttggccgcgggcgacggggagatggtcgtggtggaggcgaagaggctgcgcagttggttctcgcgaaggcgtgggcacatagatggatggacatgacgatggtggtggcggcgttgttggcttgtggtttctcgacacgattatgcgtgcgccgataatgagtcgacaatataagggaaaaaaaagaggaggaagggagagataaagagggttgatgatgtaggtcccactgcaacttttttttaaccaaacactgacatgtgggtcttacagtttttttaaaaaactttaagtgccacattaacgccacgtaggcaccacgtcagacgaaaccgtcatccaaacaaccttaggatcttatttacgctagttttgggagttgatgaacacatcatatctagtattacggcaacaaattaagagacctaaggcgagtttagttccaaacttttttttcaaacttcgaacttttccatcacatcaaaacttttctacacacataaacttataacttttccatcacatcgttccaatttcaacgaaacttccaattttggcgtgaactaaacacaccctaaaatgaacttattcttagtcatagatagggttcactaaaccgttttgggtggggttactaccatctcacggtaaggtggttatcgcaataactatgtggttatcgtaaagatgcattcgattatcatgagatttaccatgattttaaaaactgacaaatggtgtgttcgcaagtgcaggatggaaaaccatccctcctgcacgtaaaacggagcggcctttgaacacataattaattaagtattaactattttttataaaatggattaatttgattttttaagtaactttcgtatagaatttttttgcaaaaaaacacaccatttagtaatttgaaaagcgcgcgtgcggaaaacaattaagaggggctaggaacatggggggaacatggggttgcaaacacagctagacccttgcgttcccgattgagcaatcgaagtaaaaatcgctgccctcagagacaatagcttttggacgtgaaagtacagagggagcacgcagagaacgaagaaaagagaagcaacaaaaggcagtactcctacagtgggggtgtgggacaccatagccttttcaggcttcgcagctcctaggacaccggcaacaatggagcagtcagccagtcagcagtgtgtcctcccctgtcctgtcctgtccgctcgttcggtgaggagatcgtcacgccttgctgttgctggccctcgggcggtcgggcactcgggcctcgccgcctcggcgacttgggctaccggacacaacggcgcggctcccgagccgagaccgtaccccacgccacgtcgcaggccgcgacgatgaccgatgcttcctgccgcggcagagcccaaccacacacacactgcccccacttagagcaagttcaatagtatagccaactaccggctccaattcatttatagccaatctaatagctcattcatacaatagttacatactgcactattaatacctagtcccacatgttatagacacactgcgtcttggagtctgtgctacagctggctataaatctgtagcccgctgcttttatctctcctgatttatctttttaaaataatttatctttttaaaatatgtttgtaggtgacttatagcctgctattgtacctcctcttaatattcccgcgtcaccagcctacggcgcctatacaacgccctacgcttgtcgtctccagcgacctgattccaattccatgcgtgcttgcaattgcagcccgcaggcgtttcgtcagtttgtcactggcgccggcgtaatcaccggcttttgcacgcccccccccccccagcgggttgttgcagcggcgcatgcatgaccaagattgcgagaatgcaacatcgagcttgggaattgggatgaaaaccaacaaaaaccatgcgaatggaagagcattatgccttcattaatccatatggacgacgcgacgagcagcattgtcacgaaccatggaagaacaggtactagtagtactaggtggtactctgtaatctgtactcgatgaacatcacagagctagctgaacaagctccagcgtaatgtactttgttgtcacttcgtgtctgcgtcaccggcagatcggccggaggcggcggcggcaaagctagaagccggaaggcatgcagggaagactgaagagggagcagcggccacctggtcggttgtctggctagggctcgccggcgcgcgacggcgcgcggcaggtggggcaggaagcgcgcgccgcgagccacccgtccacgcaggcgccgtggaagccgtgcccgcacgccgggagcacgcggacgcgctcgccgccgccgtccgccagctccgacaggcagatggcgcactccgcctcggcccacccgccgaccatcgcgacccccgacgccgcgctggccgcccccgagctacccgtgttggcgccgtcgtcggaagacggcttgggcggctgcgcctgcgccagcgccggcgccagcgccggcgccccggagtcgcggcggcgggcgaggcagcggatgaggcaccgcgcggcggcgtggaggcagaaggcgaggagggagacgcaggcgaggatgatgaggatggtggccacgttggagaagaacgcgcgcgagctggcgtaggggccccacgccccggcgccggcgtcggcattgccggggttgggaagcggcagcctcggcggcggggacggggtggcggtgatcatggccgccgccgccgccgccgtcgtggcgttcacggagggcgaggcggtgtggttggcccggcgcgtcatggctttctcggggagtggcgtgtgtcgcggcgtgggagtgggacggtaggaggtggtgtccttgtccgcgcttcggaatggtcgtcgtcgtcgtcgctatgcgtggccttttgtacgcttcttttctttcctccagaactggtaactcgacccagaccccacgcttcgctttggcaggcacgaattttacagctttttcttttttgaaattcaacatctactactcctaaattttgccgccattttaaggtcgccggagggcatgaatgaaatcctgaagtttttatggcaatcagttcgtttaataggaatcagaattttttttgttcattttgtaagaggcctactccctctgtcccaaaaaaaagacaatctctggtttccgtgttcaatgtttgaccgtccgtcttatttgaaaaaattatgaaaaaaaataaaaggataagtcacgcataaagtattcatcatgttttatcatctaacaacaatgaaaatactaattatagaaaagtttcatatataagacggacagtcaaacgttggcacgcaatccgcggtttgccttttttttttttttggacggagggagtagatgggtctaacattacatttttctactcctacatgctcaagcatgagtatacattttatactctaccgcggtagtacagccaaagcatgattgtcccggtgcatgatgctagaaagtagaaaaaacgaaaccgtaggtatagcataatggcactagtgatcaatcaagatgcaaaatcctaggaaataggaataccactttcctaaaccaacaaacggcaatagttaactctggtcaatgccattcgtcccgtaccaagaacaagaaggtcctacgggaccatccactgcgtccatagggccatgttgtagtagtcctccaacttttaggtccctcgtcgtcttcgcctcatcgaacccatcaaaaggagacggccaggcccattgcgcccccccccccccccccaccccactggcccaatcccccagaccttgaagttgaaggagggttggatatcgtccagcggcagcgctcgtgactcgtgtgagttcgtgagcaggggagtctctccgcgccgtgtttgctgtgtgcatggcacggcaggcacgcagctttatttatctttgggcgtcgcaaaggcatgaaccagtatcatgactcccaggcgcggggcccaatgacccaacttggcagcgttgccagcgttcttcataaaacaaagcgatcaagccaggaaaaattggtaatttggtatagacagactccagtttgatcagattggaccatggttttcccagccgaccggttaccgtgaggtaaccgtgcgttccgtaaagttaaggtaggggtaatcggctatagggtttgataaattttatctaaatttaaattttcaaaaaagaaattggaaaaattcttgtaagtactacttatacaaattttgtgataaaaaagagagaaggttaacataatagactcttatcgtttatgctagttgcattaacacagccgtaacagttatacctgcacagttgtagttctttttttttcattgtggatgttgttcctgtaactgttactaggggtggcaatttttccgttagagccagggccgggggagaattttcacctgcgggtgagcgagggtggggatcggaattaacccacgggtaacccgaaggggcaccggatgtgagttacttcctccgtttcataatgtaagtcattctagtattttt

SEQ ID NO: 66585 - DNA, 688 bp, Oryza sativa
tatagtaagagagggtattaaggtagacctcaaaatccaatactagacattaagagagggagagagagagtagcactaccacgagagagtggagattgatagattttttttttttggtcttaggagtggtctttatacatatagttagctcaaccaaatgttttttttataagaactactctcactttagaggcttaagacatccttatatctgtattgtggctaccctaatgatgaactctgacaataaggcgatggaggatatggtagcacggatttatccttcaagaattgggattaaattgattatatgtgtaaatatcagctcttttctttttcaaatggctaatcaaatgactggtgttatattaatgggttaattggatctatgatattgtaaatatgtcatattagaaaaataccactactatttgcgatatcggctacgtgccactgaaatttggggaaattgaaatcatgccactcccatcaagttttctgtcaacctctgtctaacccccatgaacagcgtcaaattcctccgtctaaccccatcgaagaacatcgtcgcctacaccaatcggtgctggatcgattgtcgtcggttcatggaggaggaggaccacgcggagaccaaccggtgagctctgggaaggtccgacgtggcgacactcggtcgggtggaggg

SEQ ID NO: 66586 - DNA, 18019 bp, Oryza sativa
cttagaccgaaaaatgtaagctcacataatttgtactcatccaaactcacataaatttcttaagaagaatctagaccacaaactagccatagtcacacaaaatatctttttatcaaaggtatattcttataagtaatttttattccacaaaattttctaaaggacatactgtgacacttggcatgaatctaatttaacattctttctttatcaggttataaattgaaaccattgaacgtactttgtcttcccgtccctaaaacattgtgatatatctgtaatattttaatatttttaattttaaaaataatttagactaataatatagatatttaaattaggtaattagtaaattcaaatcaactatagtttggaataaaaaaacaaaatgatatatgccaagtacaatctaataacaatagaatgcacttttggttaatgtttactcctaatttcttaatttctagtttggctccctccaccgttatggtaaaaaatcgttatgttttaactatttatctgctagagcatatgtaatatttatgtaaactatgttctttattaccaatcaaaatagacaccttacctactttcatcaaaagaaataaaaaacaacactaataaataatgaacatgattttagatgtagtaggtattattctggaatactcctcgtcggaaacatatggaacgcatttccctcaaaacgcaaaaaccggggccccgagccctcgacaccaaccccgtcggatgtgaagccgacggcccagatggaggccagcggtgccaatgcgtaggccacgcgtgcctctgcgcaaatcttatctcccgggaggctccgctccacttcccttcccgagtcactcaaaccatccaatccctccaccttcccttcccttgcccccatttcccaccgccgccgcgccttgcccccattccccaccgccgcggtgcggccgccgacgacctccacacctcgagcacgcgtgccgccgacgaggtgcccttctctctctcactctcgtctcccccattcctcccctcttcccgtgtcccgtcgtccacagctccccgaccaaatccctagccctactattccccacccaccaggcctccctcgcgtggtcacgccgcacgatcgggcccgacagtgccgccgcttcttgccctactgccgcggttctttaagagggttgtcctgatttgctgcagcccagtaggtattgtatatttttctcgttggtaaatttggcagcaaaaaaaaaagtgtttaataccgaatgttataaacccgagcatctcatggtgtctatatatcagcatatatgatatgttaggattggtaaggatgcatatcacacgattacaattaccaactccacctcgaagataataagcccaatagtctaaccctaaaatccctccctacctgtccggtccttttctcaacgattcccagaagcgccgcttatctcgagccgagtggccgacagcgccgcccaggagtcgaggagtcgtagctcgtagcgccacccttccttgtgcgcgcggttgtgccctttctcgccgccggtctccccgcttcacctcgcatcctcaacgtcaacagctgccatccgctcctcacgctggctatcgggaaggtcagtaggtcacgccgtctccttccctacttgcctccggccaccctaagaccccaactcgcctcttcctcgcgcgaatcgcctagttacccggcgggcgacacccctactcccgtgtggccgcgcgtcctcgtcgtcttgcttgccctgctttctttggctcacgagccaaacgagcccgctcgagctagacaactagccgagcctagcttggttttctagctcgttaggataataagccgagcctagctagaccgagccgagctggctcgacatccaccccctacacgcgtgcctttgcccaaatcttatctcccgggaggctcacttccctccccgagtggctgcgacgacctccgcagctcgagacgaggtgccacttcttcttctctctctccatcccccattcctcccctctcttcccgtgtcccgtcgtccacagctccccgaccaaatccctagccctactattcccgcgcccgcccctccctcgcgtggtcacgcccgacagcgccgtgccgccaccgcttcttgccctattgccgcagttcttcaagaggcttttgtcctgatttgctgcagcccggtaggtattatatatttttgtggttggtaaattcggcagcaaaaaagaaaaaaaaataataccgaatgttataaacccgagcatctcatggtgtccatgtatctgcatatatgatatgttaggatcggtaaggatgcatagcacacgattacaaccaccaactccacctcgaagataatatagcgtagtgtttgccagcttcgcacgttatggccgaattcttatgtataacaaatttaccatggtatgtaagctcaaaaatgcaaaactaattatcctcgaacctaaaaaagtgtatacatgcaagagatgatcaatcccacatataaatacatgcaaataatacacgccctgctcgacagccactgctgcagctgtacctaagctactagctgtggccgcggtgtgcatccacaaccgtagcaatggctgctcagcaggcccatgatctctgaaaaagttcctgcaagcagtacatatgtatgtacagttgtacacaccctcgcccctattcatcctcttaaaggagtaaggagtaatgacagtcgatatgtgttggttgattaaaatttagaagagaacgtttttgaatagaattgtgaacttactcgaatatcgttcttttgtgtattgcttttgttatgcttcacctgactctatctctgtgaaatggcagctagtatattgaaggttgaagctttgtgggtatccagcaagtatttcaatggcgttgctacagtttggaggtaccttggcccccaaacttggggaaaaacctcagctgttgcccaggtcacctgcacttacaagagttatttatgctgatccaagatttctggtgtcgaaaagtgggtatgtgaatgtgttctgatcagtgagatgtactaggaatactaaaataaaggacacattgatattataaaaaggcaagatttctgagtaaactgaagatgatatatctctttttgtgcagtagtggaggcaggcttaaacaccttgtatcacctactgctagtttacaatcacggacatcttctcgactatttaaccatgcaccatcaccgagatttcgccatcgaaggagttcaaggttcattgtcagagctgatgctgtgagttacttcatttgcttttcttctttgctggtattattagaaaatccagtttcctgacatggatttgatattttaatttacaggatttctattccacacttggtgtttcaagaaatgctagtaaatctgaaatcaagagtggtaggtgtggttttatttgtcagtttagggcatgcagtgattggtgctccgtacaatcgtaggagtattacccagctttgcttcttctctagtttgagcctggttgtaggtttgtaggtaccctataatttaccaaacaaaccagactgctttcatgtggctattagtcgtagattactagttttaaatcatactgttcacgtgtgaaacaaaatatatgtacaacagaaactgttaagcttcccagggaagatatgaaatatataactagtctttttcaaacttggccatagtgagctttatggcccacttgtttgttctcgaaagctttactattcctactagtaactcaaatatttgctatttcatctaatttgaaggctatctcagcaaaaccccttgaactattctaagacaagcctatgctgtcttcagtatcattttctgcaactgatcatcttgcgttctagactcgatactgtttatatttctgaaaatctattgttggcaacttctcattgatgcattgtttgtatggccctcaatccctgccctccacgtgtgtgggcagaaattttgaacaaaaatcccaacccacacccgtagataatctaggatttgtcctatccaaataatgcctaaggggatattatgttagaaatccttcagagtcaattttgatcaaaatatgtgtagtagtttaatgttgctttctattgtagttctaaaatggtccttcttttccagcctataggaagcttgctaggagctaccatcctgatgtgaacaagtaagtactaaccattatatgggaattgtgtttcagctacactcgatatattgcttctttttctcctttcgatccattataaacctgagtactagttgttgcattacctttttcataactacataatcaaataagcaattgttatgcttgtgtatttttctttagagatcctggtgctgaacaaaagttcaaggatattagcaatgcttatgaggttagtccagctaaccataaccaaatcccattgtttcttatgactatgttgttgtagggttacaggtgcttgccagctaacataaataggattgcaggttttgtctgatgatgagaagcgatcaatctatgataaatatggagaagctggtttgaagggtgctggaatgggaacaggagtgagtgttcctagaatgttgtccaattctgaagtatgatcagcatgacctttatatgatattgattgtatgaaatttgtgaatctgcaggattactcaaacccattcgatctctttgaatcattattcgaaggctttggtggaatggggggaatgggaggccgtgctgctcggaacagaccaatgcagggtgatgatgaggcctacaatctggtactcaatttcaaggaagcggtgtttggtgtagagaaagaaattgagatcaccagactggaaggctgtaatacatgtgatggaactggtgccaagcctggaacgaaaccaaccacatgcaaaacatgtggaggacagggacaagtggtctcctcaacaagaacgccacttggaatattccagcaggtctccacctgcaatacttgcggaggcactggtgaattctctaccccgtgcaacacttgtgggggtgatggccgagtgcggaagacaaaaaggatcagtctaaaggttcctgctggtgttgattctggaagcagattgagggtccggtctgaggggaatgctgggcggagaggaggccctcctggagatctttatgtgtttattgatgttctctctgatcctgttcttaagcgagatgggacaaacattctatacacatgcaaagtttcatatattgacgcaattcttgggacaaccgtcaaggttcccactgttgatgggatggttgacctgaagatcccctccggtacccagccaggcacaacgttagtgatgtccaagaaaggtgtcccactcctcgggaagtcaaatgctcgtggagaccagctagtgcgtgtgcaggtcgagattccaaagcgtctgagcagcgacgagaggaagctgattgaagaacttgcaaacctaaacaaggctcaaacagcaaacagcaggagataattccatgaggcttcattggacaaaatgctttggcaatatgcaattttaacgcaaattgcagtgactaagtgagcatgaactggtaaatcacttcacaaactgtacgctcatgctgcgccgtaccatcggtgggaactgtgaattctcatgtctgtaacttcatttttaagccatagaaatctagttccatccaaaacaccaaaacggatggtgttttacagtagcttgtcatatgcttttaggcgagcttattagtctatttttcataatactttttcacaattttgaaaggcctagggagaaatatttaatggtgcaaaagggacgagttttgaaacatttgtttgtcgcagaagcaccagaccattctgattgttattgtaagctgtaacatcaaagttttggcagcaggttttcatgtgctcttaagcgttgggggtttgttccgtttggttttcaactgtatgctagctttctctattagccaatgtaatggcagttgcaaaatctgttgtagtgcaggcgtgcagctaaatgcagtatagctgactgttaactttaagctgattgttccatgcatgtgccagtaaaaggccagtcaggaatgagtctcatggatcaatatatggtgcagacatgtcagtaggatataggagtattacattatagttttttcagcttcaataacgttcatgttagcttgtacattgtatggcaacccttccatacttgcgttagccacaaaagttcaccatgttagcttggctttagatcagtttaaactgtcctttaatagcaaattaataatccataaatgaaattttacttccactgtttaccagtgctactactgttctacctccagcgttcaacagctgagaaacgtgaggagtccagcaccagcagtaccatttactgcaatgcgagagagatgttctccgtttcctccttcactgaggcttaggagtaggagtagtagtgattttttcgtgtcgacttgtttaacattatcgttaacaccatcaagtgtcaatgccagtagcctgctgcttctgatcatttcttccttccctcttctaacgccattatcgttttatctcaccttgcatttatgttcaagtgaccatggttcttgacagaagcagcccttgttctttcctgtccctttgtttgttcagtacgctattattctcttgggtactagaccttgtataaaccggttgtgaaatcctcaatcaaataaaagttaactcgaaatttgtggcctgttccaagtgtttggcaaaccaatatgtatattatccacccgattatctaatggcaatacagtgcctaaaattcctgcttccggagtcttaaactttacccgaatccaatctggaaaccgaaaagacagctgcttggctgatggcaagtcactgggtacattgatttgtgttaattttcagtccaataaaacagcgcaaaaattgtaagggtgatccctctttagtaaagccatgcattctgcaaactctgttgcaatgcaagctgtatcctatatccagtgccgatgaaccaattctgtttgcagactgtaccctatctctactctacaagccaaccaaaggaaagtgtttgatctgcagtggaatactagcaggtattccaccatttcagggttgggagtgtgattgatatgcaggagattgacattgtgcagaacattggccgtcaggctgccgctgccgtcgccggtggtgtcggtgagaaagcccggtggtggtggttgtgccggcggcgaggagtggctgcaacaggatgggctgttgtgcatgggcggatcagcgggtggcttatggcggtggccacgctgttcgccggcgacggacccggcggcggcggccttcacgagggacggcgcatgatgatcctggataatttcgagacttcgggccggcgtgcgtgcaaagcccatacatattctacgcgcaactgtcacgcacaaaaacgaagtttttagtaccacatggaaaatctatgacgactgacaccggcataaaagacgacgcgctcgcatcgctcctggcgagctcggtggcgtgagcttgttaccccagctgcggggggggggggggggggggcgggagttggcatgtttcggctgctggagaaaatgaggtttctccctcgatcgaatatggatgcaaacatcctcccgactttggcccacgaggaagggaaggtgtgagtcaccctgggctcttgacggctgcgtcatggagcgaaaaggacgctgaatcgtgggaaaggtgtgtggtggccggtgcccgacgacggcgcctggcgatgggtggggagaaggtgagcagttgtagttgggacccgtgccacacccccgcacgtgcgcaagtccatgacgtgagcgctcccggtcattaggagccacgtcagctggcggcctccgccgttgagcttttccctgccaaccgacacccttctccccacccattggcgaatgccctagaggtttgggttgagataggagtagaggggagtgaggtggaagaagattgctagttggcttgtgggttccacgtgggccctgcactgactcagccaccacgtcaacaaaaaccggaaagcaatactaccttgggattaaaagtggaccgttttgcaagattaggggttcagggccgtttaaaactcaacgacaagataagggaccttagatgaacttttttgggagatgaggcgcctgtgcatatgacccataggcaggcgacaacgcggcagcagagcgctgcacgacctccgcctccccaatccgtcccgtctccttcgcccgccgccctcgactcccgtctcctcgcctgccgctggcgccgatctccatcctgctagcagaggtggcgccggcgtcctcctgctcccgccgcattcgcatcctaatccatcccatccggcctcggcctcgaatttcgtctcctcgcccgccgcttgcgccgatccccatcctgcgagcagaggtggcgcccggcgtcctccttcttccaccgcatcgtcgctcgccggtgagcatccctccctacccacacctcatcaggtattctgcgttatccctcaaaaagtttgggggttcaaccgaaacagggttagatctgcctctgcccagctccacctactttcaagttgttaattttgatttccgtttttagcagatgtaatttggttattgaatctcatccaaacacccttagaacgaaaaatgtaagctcacataatttgtactcatccaaactcacataaatttcttaagaagaatctagaccacaaactacccatagtcacacaaaatatctttttatcaaggtatattcttataagtaatttttattccacaaaattttctaaaggacatactgtgacacttggcatgaatctaatttaacattctttctttatcaggttataaattgaaaccattgaacgtactttgtcttcccgtccctaaaacattgtgatatatctgtaatattttaatatttttaattttaaaaataatttagactaataatatagatatttaaattaggtaattagtaaattcaaatcaactatagtttggaataaaaaaacaaaatgatatatgccaagtacaatctaataacaatagaatgcacttttggttaatgtttactcctaatttcttaatttctagtttggctccccccaccgttatggtaaaaaatcgttatgttttaactatttatctgctagagcatatgtaatatttatgtaaactatgttctttattaccaatcaaaatagacaccttacctactttcatcaaaagaaataaaaaatgtagtaggtattattctggaatactcctcgtcggaaacatatggaacgcatttccctcaaaacgcaaaaaccggggccccgagccctcgacaccaaccccgtcagatgtgaagccgacggcccaaatggaggccagcggtgccaatgcgtaggccacgcgtgcctctgcgcaaatcttatctcccgggaggcttcgctccacttccctccccgagtcactcaaaccatccaatccccccaccttccctttccttgcccccattccccaccgtcgcaaggaaaaatattattaataaacaatgatgttgatgtattattattaaacaatgatattgatgtatttctaaatattttcacgtattatttattaagtgtcagtgattgaaatggatcctggtcggaaatgaatcctggtcggaaaatggttactaatgtttttccttcatataatatttctggatatgtataacaatgtgggtcagcaatattgaactatgcaaaccattactctgtacaatcttttcttttcaaatgctggccacatttcgctcgagcttactgctcatgtatgcagctcatggatcctgagatctagacgtcaacgtgcttcctggaaagagagaggctcaggcatgagagcatacctctaaaataatgtccgtgcttacctgtgtgcttgataacatgggctcatcctgtagcagatctcattctttaagtgaggctgaaacaaccaaaaatgcaaaagtaagttagcactcggacttattgaacaagtaaatgctaactcaattcttgatttgagagttgccacatttggtttcttctaattcagctggtaacagtctgcagacattgacaggcgaattttgcaagagacaaaagcagagcaacacatccacaagctcttacttcttggtattgctaactttcccaaatttaagtggtcattttccttgtcacaattatctgtgctacctttagtatctattggttcagaaaattaattgtttatgttgttcctatttacctctataaaaaaacctttctcatgttatttccaaaaaaaaagaagataaataaatgtatcctagaaatttttagtttgaacttgttctcaatgtggatccatccttctttctctctctcaattgcttctgttttaaggtgcgggagaatcagggaagtctacgatatttaaacaggtgatgaatgttatattccatggagaatcataatccgtacgccgctagttagtctgatgtattcttactgttcacctgcagattaagctccttttccaaactggctttgatgaggcagaacttaggagctacacatcagttatccatgcaaacgtctatcagacaattaaagtatgcaatactggaaagggtgtgtcttttttttcttattgcaaagtggggattatgtaggagattcgactagggatttgtattctgttcataaggaaatgcgttcatacttttcctttttgtcgagtaatgtgttaaatgttaacagatactatatgaaggagcaaaagaactctcacaagtggaatcagattcctcaaagtatgttatatccccagataaccaggtttgtgcttactctttactcaacagttaaagctaaatctgtgcatatgaacatgtcttgttaaatctgggaatacaaacattttgatttgcaacatttctgttgtagtcaagctgctcggctctatgttttaacctgttaagaccttgtagactgtgctcggctctattgtagtcttatattttacacggtcattctataatgaaaacttgaaaaagatatctattgaaccgtacaatgtactgaacaaagtagaaaagaacaatgagattttgtaacatttattcttccttgtttatttgattgcttcagacaattgttgatatgctaaaaataacttggtatcaaatgtgggtgttataagattcaatttttttctcaaccaggttaaaaaaagtatacctttgtgcatttaccttgttccgttgctttggaactttaaaggaaaactgacttttcttaggcattgaaagacaaatatcaccagtttcacactgtacaccttaccaaccaattttgtttcttagatgtcatttactttgtcatatcatcaggaaattggagaaaaactatcagatattgatggcaggttggattatccactgctgaacaaagaacttgtactcgatgtaaaaaggttatggcaagacccagccattcaggtgaaaacaaatagccattcaaatcttttgaagttatatagttttcctggccaggtgtgctgaagcaatgctctatactgtaggaaacttacttacgtggaagtattctgcaacttcctgattgtgcacaatacttcatggaaaatttggatcgattagctgaagcaggttatgtgccaacaaaggtgtgctgtccatgttcatagacaattatttacatattctcagatatttgtgctgacaccatttcatgttgatttttagtctacttagtcagaggttgtcaaatggttaactatgtgtactgagtcagaggttgccaaatagttttaaaagatgggcatatgtttatccttatcttttaaataatattggaggctatcctttaaaattcaatattagggaggagaaactattattctaccgttattacgcagtctacataacgaaggtaaaaaatgtccctgtgaaacatagggtgcaaaactgctgtgaataaaactctacttatctaagccccttgagcttttgagttcccacatattaatcttatgacactagcatatattttttttgttcagttccttcaataagttgcaacccacaaatatgatcactgtaccatccacttttgcaaccatttcccgtcattttttaagcatagaaaattgtttgtcacttgtttaagtccacactgcatcaaaattccaattaacattgtgtgtgctaagtgaagatatgactccatatttctgcatttagcagtctgatggataatttgtgattgtaccttgtctaatggttcgtttgaaaggctggtagttgatcttccatacttaagaatgcttgcagtattatagttgtcaatattatgagtcattttgcaggaggatgtgctttatgcaagagtacggacaaatggtgttgtacaaatacaatttaggtaatctgctgacactattttttgcacatttttttgctggttgctctactatgtacagaacgacaagttgaagtcctttttttctcccctttcacttctaagatatgacctgagaggttctgaatgtagctgttttaagatgagttgaatcatctagttaactgggtttctttctgcagtcctgttggagaaaacaaaagaggtggagaggtatataggttgtatgatgtaggaggccagaggaatgagaggagaaagtggattcatctttttgaaggtgttaatgcggtaatcttttgtgctgccattagcgagtaagtacaatttttttgattgttgaacttatcctaatctgctaagttcttctcataggcttcttgttcatttcagatatgatcagatgctatttgaagatgagacaaaaaacagaatgatggagaccaaggaactctttgactgggttttaaagcaaagatgttttgaggtctgcatgcatccatctctgcaacctttgtgctcatgctttttttctcattttgaaactaattacggtgctatattgaccatcagaaaacatcattcattctgtttctcaacaaatttgatatattcgagaagaaaatacaaaaggtaaggcctgctctttgtaccaatgcatagtttagtactaaatgttaccaacatttatgtttacgctggttacgtaggttcctttaagtgtgtgcgagtggtttaaagactaccagcctattgcacctgggaaacaggaggttgaacatgcatatgagtgagtgcactactcgccctctcagatgaacatgggcatttggccatttgtaatgttgctgcatggtgcacttatatgccttgataagtttttccattctaatgttatatagtatcaaacgttcatcattactgtggcttatggtctggagtgacgttttacaggtttgtcaagaagaagtttgaagagctctacttccagagcagcaagcctgaccgtgtggaccgcgtcttcaaaatctacagaactacggccctagaccagaaacttgtaaagaagacattcaagttgattgatgagagcatgagacgctccagggaaggaacttgattcagagctaagactaggttgtaagtcacacagggaaggtaattaggacggcgagaggaacaaagtttcacactgtcacagctttatctgttgtaattcttttacacgtggaccattgattgatcttttggttcttactgtgggctgttcaggtctgtaccctattttttgttctctagttagccattgtgcaaattttccttgaatcagattctctacctgttgtctatgtgtgttatcttggtctgttaatttgcatagcccacttgttcattacaaaaggagatctttactacttacaaaaaaaaaaatctagtgggaaagtggttgcaaataattgaagaaattatagctagaaggtgtatccatggtggtggcttgagcccttgaatcccgttattttgcatacaattacatatgttattatagcttgcagagtacaccattagctgtagttacctggtccaccgtagtatacatgcatacagtaagcattaattccataactatcggaggtcgattttgctatatatttgtcgacaaatttttcctttgacagatgtaattacagtacaatcgtagtgtaattatattgtaacttgcatgtaattacactgtaactaacttgtatgtaacttttaaaaatctctccataacatgttattttggtaaaatagaggtcatgggaacaaattctttcacatatgtgtgtgctatgatttgtttttttttctcatcaaaataaatcttataatagatctaacgattcaaaattatgtgaaacttacatataaattacagtgtagttacatgcaagttacagtgtaattacatataagttacagtgtaattacactacgattgaactataattacatctgtcaatttttgaggaaaaatttgtcgacaaatgtataggtagtccaggtatatttacttggattacaggatcctgcataggctttaacggggtttggattaacaagcttcttgttctcattcacgatcaggatgtccctaataaaagccactgtgccataagcttctgaagcaaaatgtctattacccatttgtggagaattttcttagacggttggaccctgaacatatccaccccactttgtataactgcccattaccttcatgtaactgaattgagaacttggccaatatcctattgccgtattcttctcaccatataccaaccgtcagttttttagtcttcgggtcctaaaattaatttaatttgtgttcaaaagtgtgcaaggggcaacatgccattgaatgcacatgacacggtattgttctttttttatattctaggtgttttaacaagagtttctttgtactccctacgtttctaaatacacttgccattagttactatctaaattttaacttttaccactcatctttttcaaaaaaagaaaaaatcttagaatgataaagtattatcaaagtgtgttgtgtcctaaacataagcattaatcatttgtcaaagtcttagttatttaaaattaggggcaattgtgtttctgcccctgctttacatgtcaattgtgattttaccctgctttttagagtttgtgattttgccctacttttttgaaacgaagcagccgcatgtccctactctgttaactaatggtaacagtcttaaatgtgtggtgaatggacaaatatacccctggacatgttttggcttgtgcaacaccacgaggccgcgccgacggagccgccgctcctttctgccactcctccgccgaggggccgccgtgccaacggagccgccgctcctcggggccgccgcgccgtgccgcgcctgcccacgcccgactccaccgcgtgctggcccgagccgccgctcctccctgctgcgcgccgccgcttgtcgcgtaagccaccgccgccgctgcttgcaacctagcaagctagggttttcgattggatcggggacaacaaggtttggggatttggttgtttcattgaagcaagggtagaatagtcattcacaaattataatagcattttctttcttcgtttaatttggaaatcccgggcccaccaaactaccgtccaaaccaggggcagacggctgcttcgtttcaaaaaagcaggggcaaaatcacaaaccttaaaaagtaggggtaaaatcacaattgacatgtaaagcaagggcagaaacccaattgccccttaatgttattaacaattaaagttagaatagtgatggtcaatactaacaagtatttgggaacaaagttagtataatataacgtcttttctctattcaaagtgaaatggtattgttggaagaccctagggaaatgtctattatgatctaagatttgtagtaagcttcttttattgtaattgttgtcgaaacgacaactgcatacgtcgaaagacgtggttactcaacagtggttggaaagaaacgaagtgtattaattttagaattttttactccggatccccccattacatggccctaggggactatttatagccccattacaggttcttactactagggtttaggttatacagggaaatttacatggttgcccttacgaaagggacatttacaggggtacataatgttatggaggctcatgggcccctgatgggccgtcgggcgatcgccggccctatagcccctaggcctgatgggtcggaaagactttttcggccctcgcgggagcgaacttgccatggcgaagtcgtcttccttcggcagatactcttcgccttgcacccttcgcctgggacgcctctggcttactcgcacgacccctcgcctctcgccattcttgctccatagcctttgccacgggtttcggcagatttggtcgaaaggcctcatgccatccgccaacagtaatgttgtgctaacatgcaagataatctaagcattgctcttgatgcatcagatgtacttctgaatatagtatgtagatataacatattatgcaaaattggtgttttcttatatatcttgagtaacttaattaatataatagtgaaccacgtaattttaaccatattgaatttcatgtaaaatagagagtaccttaaatataagaacttgaattctatattgtgttccattatagacggaagcatggtttaatcttcatccaagaacaacactgctgctaacttgaacgaaaccaggacggctgtggtcagtgcaagatttgttttgcgcttcatcattctgtagcgaaatttattccaaagtcaatacctaaaaatggaaaatatagctctataccatctcaaagcggtataaattagtaggaaaaatatgtactgtataatccaatgtattcgtagcaaaatgtatattgattacccagaaaattgtcacatcctgatttttgtttcaggatttctaaattatttaataaattattattagaatttatattaaatgttcattaatttacaagtgaagttaaatgtgggaaataaaatttcctaaatttaaagcatggatggatttaacttttattaaattctccatgattaagtatactctctgaaattttctcggatttttcggagctcaattcctaaatgatacaaagaacagttcagtaattatttgatcattaatgatctaattataattgttaagagcttttcttgtttaaaaatccttaaattataaattgttgtttaaaaggaattattagaaatgatcttaaaagcctaaaagagaatatctaattttaatttgctaaatctcaatataaaattgggctagataaaattttgttaaatacttctcttgaatctttagttcctagatttttctgggatttatttgagccaagaaagtatttttaataaatggaattgcatttcatgaataatttaaattaaaaaaggtttttaaaagtctcttttggctttgggccgaaagccggcccaaaacctctctctctctccctcggcccagtccggcagcagccgcccgcgcgcgcgttcgcccgctgacaggtggggcccacctatcagggctgtcttcctcctccagccgtcgcccggccgaaccctagccgagccgcaccgccgccgcctttccaaattcgctcgcccctttcccgatccggtgaaatcaatagaggggaaatgatcttcgcgatgtcctctaccttttctcttttggaatcatcgcctaattcggtttgggtaccgagctagaattcgccttagagtaatgagtcgcactcag

SEQ ID NO: 66587 - DNA, 9854 bp, Oryza sativa
  unsure (1)..(9854): unsure at all n locations
tttaacccaaagattcattttttgcatccataaagggggaaaaattgaaatctccgaattagccaattttggttattgaccaaatttttaaaaagagccttccaaaattaataaaagttttaaattcttgtgtggcaaaagggcaaacacttttttttcctggccaatggaaaaaccgccggggggttggccntaaagggggccccataagggtttttctctccacgtggccggcgaacctaccgaccgcccgccccgcttccaattcgttggccctttccgaccggtaaatcaaaaagggaatgttctcccatgtcctcacctttctctttggatcatgcatattcgtttgaaactggggattggatcggatcgaattgtctctctctcggaacctacccttccttcgngtcgcggtcgcgttgggtttaacaccgcctcctgcccctaataaagaccncggagctcccctctaccgcaagccactttggctttagcccgcngcngtntgtagcgccctagccctgtaagcttttgcgcngtcgtttgtccacccgtgcgccgccgtcgctccggtcgtcgtcgtcgctcggaaaagccgccgtcgggatcaccaagccgtcgccgatctcgtccgcccctccgccgtcgctgtcgaccgctggaacaccatcgcggtcgtcaagccgaaggtcgtcgccgcttcttgctcgtaaccgttgccgtccgttgatcttccgccgttgttttggtcaccggtgagttcgctgcgtcacccgcatcgttttggtgctctcctttcgcgccgccgcgccgtcgttcgccggcgggcatgcgtgcccaagtcgtcgctggtgatgacgtcaccgctgacgtcatcgtcgtcgtctcccgtggtccggccgtggactgatagatctcggccgttcgtttccgtgagccgccgccgtgcacccggtccaccatgaacccgacccgctgacgcaataatcctctattccttttcaaaaataattcattattacgtcataattcaattaaaatctatataaaggatttaatccgatttaatctttgaaaattcataactaattcattgtaactcagtttaatgtggttcaagttgcaaaagttatataaaataaagatctacatattaaaattatccataaatagaattaaatttatttaattctttttaaatgggctttaattagattaaatcttgtaaaattcgtaataaattcatatgaagttagaatgaggccgttcaagtctcataattcatctaaaattatgatctacatgtttgtttactttttatgtactgtttatttggtttttattagtcttttcttcgttttgcgtgttagcttgtcgtttccgtcgttgcgaaggttcgtgagtgcgtcgggagtgttcagaagattaattgaagaccgattattgcaaggcaagtaacagagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggatattataagtgtgtaacgttattattatgatggatttgtatattaaattgtcagtttgtgtacctcggctgattcctggacgaggattttatgcacaaataagttcggaaattaccagtgaatttccgggcgtgacaaaaatatgaaacctagcaaagttatcatcgctgaagtttggctagacccaagagctagcactaaccacatctccacatcctgtgccattttcaatttgtatccatgatccactaggaacccaatgatgcttcacctttggctcgtaaacatttgttgtgacccctattccatatatatatcatcccaatatattatccctgctttctacaaggaaaaaaaacatttatgaatcaaaataacgtaaatacatatacgaaattttgcagcatgttaattacatgaaggactgaatgtgcaacacttagaccctgtttggcaaaatggttatgggaggtggagttgggaaatgaaaaggagaggatgcctaggattaaatgagatgaaaagaatggatggctagaattgaatcttacctgatgggtggggcatatttttccaaacccattagctagtcagaataaataaactaatatttattcataagcttatgtaagataaatttatggtactcagaaatataataatttaaagttggtaatttgggtaacaaatatcgacaaaggacttgtttatttgaaagagggatgtcaaagtgaaaaaccataatcttactaacaaatagcacttcaaattaaggggccattatataataccccatcaatttcttaatattttataatcttgactggtgcttgctttactttgaccactgatatattttaaattgttcgattatgataaatggaattcatatgtttatatttaccatgtaacatactacgttagcacggtgtaatttttagtacttataaatttatctataaaatagaaaatagaagtagtcaaactaaaacaatgcaaggtcgagggaatatttaggttttgtgtatctgtttgagttatacagagcaacacatatttcatttaacaaaattgattgagttcatttattagcacttaaatatgaaaacatccaatacttttgtatagctttttcatagaccaatagtaatatagtggttttgtgagtctattatgaagctagacatatgaacaactcgatacaaaaatcttacctttttttgttgactggtgctgactgcattggtattctgaattgagatagtcttgtttcttgttgcgtagtactgggatggttcctatagggcattctgcagtagctaggtagttgtgcttctgatatggaagatataaatggattttcaacatccatctccattagtaaagagcttggtttcaactaattgacaaacgaaaacatgaccattttacaaacgatgagtttacatcgcactatgaaaaaaaaaatcctaagtatgatttggtttgtactttacattctttcatgatgaagcaaagatacgcaaatttttttggctttagtgccaggtcgaagtgtaacaaacaaataaatttactattttatccaaaacaagctgaattagtgaatattctagtctcccccccccaacaaaaaaaaaatactatagtcccccaaaactcttgtattttgatttatgactataataacatacttaattattatctctctatatatgtattcagaattttttagcaacatattagacatgatatcaaatgttagggtgaaatatgtgctttacctgaattgtatgatctttcaacaatggatggttaaagcctggttgtctattcatattgatgcaatcatagacatcaccatcttcagcctgatacgatgttctttttgcttgttaggtacaaaacaagatgctatgtatgtacaaaaagatctaattttgcacttacctcgatggttttattaaccccataatttgtgagaccttgactagtatttcccctttggcttatatactgaatttcttcccccctatgattagaacaacatatgcgatagaagaagagttactgtaatcactcgactttccctcattgtgattatcttggaagattccaagattggtattgatacatgaagaagagatactatttatagggtggaaacagatttggtgatattctttttaatgctttgagggaataaaaacaatgtaggcaaggcatatataaatgcagtattgaatgcacaagatttgatacgttggatggtatcagtatgacagtaatttcattgtttttatgtttgaatgagttttcaaaatatttaaagcacatgttgtattaataattgtgtaagataccatcacttgaagattacatagaggacatgaaaaacaaagggaaatactcctaccttcaaatttatatgttttgtgggtaggaaaagactctaatctctatgggctaatcaatagcgtgtttgtaatactgtaggtgttggttgtcattaaacataatacaaccaccaacattttagtaaaataaaagaagataacatgttaccttgccattctttctttaaatcaacagaattccatgagttttattggttcaacatgttttgcaaggttaggtcataaataagttcatttctgaacattttggagagtttccgattgagttataaagaagcgcaccataaccaccaacaacatgaggccaaatatatatttgagtccaccatattgaatctctcgttgagacagtcgaaacggatatatggttcgcccgatttagtgtcggaagcactccgaacccattagtatatttgaaggatgaatagctatacacaattcttccatcaaacatattaagacattcgacgctccgagagaaagatatgtgagacattgctaggcctttagcctgccagtcaacttcagcctgagatgtgcctgtcaaaccactcgaagacggcaaccagatgtgttacacattcagaagacttaacaaaaatggctaaagatctacaacatctcaaatatctttaactcatactcatgtttaatatgtccctaacaaaaggaacacactaaacactttcattcaagcacatgatatctcaacatagggaattctaagttctaagttttagttaagtttatacaacttataacttagataagtatggccgattggccgaatagttaggttcgcggaagcatcttctacccaaaagatctttcctgcaaccgactagggtagaccctagtaagaaccatcctggaagaaagaaacatccccatcgaaatagagtgatctcacctgcaaccaattctaaacatgcaacaatacaacaatacacgcaagagtcagtacataaattgtactggcaagcaccaagcaagcctaatactctacatgcatggcgtattcaaagtaaagcttacatgggataattttagcataaagcaaatttagtttgcaaagaacatttcaaattcagatttattttcaattaaatttcagcaagcatacacttagcaaatgggcatcaaaatagatgttaaacacatataacatagctccttattgccttccatggcagcaaggatataatccataaatcacatcacattttgaagttcaaattcagctttagaagaataaaacacatgtctatactcatgacatattcacacgccgctcatgacagcgagcacggctaatcgattagttttaactctgcagagtacgtacactttacccacatgatgcgaaataataatcatgcaaaaagcatggcacgcgatacataagcacccgatttattactcacaacaaagcccttccaagattcatgatttagccttacaccagcacttacaccagcacgatacgtgttactccatcctaagccatactcgatatatgacctagaaccgttaagtggcaggtccacgccttaaacttaacgccgtggtggcagacacaacgggaacacaccacgtggcacaatagcattgtattggacacacttagtcacctaaactaccacttcggggtaaataggaagctcctctgaattatacgaactcatacacaccggcctaccagaatgtaaggctaaaccataaataatttactaagcttgggctatcccatactagcacatgtggttgtactgtatacaaaatgaactgacattgagtgaagtccttaggtcggtctgggcacattctccccctatcgacacacaactaaacaccatatgtgtaccacatgaggcccaaacttaaaatccacattttccaacattttatttaacaaatatcacattttatcattttaattcagatcacaaaataaatcatttcatatatgtaattgagcccaaatggtaagtaaactcatcactaagcatggctaagcatttctatagacttgtgacttcaaacatcgttcttaatgtgacacaatcaattgttcctaaggtttgaaataatggttaaggtcttttgtggagtttaggtgataatgcaagtaaaggagttgatctaacaaattttacaagattttaatggattagtgtacaatagacatgcatattttgcaaacttttcaaaaaccaccaaatcataggttcaatgtgatcaaagaggggaggtggcttgccttgctcttccactccttgttcagctccaaagtagatctcctcgagactcggcggcgaatcgtctaaacatacatatgcaaaaattaaaattaaaacatacataaaaatccaacatgctctaaaatgaatgctttttatggagttggtgtgctctgtgttaatttgatttttaatgaaagaaacttcaatctaacaatttacattcaaagttacagatttttaaagggtttacatgttaaatatggtcctaagtgcatttcggatttttgagacataaatctttatgattctgttaagttaaacatttttatatgcagagcatgaaaatatgattccaacaaaatttagttttcaatttttatagttaggatgaattttctacaaatttctaaagtttctgtcatttttcagttaataagaaacaagttttgcattttctccaatcttctcaaatcatttactctctcaggtccaccagtcagcgactaagctttttcgcataagcccctgggttcttgggaaaataggtcccgcagcccctagcacgtggtttaggtttttatgcaaaacgacacttgcgttttattttatttacagattagtattggtcccacttgtaagtgactgctcgagttgttaatacatccctgggagtctttaaattttaaaagccatgcccttgctctggacagagcagagtagcagcacagccgcgagcttcacagcatcaccggcggcgaacggcggcgattcagctcaagctcccaaaacgaaaagtgtagagaacaaccatacaaacccattggtggctttattgcaagctttggtgctctatagcggctgttagggtgttagaggcagtggctaagctcggcttgcacatgcatgtgggttttgaggctcgatctaatcgtgcatgcgtatggtaaggactctagggactcaccaagaagcgaacgcggctcggcgaagtcttggcgatggtgtactggttcggcgacggcgcggctgctacggtgtacccccgggcttgtactgcatagaaagggtacgtgcttcggtttagatcagcacaaggtagctctaggcgaaaaagattgcgccgaagctgaccagagaaggagaaagaaaggaatggcgtcggcggccggaattggggaagaagaagaggatctcccatcgtggtccacctcgcgtcgattacttcgggattcttgatctgaaggtgttgatgaagctcgtggcgaagtggctcagcttgttacgaactgttgaagccgggcgacaggcaaaggtgaagctgcggcgtccagagcgctacggtgttccgagttgacgcggtcgcgttcctggagattgggtgcaccaaatgaggtgttcttggttgtgttaaagacggcattgagaggggattacagaacgcatattgaatggaaatggggctcattggattgcgacagcgtcgaggacttctctcgccggcgccggagatggcacctccgttcccgtcgaatccgaggcggggttcctcggttcttccgcgaaacgagacaagggcgagagagagaaggttggtcggccgatcggcttatatgcggtcgccggtggaggaggagaggaggagctcacacgcgtggcgcgcgggttctgagccgtgggcccgaatgtgaggctgacaatgggatcccacattgcagccctggcccacatggcagcgactagtgatagataaggagaggagattatataatattgatctgatactggtttctcccattgatttaagaataaaatatctatgtttgacaaggtgaagtactggccaacaccataaaaccaccactaatgacgaaaagctttggaaaattaagtgcatgacaggcaaacttagacgctaattaacctgtgaatttgccagtaaatattaaaaattttcgcacaaactacatcagttccattttatttttctattttgtctgcataagtataattcgtagttgacgttcaggtcggatatataagaatatttttgttttcttaatacgatatatttttatataatagaactgtaataatttattgctacggttattacatatgatttacaaaacatagtaaataatatgcaatattatttaaaaatagatttttattataagtagggagtctgatgaataatttggttatgctttactgattaagactctagtatcatgaaattcagaaaatgattttttttttacataatgaataaactagttgctgcatctgagataacaaaaccgcagtcaattattacaatgtatttctatatcactttagaagaagtccagtcaatctatagatattgcaacaaaatcaatttcctaattttatgattaaaaaggcaaactaataatttagtgcaggatagcagcagttgcaagttgtggcttccatgccttcaaatctcaatggaccagctggtgtatatcaaatcaaccaatccaacgggacatcacatgactttcacaagaaaaaccagaaaaaccagggcctgagcaccttgtttctctattcaattttttatccaaaagggaaaaatgaaacacacacacaaatccagtttcctgcacattattatcatatatgtttgagaggtatttttgtttaactacataaaagcccacacactttgcggtgagattttgagaagaaaatcaagctaaaatatattaattgtggataaatatttttaatatatttagagctgatatgtgaaaattcttaggaatgaattgaacaaaaaacaataacaacatgttctcttaaaaaataacgacatggttattctagtggttatgtatcttcttatccaacgactgctatctttgctctaatattgcaatgtaatggttagaaagtgttgctttatatgagttaatgtttcttagtggatactaattatatagaaagaaagtttcaacaacaaagatgttttttttaaaggaacaacaaatatatcattaccacggatgatcattttaggtaaaccttttgcatttttagcatttctaaaaccacaactgagtgactaaatcgacgaagaaaactttaaagtaactctgaaatcaaaattggcttatacttataactaaggcaaagacaagcaatgcttaactatttgatcaaatagttaagcattgcttgaaaggtacaagaaaaaaactaatatatttttgcaccatcgtgtagcatcattacccttcttgattatacattaatgcttaattaatgttttcggaatactccctccgtactcgtaaagtaagtcattttggacagcgacacggtctccaaaacataactttgacttcttatttctataaaaatatttattgaaaaagtgatatatgtatacttttatgaaaatatttttcgagacaaatctattcatataatttttacattttcaaactcaacaactcgagagttattcatgatttatattctcaagatttgacttaaacattgtcctaagcgacttcctttacgagtacggagggaatatatat

SEQ ID NO: 66588 - DNA, 40027 bp, Oryza sativa
cgcgtgcccgagccgcgccactcaatccgccgcgcctcccgttgcaagccgcgcgcgcgtgccgtggtggccgaccgcctggtcgccgctgtcgttagcgcctgcccacgcctgtcgcccgtgtcaccgcttcgctccaaaccgccccgccgtcatcgccgtcgtcatcgcctcggccccgccactccgagcgcaagccgccaagggacggaggcagagcccctcctccctctgccgcgtcgcccccgctcccctcctccttttcccaaagaagcaaggggcgagcccccatttctctccctccttttccccttttcctcccgccggcgtcatcctccctccgccctgtcgccgatttggacgcgagcgccgagcgccagctcgcgccttgaccgcccaaagtcggtttccaaaccgacattgccgcccttaaagccccgggcgccctccctctcttctcctttcatcgcctccactccattgttgccgccgccttccgagctctgtctcgcctccgccgttcatcgccaagcgccgggagagccggtgcgttcgtggacgcggaaggggactccgggcgctcgtctcctccctcttccccggcccgaggccggagagattactcccgcgccgtcggcctctcgtctcttccccggcccgaggccggagagattacttccgcgccgtcagcctctcgtcacagcgcccctcctcatctcggtagtgcctccctccgttcttcctccccgctccatctcccccccttagttttcggtagtagctcgagtagcctccccgtagctagccggcgccgccccgaccgttgctgccgctcgcagtgtgctcgccgccgtcgccgcccgtgctccgtagcacccgctcgtcgccggcctcgctcggcgtagctccgctcaatccgacgctagcaacggattcccgtagccgcgtagatgctctcaccgccgggaatcggcccctcgagacctcgtcgccgtttcccccttctcccgccgccggttgccgccgccgcaattcgccgccgtcgggcatcctccggtgaatccgagccgttggctcgtctcccctcgtcctgtgcaaccacccggtgtgctcgctttcacctgtatcgccgtggatcgctccgccgctcgccgctgtcgtccgccgtccgttccggccggcatcgtcgtctaccttccgccagaccgcgtggcagccacgtaggcgccacggaggcgccacgtcggcgccagctcggccgagatcgggtcgggccgacccctgtcagcccctcccgtgcgcgcgttccaccgcgagccgtgaggctgcacgtgggcccgccgcatccgttccaccgcgaaccgcgcgcgtgcaccgcgtccctcccccgcccgcgcgcgtgcgccgcgtgctcgctccgcacggtgaaccgtgtcaccgacaagcgggtcccacccgggaccacgcgtggtgagcccggtccaccgactctctctctctcctcccctcccgcgcgcgcgccttgggccgccttgggccggccggcccatttagctcggccggaccgccccatttctctcgggccgcgccctagccgccgaggaaaagtctatattccctccctcttttcttttcttttcttttcttttccaaaaaggatttaattaaatccttttcctttagaccaaaaatccaataatcttagaaatttaatatcttcccaaccgtaaatccgtttgactccgttcaacttccaaaattcctcaaatctcgagatctatctaatggcacgcttagaggtcattaataaggctttatttttgccgtttgttgagttgtcccgtttcgcgtgtagtttcagagcccgaagacccgcagtgcgaggatttcgaggatcaagctccagatctcgagcaaggcaagccacctttgaacatcttgagcctatacttgaaatttaattatgttgcttgaaaaatattatgcattgataggatcgcacttaatctgttgtcccgtctacaaggcagattggcggacctacctaatttgttgcatttgatccttcctttgataattgttatatcgtgtccccttgtaaccatctagttgcgtctcgatattcgtgcaccctgtgcgagtatcgacggacgccttcaaacttaaaatctgaaaaacttcttgggtaaaacttgggttatacaaaagacttggaaaacccgacacctgggtcggtgcttgcgaactaaatggatttccaaaaccgcggaccgggaaacgtactgggtgtacggttttcccgctcttgcacctaaggaccgtttccttggaatttcatctgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgttggcatatggtaaacctgtgtcggctttggaaatgccttgtcatgaaagcttggaggtctcccgacgtggctgatccccacgagctgggtgatccgggttagtaatgtcgtgtgggtaaagtgtaccccctctgcagaggttaacaaactgttcgaacagccgtgcccacggtcatgggtggatgtgaggtgattcctagcgtagttttgtttgactactgcttgtgaaattgctgttgtggaaaggggttcgatgattgaaaaatctgcagctgatgggatcagctaggcccaggtggccgtttgaaagttgttggcccgggtggccgtttgaaaagctgttggccgggtgccaaccttgaatcatttcaaaagactgatacattgcacaaactccgaccggacgagacacactgtctcatccgtgtcgtttgagaagcactcacttagttgtttttagagaagagtttaaataaaatcaattgcaaaaacaacagtctttccttgaagcctgcattaaacacttatttcccatggcttgctgagtactcccgtactcacccttgctctatataaataatttcccccccagttgctgaagaagatgaagcggatcccgccgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgataatctgtcttcctgtgataccagcactgtttcctgggactggtatcgattaacagggtaatttggagcgtcacgggctagttccggtcggtactagtccggggcgtgacattaacttaagctcatctgatcttttatataagtatttttattataaacataaaaacacaagtgctcatgacacgagcaattatccctatgaacacgcacacctataagcacctttgaaaagctggaccggtatatcgaagtcaccacatttgccttagttagccaggcgccgggtactcgtctaccacttaaagaataattaaccgagcatcgggtaggtcgtctactaccaggtagtttggttccaccacaacgaacctaactagttgagccatgctcactttgctttacataaagaatttatttggtcccaaaacaattttatcttttctctatccatttgtcttaaagaaactttatttttaaataatcaatgcattaagatttgataaatttaggacaaatacgttgagaactgataaatttagagacaaaattcattagatctgttaaagttagaaacaatattaggatttaatacaagtaaagtgtagggagaaaactacgcatcggatgatcgatacctaaaaaaatcaggtggccaaatgtttcagttgagcaaaaagtgaaacatcaagttatacatggtgaaaaaaaaaacagaaacatttaaatattttatgaaataaggtacacatgttgaaacatatctctatcacatatgaaacaactaatgttaacggcttgaaacatatatttttcttttatcagaatataatcatatgatatctggttgtaaagatttagattagtagtttatgaaaaaaaagttattttaaaaattaatacatgtatgtatataaggatggagtgaaaagagcagttggatggaccggtccatcggtcaaccgatcgggagttttctcccaagtgtattatagtatcttttgaattttatattggtatatgttttatacttttattgggtagaaatgaaattatgtttggagggagctaatgttcacgttttaaattgaagggagctaatgtaccatatattgggggtaccttttaaattgctggtactcaatcgatcctaatgttcacgtttcatatggatcatcatctatcattcttttaattcacctgccggccggctatttaaattttactttttgtcatttaccacggacgacgaattaataatgaattaaagagaggcgtacttacattgggtatcactcactatatagtagatcccaaagccacgagctcgatcgatcggtctcgtcgcaattaagctagtaacttaattacatcatcgaccgatcgttacctaaccgatcgatcgagcagacgtacgaatttttccgttccactctccaggaaaccatgcctcccatggatcgccatcgtctcgccgacggcgacgattcgtcgatcccgttttgccattaaagggattattgattaattgtctgctgatcaaccactagatagctagatcgacagaaaccttgatcatagagtatacatagtgaaaaaagttcgagcaattcttaaacatatatagaagttagggtctgctagattttaagcaatgcacgattttagttcaatttatatttaattgtgttattatataagattttattttattttattatctattttatgtacttttgcatatttgcgtatgttaggataatttattatattcaacccttttatctaaagatgtgactttgtttataaataaataaaatgggataaaataaatgactgaacttaaaattttctttttttagataatggaaataataaaaaaaatctaaacactcttaattagttgtactttctttaagcaaacggtgaaaatgagctggagataagtctggcaccactaactctccattgttttataagaaaacaaaagtgtgggttaaacgatctacgtgtcaaccgaaaggtacgactaagtaatacgatgtataaaaagtaatgaaaaataaattaatgataatgctaagtttaaaaaatgtgttgcaactcgcggtccacgggcaatatatgctattactccctcggtaccagaatatagcaactaatgggatgagacacatcctaggacaatctaaaaaaatatattacctctcattgagagggcctgaacctgtctaaatcctttgtctccacatccatccacttttaggtctcgtgcgctacccccttttattattgccgaattcatgtttcgacagttggcgcgccaggtaggggttgcgtcgagtttcctatcaacgagcgcgatggaattaacttcatgagtcgccgacttcgttttcgcttcgggagttttcacttcctttccgtcgaccacttcttcaagctcctcttctctgacttgatccaaatcagtcagggggaaactcaatcgagggattacaacaatctaccgcggcaagtttcagattcaatctcctatggctgccgtcagcaccgccttcatcttcggaccggttcttttcttctggagttcggcttgcatcgccgccgccggaaattccgacgggacgtcagtcgtcaacttgatcgtttgacatgccgagtccatcatctgatgatgtcaaatctcctggcgatattcaattactaatctaaattggagtcgacgtggaatctgagccaatcaataggagcaattttcacgcagggaagtgcagcactcatgcatgtattgcatgtttgtcacaagctgccgatatgatctcctgtccacccattaacacatatatacggaggacactgagaaaaaagctaagtgcctttatttttcctctttatgtgatattttccattgagcaatttttttatatctactcatgctaactactcgtccagcgccggacgcctagttttatcattatttatcatattgatttttaatctcagattaatctcttgttattttttgttgttgttcgcatataattacgcggcactattgaggcgattaatgctggtcatggagtcgaggcgtctcagctttccggtcgatcggccgcgagtccactttgccggcttgtcttcgccaccgccattgctgataacaacaacgacttcaccgccggcctgcttccgtcgccgccgagtggtgcctccgcctacacggctggcctattatgccgccgctgttaggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgctgctgttgggcgtcaacgacttcaccgccggcctgcctccgttgccgccgagtggtgcctccgcctacacggctggcctattatgccgccgctgttaggcgtctacgacttcaccgccggcctgcctccgtcgccgccgagtggtgcctccgcctacacggctggcctattatgccgctgctgttgggcgtcaacggcttcaccgccggcctgcctctgttgccgccgagtggtgcctccgcctacacggctggcctattatgccgccgctgttgggcgtctacgacttcaccgccggcctgcctccgtcgccgccgactggtgcctccgcctacacggctagcctattatgccgccgatgttgggcgtctacgacttcaccgccggcctgcctccatcgccgccgactggtgtcctcgcctatacggttggttggtcacaccaccgttcatgggcgtccacgtcttcgccgaccggctggccttcgccgccgccgactggtgtttttgcctatacggttggcggacttcgccgctgttaatgggcttcatcatctacaccactggcttggttccactggcgccgactggtgtttttgtcaccattgatggactgcttcgttcccacatcggctacttttgctgtcatcgagggaatacgacaaagctaagtcatcatttattttattctttatatgatattttgctttttcctttgcctcgctacctcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccggggactcgttggatggaccgagtaacgcaaggtgctgagtattactcggaagaaatcaaaagcatagagataatataatttattttctgctcttaataattgcaaaagtacctgagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccaccgccgactggtgtttccgcctgcacggctggcctattatgccgccgttgttgggcgtctacgtcttcatcgaccggcttgccttcgccgccgccgactggtgtttctgcctgcacggctggcctattatgccgccgttgttgggcgtctacatcttcaccgaccggccgcctcgaccgccgccgactggtgtttccgcctgcacggctggcctattatgccgccgttgttgggcgtctactagtatgagtcttatcccattatagattgctatattctgggacggagagagagagagagtagcttttaacaaagatatgacacatgcctgtacatgtacggttcttgttgcctggctgccacaatataattcagatctgaactgggttggcaactgctgcctttgcctccattctataaaaatgtatggctagatttatagtattaaaatgtgttatatcagtactaggttgattttttatgggacggaggaagtatatcatactaaattacatggagtcatggatatatatttttgtacacctaccacgtttcaaatgcataacttaatttggaccattgaacgactaggctaacacacattttgttgttggagtgtgacgtggagtatcgtggagcacagatatatatgagcagcttaattagctagctagatcgtcatctttcgctctcattaattcccattaccgttagcctggatatgcaacagttttgcatttaaggcgccaaagctccatataggcatcaaaattttgcgaacctttaatcactgtcactgtatgaatgaatctttaattaggctgatatatatatgcggcatgtgtctaaattaattatgatcgatcagtagccatgaattaaatggttgatgcatttgcttgtaccttctgttggcccgttggagcgcgagtatcatgtagtgccacaatatgctgacataacaaatattgcattatttattattattattattattattattattattattattattattattattattattattattattattattattattattattattattattattatttcataggttagtttgattggatgcgcgtgcgcgtgcgtgcgtggagaacgagttacagtggagtacttatataatcgtgtatactgttctcacaacacgatacatcagtctgaattacgaaagctctcgagcataagtaagcttaataatgttgtgcacatgtaactaagatcatggactcgtggatgtgtgtggttgcccaaatttattttagttattaaaagaaaaggaaaaataaccgtgttcgtctatttatatttatgaacgaagggagtttgttacaatgatttattcgtgaactgtttctattcttcaattaatcgagagaaagggacacaaagtaacactcctttttgcccacgaaccgaaaaaaacactgctaattagtcatccatggatccatcttctcccttccgacaagggcaatagagacgacgacggttgctccactgctctccggccgccgtgtcgtggtggtcgcctcgtcggcacggtggtcaacttggcccatctatgtaagtcggttgatcgtcggcacggcgccattaattaattactccggccgaaagtgaccatatatacgtactgtacaactctccggcatgcagatttgttgatccgctataagttaatatcactcgcgttgttcttttcatctacttcatcgaatttgaagtaattatgtagaaattattggagaaatgttgtgattgattgacaagataaaaatagatgaataatttaaatggagaatgcttgtaaagaaatagtattattttgggtgaacagctaaagtgatcctccaagttttattctaggctcagtttagtccttaatgtttcaatttgtccatattagttcttcaagtttttattttagtttaaacttatccttaaacccacttagaagccacatgactaaacataacgaacaactcttaataaataacgcttatactccttcattcactagaaaaaattgcatgcaatgattttttttatagataatgcatagtacttatgtaaaacaaaaataaattatgtactttcaattgtatagatagccattaggcttaagtttcatgtgcacatattaaaataatagaaattacatctgcaatattgtttattcatcttgtttttctcttttatagtgtagtatacaaattaaaggcgaaagggacattttctaataaaaatgttgactaaaaatagccatatggcacatcaagtgggtaaaaggatgattttaatccaaaacaaatacttagaggacctatatggacaaaacgaaacctaaaggatcaaattgagccttcggtgaaacccgagggactgaattagctattcaccctattattttaagacaaaatactatactagacatatagctatattttaaaatgaaggtggtagagatcaatataaactgttgatttgattctatgtaaggggcaacatttatttatactatcgtctcaattaattaattgaaggtataaatattagagggtatatataatcttcaataatacaaatatatagaattgggtacttcaaaatttgggaccaaaatagccaatcgatacttcccaaattgtagcgataaaataagatatcaacgggtactttctaaacagtccaaataaatcgatatacttcacaaaaataaatgggatgagtagtaagaaaaataattatcgttcaaactatttcttctactattaatagtagaatattatatagagaaccataacaaataaagctcatggaaagtgtccacgtcgcaatgacggtgggaacatgtgggcggagtgtccatgctattttaatcccagcagaacgggagatgtaaccgacatacgggcggctcccctgtgatgaaaaccaacgtgatcatgatgcgtgcattatgtcagcttacacgtaatgtatgtacccctctgtctaaaaaaatattaatcctacctacgaatttagaaacatatatgttcgagttcgtggctaggaattcattttttaaggatggaatagtacgtttgaaatttggctggatacatttctatataaaattagaatcacccgtagtattctaccgctagtagaatactactatataaaccattaatttatgggcatgttcggctgcccgggctgcagctgcgccgcagccggcacgaacagtgccgcactcactgtgcgcagccgcagccacggctgcagctatcggcctgccgaacaggccctataagggcacgtaatatattctattaatatatagttagagataattgcaacattatttttttcttttcgagcctcgctacggtgctttctactagtagccgaaaacaatctgaagtgttaattttattttatcgaaggattccgatctatttatactaccaccccagttagcggtagtagaaatatggagatacattattgtcaaaaaaaataagtgtggagggatatatatacttgttatttagcaatgactaaactttttttcctcttttttggctttttgatgaaaaatgagtgatgccggcgtaatagatgatatgattacagatggatttagttgaaaaaaataaaagataaagtaacttctaatcattatattaataaattactctctttgttcctgatatttgacgtcgttgactttttttaaatatgtttaaccgttcgtcttattaaaaaattaagtaattattaattctttttctatcatttgattcattgttaaatatatacttttatgtatacatatagttttacatattttacaaaagttgttgataatatgaatggttaaacatattttaaaaaaatcaacaatgtcaaatatttagggacggatggagtactattttagctctcataatatactaccaataaagttcttttctttatagtgaccagtcactggtcctttcgttcccgcgtgcgctcaactccagcggcagtgccctctctcctccgtcgaacagacaaaatcaggcaagctattactatactgaacaaatcaatatatatagtcaacatcgagcagcaagaacacaagtaattaatgttagacactccccatgattatctttaaaacacatatatttgattagtttctccacatgctgtgttctgttcttaattaagtcgttaacagtgctgaatttctccaaaggatcgtacccaagtatttcagttcagaatagtcatttgcgcagttcagagtgcccattagaatggtgctcaaaacactgtaatgttgattggcgcttaaatccttgaattgacaaggtttcttgccctagtctcaaggtgcaccagccctggccagcgcatgacctaagtcacaaaagttaatggatggatggattgagaaactggaatgcaggacattattttctaaaaaaataaaacgacgaggtatacctcctcctaaaatatggaacgttagttggaacgtgttcctaagttatttggaatgcccctctatctcttcatggtcatcgcacagcgcgacaagagcaatgcttgtccagtctccactgcatgatggtgctgacgcccgtacatacacaacatgatattggcgagcagtgagggagcaacaacagcgcttgtcccatccagatgagttcaaatttagtgaaagttaatcaaattatagattttgcttgatttggattgtctttccatcattcgctccatcgtgttgtatttctttatcagaccgctctattgttactccatcataccttgtactaggatgacaagttccatccattttcgggacaaaaattccacatagttcccgcttctcaatccggaacgaggaacacacttaagttccacgttctatgtgacatagcgcatgacctccttatgtggtttccaacttatatttcaaaagtacaaatttacccctccacacatctgtattaatgtggactattataccctcttatgtttttattgttgttaattgaggtggtggtataataagatttgatcccttttgtagaactagcatagtggctcgcgcagattgcgcggctagtatcattatattttctctcatataatagtatatatgttttctcattatattattcaaatatattaaaatgataacataattttaaattttgcaataactttacaaaactactaatgtgtaatattcatattatattttatatacatgttagttattaattacttttaatatcaaattttagttatttgtaaattatatatattcctatatggactctagactcgtcttttaatatttctttttttttaattctgaattttctgtaaattgtatttctatatagactctatgctcttcttccaatattatttatttttatttttgaatttttattttttctaattgtattcttatgtggactctaaactcatctttcaacattctttaatttttaatttcgaatttcagttacttctaaattgtattcctatattgactttaaactattcttccaatatttttcttaatttagaattttagttatttgtaaattatatgtttatacggactctaaaatctacttttaattttattatgtttattccaaattttagttagttttaaatttcaatatggactctatactcaacttctaatatatatttttaattccgaatttatatgtttttcttaattgtatttctatatggactctatactctacttctaatattccttgtttttaattccgaatttcagttatttcctaattgtatttctatatggactctagtctcctcttctaatattccttattttttaattccgaatttcaactatttctaaattgtatttctatatggactctagtctccttttctaatattccttatttttttaattccaaatttcagctatttctaaattgtatttctacatggactctgctttttttttctccgattaatgtgagaatttataagccatgagagcgaacgtggaggctcatttttctattcctttaataatataatagatatgatcaacggattagattaatttgtaataccagtatagtgcattgtagtgtggcttaaagaaaatctaaaatgacctgtgtataatggaacctatataacatgttcacttctttttttttcttttttttttgaggagaacgacggcaggagatctgccggaattttattagagggagaaaataaagtgcttacagtccagagaaaatatgagagacttgcaccgaaacaaattaagattttcacggaatttcattagatgctctctgtttgttttttccttttcttctggcaatgaagtatcacggatgatgatgacttgttgctcacaacaatcctattatagtcacgaacaattcgccctgattccaagaaagttcgtcaactcgaaatatggctagaaaagcaacaagcagaactaggagctttgggtattcagaagctgacaaacacaccgcccacacacaggattcggcttcagaatagcccctgctttagtgttcaggccaaggactaggcaggattagttttctcaatgaacaaccaagcaaagctgattaacaataatgtgttcaggaaacctagctgtaatgaatgtgcaaggggaataagaatccatcctaagttgttcttagcctctgatgaggaatttgctatattacagtcaaactgaatggcctacattacagtattacactgaaccaaccctctgctgcttctgtcctaagctggctacgcaaagaaactaaacccgtcatcatcttgtccaccttctcatcatctcctaaaccggaggagcacataatctattaatcttgtccagaatcctcatgagcttcttcttcttcttctcatcatctctggacacaaaagttttgtctctaccaaatccacaaaaaccaacaccttcagctgccgaagaagttgcattttgttctgatgatgatgatcatcatcagctccggttgtgtatcgggtcggagcctcgccggactcgccacttgctcgtctgcgccgcggccgtcgtcgccgcgaaccgctccttcgccgcgtcgacgccgacgacattgttggccggaggcgccggcgccggcgccatagccggagccggagccaggacgagctcggctctcgtcaggccgtgcaccgccgtggcgtggtgcagcgccacaaccacgacgacgacggtgcagaccaagaaaaggtcgagacggcttgtgtgctgcaccatgttggcttctgctgctgctgctcagatggagacaaacaagtctctaccttggctctctctgtagctagaatggtttgtacaatgatcaatcatggtgatgtcttgtctctagatatagcaggggcaggcagtgtcgagtccaaaagcacaaagggacaagtgaagccaagcacagcatattagcatagcatgcctaaggctgtcaatggaaggttctgaaaacctgaaagtttgagggaggcagattttggcaaagtcatgaattggggggggtacttatctcccaacagacaaaacctaaagttgcaattgtagatttgtaggggataggaggagcaacagtatgctagaaacaaagacttgctttagctccttgttgttgttatcttccccttcttggccactgtctgcagtaaaacccccaacactaaagcagcaggcacagtggtgagtgaaacaagtgaggcttttttgcttttctatctttttttttgttgttgtttgttgttcttggttgaaacacacttttctctttgaatcttcttccaagctaaggccaccaaagatgggggagcattcaaaacttaaaaggaagtgcaccaagtttcaatagcctctttcctcacaattttctatgtgtgctacttgccatgcatcccaatgctttagttgctctcctagctttggtgcaggaatggaaagaatggtgaatcttaaagcattttcaggatccaacgacggttgtagcttcttggagctgtgtatgtgttggactggtcatggtctaaggaggccgttttattggtaccaaagcgaaaaaagaaagagagaaaacagtagctactgaatccttttaaagtggaggcaggccaccttagcttcaaatttgtaataaacacagcacttagatgcataaattttaaaccagaagaaaatcattataaagagatggaagattatgtaaagattgcttcttgctaagtgggttagggagcccacaaaatcttcctagcaagctgcaaaagaaaaaaggaggggaaattaaaggtaacagaatgaattatcaatggtttgcccttttgtttgaagagattcttaaagtgctaactcaaatacttggtaaagtcactatttgaaatatatgtatacttgctaaagtgcccagaaattgataatgggaggcttttgtccgggacagcaatctacaaaataggattccattagaaaaggagtaatcatattgtgctggttcatgacactaaattaggtctataggaatactctatcagaaagggcacagcaaataaattaacaaacaaatatttacttctaagttaagcaatgcagcatacaaggaattgatacaatgctggaaaagatcatgatcttagcagagacaagatattgatcttatcagagtaatgatgacaccgtgattaaagcagcagcacagttcaattcaaaaaaaaaatagcactgttatttttcctgctttcgtagttacatggaaagtttatgatgtgtctttaagtttatgatgttcataaagacactcaagtacagaacaaacaagcttttaccaaagattgcagagaatctaatactagtagttttacccacccactctttgagtatgaactgtaatgacctcccactttttgctatcggaggtaatcaaatatgaaacagtgaagttaagaaggtgcatttgtcatgtactcctgccagataaagttagaaccgaaagaacagttaactgttcacaaatgacacgcattgaactatagtacagtaattaactagccacaggacgaatctctatgtaatccacgatgcgtggcctggccaccttgtaggcttgtacctcctccccttgtgattgtgaggatcgaagcggccacaggagcacacgtccgtcgatgtacgatgcggtcacgcagactgtggaatcacggcgccggcatggctcctgttatggctcctgttgagccgagtttagcgcctgttcagtttgatgctattttcaatcttaccaaattttagtaaaattactaaaaaaaataactacatttagtttgctaccaaattttggtaactatataagaaatcctgccaaaactttggcaaatggcaactataccaaaattttgaaatgtgtaaggtttttttagcatcaaagtgaacaggcccttagtttcaaactatttcttcaaacatccaatttttccatcacatcaaaactttcctacacacacaaatttccaatttttccatcacatcgttccaattttaaccaaacttctaattttggcgtaaactaaggccgagtttagttctaaactttttcttcaaacttccaacttttccatcacatcaaaactttcctacacatataaacttccaacttttccgtcacatcgtttcaaaccaaacttctaattttggcgtgaactaaacacaccctaaacacacccttaggtgtcgtaaaacacgtgaatgttatggaaggatctaatatcaaataaatagaaggggtgaggtttcgaacccaggttgtctagcccaccaccttgtggagctagctggaatacctaggtgtttctccactttaggtgtcgtaatttgtcaccgagttcaaaattaattcctaaaccgtcgtatccaagggtggagctagaacgaaatggggagggggtggcactgcttgctttactctgctttaggtcgagtttaagctgatatgagtgtttgagtttgggttgaagagggcgcatatacggtgaaaatagatgaaatataactaaaaaatttcttgaccgggtttctgggcaccccctcttttcaatgtagctccgcccctggtcgcatccctcaacttccaaaactagaacacctcaaagcgttttcggctaacgtggcgtctaagtggtgtcgacaaagttagaaaaaacataggatgtcccgtcattttccctcttctttccacatcatcggcctcggcaagaactcctgcatcagcagcggacaagggtagtcctatcaacacatcctcctttcggcgaccacacgaacatcagcttcacgagcggcatatccggctgcagcgccgccgaccgggagatcacctgcaccacctctgtcatgctcggccagtccgacgggttaggattgctgcacaccagcccaagcaaacagtaacctagtggcatcatttgcatcaaattcttcggtactagtatagaagaagaagaaacgccattgtcgacggcgttaagcaacctccaccccagtcgacgagcaaatatcaattcagagcaacatatccgaagcatagctaaccaattcagagcatcatatattacatctaactgttcattgatttgatggttaactgtgcttcggatatactctctccgtctcataatataagggattttaagtttttcttgcactgtttgaccattcgtcttactaaaaaaagtgaaattgttatttatttttttgacttactttattatccaaagtattttaagcacaacttttcattttttatatttgcacaaattttttgaataagacgagtggtcaaacagtacgagtaaaaactcaaaatcccttatattatgggacggagggagtattgctctgatatatcaattcaatcgacggcagcttaaacatctcctggaacatgcagagagctcgttcgtcggtgacgatctcgagcaccagaactccaaagtactccggcacgatgaagcccaagcgggtttcatggttttctgtgactttgttaacgctacgtatacatcacatcagttaaaatcgtcatctaaacagattaggatcttatttgcactggttttgagagttgagggacacgtcatatctggtattgttgttcagggatgaattccagactcgacgacaaattgagggacctaaagtaaacttactacggaggaagaagaagcacttactgggccatggcccacaacatccggtccatctattttcatcgccactatacctccggcccacggacgcgacgcgcttacacacatggcccacatgccatggtgcgcaagcgcaaccctttcttcctcctctgtcgctctctctctctctctctctctctcctcttctccactttctccctcctcgctagtgcgctctccttggcgagctcgctccgacgaacgccaagcccattgctccgcgtgtggttgggagagtgagaagagaggagatattttcggtgcggtggggaggggggattgagagaggccgaatcaaccaaccaacacctgcctgattcatcttctcgatcgatcctggggggtctgagctaatgcgcgccgccccgatctcccgatccggtccgcgcgcgctcgatccccgcgcctgatttctcctccccgcccgtcgccgaggagagctccgtccaggtagcgcgcacgcatacgcaaaattttggcgtatttaatccatgatctgtgtttgcatcgaatggataggacgtgctcttttgacttcagtcggtgctggtaggatgaaacgatgcaaagatactgtgttgttgaagacataatccgatttaaaacatttcttgttaacttggaacaagttatcttaattttcggtagtgatagtttctgctgtacatttttttccttaccaaatctaattcaattgcagaatgtagtaatgtattgatgcctttggctggcaacatagagaggttcatggactcgtttctagttctgctagtttcggtacttacatattttctgcacatatctgcatgttttttttttggttgaacataattcagttgtataatggactgatggcttgattagtaagtttcattggaaatataaggagcggaaatcaagaattcattccattccttgcttaatgtatgccattgatgatgaacttcagagttattttttagagtaaattgcacagaaccccatgttttatggtcaacgttgcttaagagtaggtacaatagcaggctataagccagctataaacatattttaaagagataaaggaagagagagaacagcagcgggctacagatttgtagccagctgcagcacggactccaaaacgtaatgtgtgtatgacaggtaggaccagatattaatagtatagtaagcaactattgtatgaattggctattacattggctatagatgatttggagctaatagttggctatactattaaacttgctctaatctatacatgtggttttctgcaactttgaccatagattgaggggtgttctaaaatttactcttatttgtaacttgtcggtttgtccatacttgtgctatacacatttactgaatctaattgtatttatcttacagtgaggtatggcgcggagttcaactgagagcaggaccaggaccactgtatctgtagttgttttatttggcctttgttccttcttctatctcttgggtgtgtggcagagaagtggtttcggaagaggagacagcatagcagctgtggtgaacgaacagactaaatgcgtggttcttccaaacctgaattttgaaacccatcatagtgcttcagaccttcctaatgatactgggagtactgaggttaaaactttcgagccatgtgatgcacagtacacagattacactccctgtgaggagcaaaagcgtgcaatgaccttccctagggataatatgatatatcgggagaggcattgcccacctgaaaaggataagctctattgtctggttccagcaccaaagggttatgctgctccttttcattggccaaagagccgtgattatgttcattatgcaaatatccctcacaagagcctcacggttgagaaggctatccagaattgggttcactacgagggtaaagtgttcaggtttcctggtggtggaacacagtttcctcagggtgcagacaagtatatagaccatcttgcttctgttatcccaatagccaatgggaaagtgagaacagcactcgacactggttgtggggtacgtaaaggattcaactctaaagatgcaaacttagatgagcaatcaagcattagtttttgttgttcttatcatgttacggagtttaatcttttaatgctttttcctgccacaattttgttcaggttgctagtctaggtgcttacctgttgaagaaaaatgttttgaccatgtcatttgcaccaagggataatcatgaggctcaagtacagtttgcactggagagaggtgttcccgcatatataggtgttctcggatcaatgaaactgtcattcccatcacgtgtctttgacatggcccactgctcaaggtgtttaattccatggagtggaaatggtaaaatcacttttagaatccttactgtttaaaatgttctcatttaaagtttacacatctgaagcaagctggttgctctggttctgcagatggaatgtacatgatggaagttgatagggtactaaggcctggagggtattgggtactctcaggcccaccaattggctggaagattcactataagggatggcaacgaacaaaggatgatcttcaaagtgagcagagaagaatagaacaatttgcagaacttctttgttggaataagatttctgagaaggatggtattgctatatggagaaagagaataaacgacaaatcctgccccatgaaacaagaaaatccaaaagttgacaagtgtgagttggcatatgacaatgatgtatggtgagtgacattctttctgacatcctccacaaaaaaatatgccgttttaatctatatgatcttttttttttgccttcatttttctagcacttacattcttctgaattcaatttccttcactaaatacaggtataagaaaatggaggtctgtgtaactccccttcccgaggttaaaaccatgacagaggttgctggtggtcaattagagccatttccccagagactcaatgcagtacctcccaggattacccatggttttgtacctgggttctcagtccagtcatatcaagatgacaataaactttggcagaaacatattaacgcttacaaaaagatcaataacttgcttgatactggaagataccgtaacataatggacatgaatgctggccttggtagttttgctgctgcattggagtccacgaagctgtgggtcatgaatgttgttccaaccattgcagatacttctacattaggtgtaatctacgagcggggattaataggaatgtatcatgattggtatgtaatgcttctctgtattgctctcctggactcatgttttggtcattgcactctatttttctcacttattcagttattcttcgtgccattgtttctgcatactattttttgctttttagaggagacacattttactttaccaacatggaaaacctattttttttaatggttttcatttgcttcagaaacatgtcaaaaacggatcaatttatttacttctgtagagactgaaggataggattgaactttagctctgccaatatcagttcaagctcttcatggtgaagttgcataataataaaatcagtctgttagttattctgctattgtaaatatgtgtttgttttgactgtgctgactgttagctttgatcagttgaaatctgaaaagcattggttgcttcttgttacataggtatatgtgttgaccatagtttttttattctttgtacaggtgtgaaggattttctacatatccaaggacatatgatctcatacatgctaacgctgtgttcagcttatatgagaataagtaagaatgtcatacattgcaaaaacaagaatgtgctcctaagttggtacatcttcctaattgatattttctatttacaaaaaacaggtgtaaatttgaagatatactattggaaatggaccggatcttacgaccagagggcgcagttataatccgtgacaaggttgatgttcttgtaaaggtggagaaaatagctaacgccatgaggtggcagacaagattgactgatcatgagggtggccctcatgtgcctgagaagatactctttgcggttaaacaatactgggttgttgaaagcaagagcagctaattacatatgctgggttgtttttttccactgagctcccaacaagacctaagacatgacttaattacatatgaagggtatgcatcatctacctcctctgtaaacttatagccactgtagtcaggaatgaactcttggcagcttgagttttccgaaaagttagcacccttgcaatgtggccttgccagttcttttcaaggtaaattgcactgcaggtataaatctttttcaaaaccggctgcctcagtcttgacaatctcaaccacaggtttcatcttttgatgtaaatggcttggatttgaaagttcatgtatgcaaggcttgtcatgaccgtatttcttttagccagttttgtctagccttagctggtgcgacaatttgagaatgctcaaactggcctctaatcttgcttgtttggtgcatttgtgctctaaggaggtgtcgcactgtaatgaaactgagatccataagattctagtattctgatcgtctgaaccgaggtgaccaataatcaaatttagctacgtatgtaatagttttttttctgttggtaacagacgaacgatttatttttagtgctatttgaggctgtccttttgagattcagttatacaaatgttgttcgattttgatggagctgcaacttgcagttcgtctgttgcaggcatttctctactgaaaatctgaaatgggtattggtctgtcggagtgttttgttttaccgggaaaaacaatttttctattgccagtcacctgtttttttggagggttttgcttatgtgtccgtattaatagtaattaccaaaattcaaaatgattttattctaaatggttttaacttgggctaaccaaacggatggttagatgtattcactctcgtgcatgcaatgtacaaaacttgcgtgcaggaattatgtactatgccggatggttagatggttaacttgggctaaccaaacggatggttagatgtactatgccggtttagaagcctcatattattttttttttcatactttgatggaaattcgggttccatgacgcctcacacttttaaccctaaaaatagaagtgacggactgtagattatcagttaacaaatagttattttattattaaataatagtcccagcaacatattgcaaccaagaaatagaagcacctttactttgtaataactggaagtccctaagacaatctttagcctttacaccatcttgcgcatgcaatgtacaaaacttgcgtgcaggaattatgtagcaaggtttactcaacaagtcaatatatactgccagagaaaactaataatggatgcatgaataataatttaacaatttatattttacacttccatcattcataactcatcatcgagtctaaatgtatttttgtaaaagaggttttcctaaaaagatttgaataacaagagaaatgcgtgaatcataatttgttataacattgtgaaagctcgtgggccacatcttttgtcttacaacgtatcccctccatcccaaaaaacataattaaaccttaggtttgaatctggacacacacatgtgatgtgtttagattcaaactcatagtttaatttttttctgggacatagtagtatatgctcataccaaaatttaaatcttaaaacttaattttagaattaattttaaggtttttattatggcttctttttttaatatcggagtttaaatcattaaaaacacatatgtaaaagttttaaccatatattatttttttacgctaatatgtcttttggcgtattatcagcaattggccaactgatggcagcttgtatcgcattacaaatcatgtatttgtaaatacttgctttctcttttttatataatggaatgtacttccggcctttactcaatgagctatagccaattattacgtcaaatcgctcaaaagcgctcacaatctaataagaccacaaaacacaccaatttaacataaagcaacacaaattaataagcaccaacacaagatgaaagacccataattattgaatcatatttgtaaatacttactttctcttatttttcgcccatcgaatgcatcatcgcaaaaaatattttctctataccaaacaataaaaaataggtctttttaatgccctgtttatagtccagataatttatatgaattttgaagaaatcaacatatttagccaaatggtagtactaggcttgacagcaaggtgtgacatgcatagccattatccagtcaccaatatccccattgttttacttatgcttacccttctaagccaaaatttaaattttaaaatttaatttcagagttgattttaagggtttgtcatcgtaatttattttacactatttgcttttgaacgctaacgacaagtatacagaacatttatcataaataagattttcttacctataagcgatatggataagcataagtgaaacaatcgaactgcaaaactactttgcgtgagagatgatcacgagcacttcgatgccaaacttcacaacgctgccgactataaatcatcgtatatcactaactttgtgttcatatatcgaagaaatatctatttctaaaaaagtgcctattttcaaaactatacttaaaaaatttaaaatctaaatcttttcatgtatttggattaggggctaaaattttagtccatgtcacatcggatgtttgacactaattagaagtactaaatagagactaatgataaaacccattccataacctagactaattcacgagacgaatctattgagcctaattaatctagtgatactacagtaaacatgtgctaattataaattaattaggattaaaaaatttgcctcgtgaattagctcttatttatataattagttttattattagtctatatttaatatttttaatatattagtcccgatatccaaacaccacctttaaaaaaaaactacggaggaactgggatagttgatgcgcaccggggcacgcacgcgccgtgcgttgggcgtgtggcgcaaccccacgcaccggcacgcgccaggccggcgctcccgcctccagaggccgccaccggccacgcgcccctccacgtggctcctggcccaccaccagatctctccaccgacccccacagacaggtgggcccgttcactcccgtggcccccacgtgccagtgagaaaccacccgccgccgcaacgcgcgcgccacgcgccgcgtcgtgcccctcccgcgcttgactcgcctcgccgccctctcccccttgctgttattgctcccttcgcggctctccttcttcttcttcaatcttcgccctcctcctcctcctcgtacgcgcccacgcggttctctttctgccccctcgatcgatttgaggtttgcccttgtttgctgtgatgttttgcgctgttaattgggtgattaatttgggggggtcgggttgggttgggtggatcgatggctgatgggttctttcttggtcgattggttttcagcagggaacggaagggggaggtttttggaggaggccatggtgccgtcggagaggggggacgtcgccaccgccatcagacccgccgctgccgacaagctcgtccatgggtgagtgactgaagtttcttggttgtctcgtttggggacttgggggatagttcttgttcttggaggaagcaaagagatagatgctctggggatgctaaaatttttgtttcatgatttgtctcgaggcgcagtttgtttgttaggcatcataccatagtgaatctacagaattagtgatgatgctcactactcaagcagcaaccctgcaatagtaaatgtggaagcctgccaatcatactgcgttagacgccgttggtggcgtagagctatatagtggtattggcaaattatttgtcgtcaggtttattgacttagttgttatctctgcatgtcgatttaattcttatcccttttccatttgggaggaaatgaaagttgagaattgtgcattgttgctaatgttgtaagttcccattgaaaccttgtgcaggcctatctctgacaagaagtgccggaagaaggtcccgaggaaggttcacaaatctgagagggagaagcttaaacgcgggcatctcaatgatctgttcggcgagctgggtaatatgctaggtaagctgttttgatcacaaggcattgcgtcagttctatgtgtctgaattggaaatttattatagcttgttgcgcagaaatacaaaccacatatctctctcttgaatgtcattatataattcgtattactagcaactggattcatcattgcttaaatttgctgctatttagcatctgatcaaatacaacaaccttctgcagaagcggataggcagagtaatgggaaggcatgcatactaactgacaccacccggatcttaagagatctgctttctcaagtaaaatctctccggcaagaaaacagcaccctccagaatgaatctaattatgtaagtaatatttgctatggaaaaaaaaaactgttgatttgttgcagttgtagaaccatttccctttctttggcgtgcttgatgatttacattgctaacttgtcgtatgcataatgcaacactcattccaacattgttttttctcccacaaacaggttacgatggaaaggaatgagttgcaggatgaaaatggtgcgctacgcagcgaaatctctgacctccaaaacgagctgaggatgcgtgcgacagggagtccaggttggggccatggcgcgactggatcacctctccccgttcctccctctccaggcacggttttcccatcgcagcagccaatgcagccatctcccatgacaacaagcacagtgttccccttgcagcagccactgccacaaccaacagtcattgagccctctgcaagacagccactggaactgaagctcttcctagaagcaccccccgccgaagaccctgaaccatcagaagaccaggaggctccgaacaatgtggcacgaccgcagccgaggtacccaacagaggcatcttcttggcctattagcctgggacttccaagaatggaagatgagcaaatgtagtggtagcacgatagatgatagcacaggtagagattgagagggtctgtttttaatgcatgcaggaattccacacgaaaacacttctgtccttgcatgaaaactggaaaatttcctgcattccaagtaagacctgagtagatcagctccaaccaatcagaaactcactttgagcctagaggatatactactgaatgatgtgcatgtaaatatttcaatctcccttttgtttctgtaaactctagtgagaatagaacccgttttatccccttgcaaatattgatgtccaattaaaatgcatttatgcgataattgcaatcgaaggaaaagttatgaaagaacaaaaattgtaagactatacgcctgtaaccagcctccaagccaacattatcacaattctatcgagtctgacgaaccagcaacatctcaatacaactatgcagcacctggcaaccaaacaggctgatatatagtagtatagcattaacattgaacacttgaatattttccattgctgttattcagaagaacaatccgtacaaaattttatgaactactccactccgtagctggaaaaagtcaccatgtcctttcgcacataatgtatctactgatacatcttcaaacacaccaacggaaatacgcgagagattatggccggtttcctctgaatggcgaaccagatgcaattgcaggtggctcttccctgtacggctgagtagcaggatcagtcacactgggcagtctctgtacgctccccttcccttttctagcattagggccaatttcttcgatcatgtacttccatccgtcaataggacgcctccggctaaatatgtgtgttttgatgaagctagcaatctgcagtcgcatttcaacaccatgtcagaaataactagaataacacaaaaaaaattgtggagagagagtgattgtggacctgctgtttactgaaagcaatccgcctttcgaattcttggagaagaatgtcatcttcccgctgtgagatatcccatatgctaccatcctgtcctctagaggtggtttcccaaccatcaggcttggttttgatctcagcagtgcttggaatctttgaatcgccaaaatctgtatttccagaatcgaaaatcctgtatttcacaaaattataagccagctacgtgttatagattgctaagcattttgctcacatgaaaaatatgcattcctaacttagcaaaaccaagagcttacggaaactaaaacattgtacaagccataaagcctccccaatcatgcagcaaaaaattgttatggcaggaagatatgcaaaaatgacaaatagactgacagtagcattaggagttttggagtgctgccataataccgagactatgagagtttatgttttaatgcctgatatgctgattactaagcaattgtagcaaatgaaaagaaaactgcataactaatgtcattccaaatgctcctgcttctatcaactaaatggtgagcagcaaatgacgctaacatatgcttgttcctaagcaaaatcaagtaaacatcgaagcacagtacttcctattttttgagaaaaaaataaatttgagggtgaaagatgtgaactgtactagatccagaagaaattcacatagtacgcataatttgtgaaaccaagctgctacattggaagcttggagataaacaatatatgcaacacggttatattttgaatgaaccacaccagatcaacatttaatttgtacatcatgcaacaaaaaggttatcaatttgacatgcagcaggtgctatgcatcaaaaaaataatcggaggcataatatacactattcaagtcccaagttatcaaacatatcagagtttcaccaatgagcaactataccagatgaaaaggaaatcacagcttttccaggctctagctacaaatgaactagccataattcatagtattgcccgacagtctaacacaatacctatctaacttataaaatacagctgaaatttgatacagattcatggtctatcagctccagattccaccaccaagtgcggtgcacaacgaggaatcaaataatatgcaagcgacattttggcaggcaaatacagtttaaatcgcaaatttgtctaaggggggaaaaaattagagcagcaacttactcagagcacgagtcgaggagtcggtcgatgtcgtcggcgccgccgcctccgccgccgaggcgcgcctcctccatcttctcgatctccttcacccacagcgcggcgtgcacccgctgcttcctcgccctgtactcgtcggcctgcgccttcttggccgcggcgccgcccgcaccctccgcgcgaggagcggggcgcggccgcctcgacgcggcgcggcgctcggcccagcgctcgtccatgtcggccacgaaggccttggtgtcagggtccacctccgcggagatggccgggacggtggcggcccccgaggtgggggactcccacggcgcggcgggcgccggggaagaggtgggggagtcgcccgggagccatgaggtctcccaggcgtcgttccactcgtcgtcgccggtggtcgcggtggcggcgccggcggcggctcgcgacggcggaggcgcgcggcggttagaggagaggcgacgcaggccagaggcggaggtggggacgcggagggcgcgccggagcgagtgcatggtgtgtgttcggtgaaatgcgcgcagagaggctctcctgttccggagtataggtagcaatcaactaagaaatcctctgcaatttgatacccatcttatcataagccctcctaaatacatttagtttggtaaaaaaaattcttttcagaaagacaatacaaatattgatgctcacagaagcgcgcacaaccacctctatgaacgtacattcggaaaactcatccgacatacgttgacattaacgaagtcatcacaggcacatcgttgtcgggtgcatcatccaccgctggaaaaaagaattagtcataaatgcaagccctcgtatcaagtttaagacttaaacccgagtggactatttccaacctaactagtcaaactacgttacagtgcaaaattccattaaaaacaactattttgaaaacgttgttataacgtcattatacccatccacaaaactcaaaaatccaaatcattaagaaactaactggcagagatgggggagatcgctcctctctcccccctcggtgctcctctcgacaactgagtgatattttgccaccgcttcacattatatattttgtacgctttgatcaatgagaatccatccctctcgctcttgctcccacactctcagctgtcttttcaacacaaattatttcaataacttcaatcaaaaccttttatgtacttatggacagttcgactgaccatgctccttttataagatttgcatatttggactctactactgtacttcctaaaggattagattctgaaggtatttatcctacagcatatcttaagatttaaacctcaatttgccaacctggtatttcttttttcaaacattatgaaactacataacaagttgaataaactttacagtgttacaaagaacttcaagacattatcacaattcttaggtttaatggatcatcggatcagtaccgtttaattgttgcaagagcacggaaaattaagtgcttcttatcacagttgatagcatactaggattaattaattggaggtcatataaaaccaagattcaatgtattatactacaccagtgttagtaaaatatttgtaatgattcttttttatgcatatagcttcttctttagaagaatttggaattcctttaccacacgtaaagagtagaagagataaagaaaaaaaaaagatagaggagaaaacaaagcgagaggtgttcaaccataggcccataagacagcccactatatcatctaaaaggccacaaaagataggcccaccaaggcaaaagctctagggttagggtttagcgcctgctttataaaggactccgcccccaactctcgtccgcctccactgcctccctaaccccacaatccatctcgccgcggcggcggcggcggccgagaccggcggcgagcggcgggggcgggggcggcgtcagccatggtgcgcgttagcttctatcgcaactgtaagcaacatccttgccttgtctctctgtacccgtgatccattggatcacagaacgtgatagcagtagcatctgatcccgagctagcctcttcagcagttttgataagttttgatacttaattacttggttccgcatttgaatctggagtccgagatctcgtcatttgaatctgttttggtagtccacgggcagattaagggtcttgcctgatttcacaaaggtaactgatttggtacatttgagtcgttttggttaatcggcttgctcgagtttgccagttgtcaatagttcgtttatgtgaattaataatcacagtagtcgtgcttgacgtggaaatgaaaactgcactctgaaatgcaccttttgaatcctaaccgaaagagtaaagtgtttgactataggggcatatatcttggagacgttcgctcatgatatgaggatcagtagctcttgatataaattgactgttgtttcaaacgtggttttttatttgatgccttagattttcgtacatttacctgatactcatggtgtgttgggctatacatgtctaatttcgcaatattaatatttctcagatggcaagactttcaagaaaccaaggcgtccatacgagaaagagcgtcctgatgctgagctgaagctgtatggtgagtatggcctcaggtccaagtgtgagctgtggcgtgtgcagtaagccctaagccctatccgcaatgctgcaagggagctgctcacccttgatgagaagaacccccgacgtatctttgagggcgaggctctcctgcgccacatgaaccgctatggtctccttggtgagggccagaacaagcttgattacgtgcttgcgctcaccgttgagaacttccttcagtgccgcctccagaccattgtcttcaagaacggcacggtgaaatccattcatcatgatcatgtactcatcaggcaacaccacatcaggtatggatttcaaatttcttatatgactggtgatttaacttaggtacactgctgaaatgcatatgcataaataaacatgggcttgattgaacattgattttctgttttgataacctcatagctcagtattttcgaactgcacttctgtttttcattctgggtcatgtgatgagaaacaatatgcaactcacgacggtcgtctgagacacttagtgtgtaatggtgcagtcatattatctctgatgccctgccatttctctttaaacttcttacattgctagggtcatgtatgtttttagttttatgtgaaccacatactatttttgcagaattttataatatcttattgttggttcataattgtcattaagttggtttggcacttggcattatgtagtagttccattttgttgcccttttttgcacatttttcttggagtttgtatttggtggcacaatgaggaactaactttgctaatgtatctatgaggccattaggctaatgactcaaaatgtccttttcattctgagtgccacattgtacatgactttgtttttctcttaataatggatctcacttgtctttcattatttgcatgttaaggaattgcgtgatcccatcatgtccacggtgattgctaggatttaatttgtgtttagtctcatattgatgcataaagctatcacagctatagtacttgtgtaaataggtcctgcaaaatgtgcaaaatggatttagtttgtctttgcgtagttgaagcctagattacttgctaaatgttgggttgtgcagagtgggaaggcagcttgtcaacatccccttattcatggtgagacttgattagagaagcacatcgacttctcccttaccagcccactggcggtgagcctggaagggtcaaagagaaagaaccagaaggaggcctctggtggtgatggtgatggtgatggtgatgaagaggaagagtgaatatgtgatgtcagctcggttttgttataggacctaattttgcgggaacttgtcttattagggacctaatttttgttacatgagtagaaaacaaaaattagccaccgagggttgtcaaaaattgttgtttgcgctgttgaaattttgatttgaagtttatctcctcatgaacatgtgaattcagtgtacccaggaaatatatcccaggtctcacaagctaatactgttgggaatatttgaagtgttgggtaccttgtcttttgaaaactggctttgattatactaaagcggatactaaatctggcctcaaaattgttctaataaatctggaattcgaactcgcaaataatttgttgtcacgcaggcatgtatattctagggatcttttgagtttgttggtgcatatgcgaaaagtggaaaccgctactgctgttgtgaagcgcttcagaattacccgttactgctgttgcgaagcactccagcattacacgttatcgcacgacgaaacgtcctaatttcagcttgttgccttcgttcctctgccttgccgaaccctctctgtcttcttcacttttattttttctatgatggattaaaactgcctctacaccacaaccaactctcttacggtgccatgcgatgtgttatcgttcattcgtgttattctaccatctaccgcctcctaatcactttcccagggattcccctagcgcctaaccactatatcttagttgttcgatagcctccactatccaacacccttctctgcttgttctatacccccatggcttcaatggtaccatcttcatctcatcacgttgtgtttacaccttccatattgctggtcctccatcaccttgacctccccctctaaacctagagccagtagcgcttggcaatgaccctcaacccttaccccgtcttgtcgatagagaagataaggaactctccaaagataaggatgcaggagggcaatagtaacatgaaaattgactaacctgacattgttagccaaaggtgtatcttgcatttctggaactacaatggaagtcatagcatgtttagctatctaatctaagctctcaaatttttaagtggtcctgcacttggaaaagtttggagattgagataggatcattatgctagagccttttgtaattgctctctaagtttatttccaatgcggtaagttggtaagtaacttcaactcagtatgttggagacatattgctttggaggagagagtggaatatgttggcgacatactgcctaggagaagaaaggggatgggggcaagtggcttcatggggtccttgtgccttctgcaaggcacgttaacctcacctggcattctatgtgtggtccaagaaggagggagcattgacctaagcatgaggaagtggtgatggagatcttatagcgatagatttggcgagcctgtagccacatcaggcgtagtcattgagctccactcaccatccgcaaatgccatcgggatcctcatcgtcatatccactccaccaagcccctagtctgagaggacaaacaacggcggagatcatcactgcagcaccaaggagatctgagataggatagctagccaccacaaatcttgtcaccacagtgcttaagaagggagcaagcataggcgaagaggagagaggcggcgaccatggtggcagcaaagaagggagaggagagctgatggagtgaatgagtgggagagagtagttatattgtttagtttatggaatttaggaagtgtagtgtaaaattttgaacttccttgtcatttagaaatagaagaggactaaatataaaatgttagaggctttgaagctacctatataggtaatcaaatgagccccatgacatgattaggcatggctagtgctaaaatccataaaatccatgccaatccacgggctacaccaacggctcaggcatgacctaataagactcgggccgtgccgtgccgggccgaaggcacgacaagcccagcgggttcttccttggaatatatctattttgcatccgtcatctatttgggccttgtctgataaggctagaataagtctatttgcattcctcatttctttgggccatgctttatttggctaaaataagcctattttgactccctcatctattttgcctccctaattgttgggttgtgccgtgatgggccggcccaccatgccgaggcagaggcccagacacagcccaacagttgggctgagctggtacgggttagacactagtcgggccgtgcatgtctgggccgggtcgtcgcgccctgggctgtttagccatctataactccatgaggccattgattttgttttacatttgcacatgtagtctcagcatagatagtagccatattgtattcgaggcagggtttatattaccgtcggtaactatgcggttactgccgttaccggccttaccgcgggggtatggtaatagaaaaaccgcggtaacctacttaaatttaaataaatttaaaaaataatttgaatttttgataaattttgtacggtttcgtacggtttttcacggttaccacggttaatgcgcggtaaccgtgcttaccgccagggcacggtaaccccggtcccggcggtttgggaaaccctgattccgaggtaactcggtaaagccgcttgcacagttttgcattgtaaatgccctgatcgagttgcatatgcccgtgatgctacagctctttcccacaacttgggacaggaagactcagtgaaaaaaaaaaaacaaagaacagaatgcccagacaaccctttctaaaagacgtgaattagttgacaacccaacggcttattattccctttcatgattcctaacttcttttctggaaaaaaaagcatgaaagcaagcatataccttaattaagcacacatgacacaattaaacaaagaacaaccaagtcagagcgatatgggtacgcaaagtcagcagaggaggaatcaaaatctattcctccccgagcagcgactcaaacgtaacacagctgagcagctacctaataagctagctagctcacgtacaagcatgtcgtcccctctctctctctctatatacatatatatgtaacgaattaagtcaatgtataagcaaattaaagattgtctgcagaaaggaaaactcaaacaaatcaattagagagagagagagagagagtaaatcgatcgacaatggcggaggcgatcatcgggccgctggtgtggaggctgcaggagatggcggtggggcaggctcgggcgctggtgtcggtgaacgacgacatcgtgaggctccgggacaggctgatgtggctgcaggccttcctccgggaggccgacgccaagcgacgcgccgtctccgacgaggtcaacaaggtgtggctgctgcagacgcgcgacgccgtcttcgacgccgaggacgccctcgatcatttctatctccgcgtcgatatgtccaggtatatatagctgctactagatactccctctattttttaatagacgacgccgttgactttttcttccatatttgactattcgtcttattcaaaaaattttatgtaaatatataaaatataaatcacacttaaagtattatgagtaataaaacaactcataacaaaataaattacaattacgtaaattttttgaataagacaaatggtcaaacatgtgagaaaaagtcaacggcgtcatctattaaaaaaacggaggtagtatgttattcccttttctgcatccatgatagatattgcctctggttttaaatggacaaatcggacgtctggcatttctcagaacatcggacggtgtatttgttacaaaatgtttcagatgtttcatccatcaaggaaaaatgtttcatcgcttcaacataagtgtttcaaccaaatgcaatcgaaacatattgattgcaaagattcaatatatgcaacatcaaatcaaaacaaaatgaaacaccttaataggagtgcaacaagcttaaacagtagaatgcaacatcactaaaactccaacaaaacaaacctacctccattttcttcaactccggtcaccggcccccgaggaaactcacctccgtcgacttcttcttcaactctggttgccggcccccgaggaaacccaccttcgtcttcttctttagtttcggccaccacctctcgacacctacgtcttcttcttcaactccggtcgccgccacccgacacctctgtcttcttcttcaactccggccgctgccccctaacgagcaacagagaggtgggtgcccatagctaggaccagtcccatcaccgccggcgccgccgcataagctccatcactgtgtggctttctgcgaggatcagtgcctcaattatcccgcgtcgtctcgccctccgttgctgccgctgtgtagccaacgctggtgaagcagcaagagagaagaaagagagagaaaagaaggaatctgtggtggagaaggatgtgggatgtggctgtgtgtttggataaggtcgacgtcccatattttgcagtgtctggacgttcgtccggaagcattttcggtttttaacatatgatgtagttaaattatttctaattcgtttgagttttttttttctgaaagaaatatttagacaaatatatataaacatattagacatgcttaaagtgcttttgatggtaaatctagtaatactccttttgctttacttaaactaagtaattgtataaatattggttgttatatattaaacacttgatcaaacaccaccggtccaaacactcaggaattataacattccagtccttttgaaataaaccctgttaaagtatataagaatggacacctaggttaacacaaaccccgaagttggggtcaacaccataccttgtgggacctcttgggagttcaatagcaacaaaccattgcaccacctagaaggtgatgacatgatgtggtatattaagtactagcataatgcccctgcgttgcaacggattctaaataacatttattgacataaattaaaatcctaaaccatgcatatatcacaattagactgaagggaatatgatcacagaaataacagtattaaactacaactaacttttgctggaacgatatttcaatatcagaaaaaattatataactaaatccttattttatttagctataaataattcaacacagagcaaattgcaagtgacaataattttttagtggatca

SEQ ID NO: 66589 - DNA, 2167 bp, Oryza sativa
acggagggagtagtaagtaaactacccatctttacctatctacttaaacttttataatgaactagtctattagtgttgtactccttctgctcaaaatataagggattttaggtggatgggatatatcctagtactacgaatctagacatgatcctctccagattcatagtactaggatacatcacatccaactaaaatcacttatatttagggatggagggagtagctacgtatttcctctccaacttcacgaggctagagatgccaccggccggcgacgacaagtcgccggcggccaacggcgccggcgacggctattcaaaggtactgcagggccggtacgagctcggccgcgtgctcggccggggcgcctcctccaaggtgtactgcgcgcgcgacgcccgcacgggcgcccatgtcgccgtacgtcaaggccatccgaaagcagccgcagccgcactaccacccatgtcgctcgcccgaggcggccgccgcggcgcggaggtgcgtggagcgggaggtcgccgcgctccgccacgtgcgcgggcacccgcacgtggtggggctcctcgacgtcctcaccacccgctccaccgtctatacctcgtcctcgagctcgcccgcggcggcagcgtcctgtccgcgctcgacggccgcggcggcggccactacgacgagcccgcggcgcgccgcctcttcgtgcagctggcctccgcggtggcgcacgcgcactctctcgacgtgttccaccgcgacgtcaagtcagagaacctcctcctcgacgagcgtggcgacctccggttcacggacttcgggcttagcacgttcactgacgccgaccagcaactcggcgccacagacggcctcgccgccacgcactgcggctcgtcggcctacgtcgcgccggagatcctcctgaagcggcggtacgacgccggcaaggcggacgtgtggtcctgcggcgtcgtgctcttcgtgctcaccgccggctacctgccgttcaacgacggcaacctcatggccatgtaccggaagatctgcgccgccaagttccggtgcccgaaatggtgctcgccggagctccgctctcttatcgggcggatgcttgaccggaacccgatacccgtatcaagattggtgaaatcttcgatcacccttggttccaacaagatgggagcttgtcatcattcggtatgatccaagctgcatcctctcattctaaactagaggtggagaaatgggaggctgggaggctgaattggagcaagcaatggagctaaatgctttcgacataatcgggttcgcctcgggatgcgatctaagcgggttgatcggtccattgccagatcgagttcgattcgtcgtgccgggtgcggattccaggtcagttctggacagagttgagaagctagggcgagaggaagggcttgtagtgaggaggaaagaggaagaatggcgtggaggagttcatgtggaggcaccaagtgggaaattcactgcatatgtaagggttagtctattgcccaaaaagatgctgatgatagaggctgaaaggtatatcggaaacgagattcctaaattttggcatcaacttcagatcggtaatttattcgtcagaaaatgagtatatgatgaacatgtttttatgcaagagatcgtaaatatatagaaaaaaatagtttagagtaatactccctccagattaaaaatacttggcgttctggatataacaacacgatctccaaaaactaatttttaccactattttctattacaatagagatcattacaatattatagaagtactaataaatatatgattttattaaaatacattttaagatctaaggaaaatactttagaagttattcaaagttaaagtttttaaagtttaacattagttttgtttaaaatgataattattttttacctgagagggagtaattgatattagtggacgttttcacatttgtatatcttgtaaataaatactgagacatgaatacacaaacgatcgatctcattttcgtcacgagtaatggaccataagtatcacttgccttgttacctcaagtagctgccacagatcttcaatagaatctcctgccactaataatggggatcctctagagtcggctgcggcatagcaggatgtcatttcaggcgg

SEQ ID NO: 66590 - DNA, 4223 bp, Oryza sativa
  unsure (1)..(4223): unsure at all n locations
cgtcttcaccgagccctactcaaagcgcctcatgctccgcctccgcctccgcggcgaggtcctccatggcagcagcggtgtcacgctggagcagggccatgccgtggagttcgccgtccacgaccgcctctacaatgcgtgcgctcaccggtgaaggagggattggtgatgacggcttcagatcgacaccggggaagaggaagccgatctccatgcctcttgcgtctccggttgggattcttggggggtcttggaggggagatcaaggcggtgctgatggcgcggtggctcgtcctaatttggtccacggcggctagaacaccgaggtcgacatggcggtgaccctgggagcacgctcctgggcatccatgtgcacagaggcgttcctgtcgactcactgcatggaaagggatgagattagagggaatgaaaccagtgtcttgaggaggtaatgaaacgtggatgagattgggacgacgacggctcggcggcgattggcgccatccttcttggtagcccgcgatgagatgaacagagaaagagacgaagaagaacagagaaagagagattgacaactgggcccatgggcaaacttgtctttaaccaaaatttctctctgtttcgatcgaaaataattaaataatgggagaagtgtccagcagctaattaccacttttttaagtgtccacgagcaaatacacgatcttcgggtgtctcacagcaaaggccgtaatctttcggaaaaaatatcaaaaaatctgtagcaaattttatctttcacaaaatatcaaaatattatatggaaggtttagaataaaaaaaaatatatcatattggaaacaaatagaagaagatctgtagtacatattccatttatcatcggtggcttcgaaagtccgtttcaaatatgtgccttatgagagaagggatagaaataacatcaccttttaagtattgatgagtaaattgcaccagcggttttttttcttaacatgtaaatagattttacctagattcatgaacttgcaaagcacgtattgaaatccctaaacccggtttattatatcatcccggtccaaagccttatttgaccatgatcttgcctacgtgtcatgccacgtggacaataatatgccaaaatttcccctttccctcattttattatttattttttgggagctcctcttcctaaccaatctcctctccctctttcctttcttcccttttcctcctctctcaccatccaaccgtcggctgttgctgcttcgatgttccagttgcagcctcttctccgttgttgctgtagtcatcgctgcctgctgttgctgcttcgatgctgccaccacctcctctccctcaccgccgttgtcatcgcctgctactgcttctggaaagttaggggtgagggagggtttctctacagccaccgatgcctcctccgccctcccatggccgcaaacaaccttatcgccgtcggatatccacgtcgggtcatcggccactccgcccttggggcagtgtgtccttgctccggccggctggtaatgaggaggagcgcatattcagcgaaaagtcgaaggaggaggcacagatccagtgcacgcaacggtgaggaagagatggagaagaggagaaggtggcgcatacccgggggcacatgtgaagaggaggagaggaggtagcggatgagatgaagagacaaacaagaggaggtgactacaatgaccaggggcacccgtgacaacaacgaagggcggcagacgagacagataagaggaggcggcgacgacgaaccagggacgcatgtgaaaacaacgaagaggcgaaggagcggaggtggtggcgtccactaggagtgcgcacgatgaggaggtggaggaggaggagaagctcttggtcaccgtcaagtggagctcgaggtggagagaagggagacgacggggagctcgtgatcaccatcgtcggctttagcttgagcatctgctctgccgtcgggccaaccccgctaccggtgcctctttctctgatggccaacaccgctctcttgctacctccctatctctgctacttgcatgacgctgccactggcgcatccaacggtgggggatgaagagaaaagaagggggaaaagggggaatgggaaatttttccatgtcatcatcctcatatgcaataccacggtcaaacaaggcttaatagagtaaaaattgtttttttcccttttatgatctacatatatataaggaaatctattgcaacataagcaacaaataaattacatcctagcgtctgccttatgtaacatcgaaagtttcgatgatgacaaaaatcttgatcgattgatgacaagggagtgttcgatcttccatcaagtgaagataattatcgatttttgcggaaacttgacatacaagatccagcttccaatcaacatgatttcaaaccctccaatcataattctatatctcctttggttatcaatagtttaaaacctgattgacttcgccgagaaggataatctctatatgcgaatcgaaaaacacaagcaagaacaaagtcgattgtaactcaattgtagatgaatgattaagaacttgaagttagaattctacaaactgactagcgttgaaactgcatgacgatagaaaaaccactctaaactttgatggctattgaataagtatgattagggatgtcctagggtgtccagtccttggacttatcccatgacataattacaaggtctaaggcccaaatcaaactcaaattggatgatgcacgtggcttgttttgcagatttttgacatccaaggaagaattttaacatgggaccaaaactatttgaaagtagactccataaacattttaacaagtacttatggaccctaagagtccgtctagttcagcggcatgtccgtttaaaattgatgctgttaggagggccgaatccaaataaaaaagtgtagaactttatctctggtattctatagatgagaaatgacgtggtatcatggaagtagatttggggaaggatattggttagtccctgatcaactttatgatcatccaagcactctgtatacccgccccctttacttcacccatgcaattatttctgcaaacgagaagatacatgactcatgttacaataatgtttattgaaatatataacaataaatcttacataacaatcatacatgcacttttggttaatgtttactcccaatttcttaatttctagtttggctccctccaccgttatggtaaaaaatcgttatgttttaactatttatctgctagagcatatgtaatatttatgtaaactctgttctttattaccaatcaaaatagacaccttacctactttcatcgaaagaaataaaaaaacaacactaataaataatgaacatgattctagatgtagtaggtattattctagaatactcctcgtcggaaacatatgaaacgcatttccctcaaaacgcaaaaaccatgccccgagccccgacaccaactccgtcggctggaaagccgacggcccagatgaaagccagcggtgccaatgcgtaggccacgcatgcctccgcgcaaatcttatctcccgggaggttccgctccacttccctccccgagtcgctcgaaccatccaatcccccccccttcctttcctttgcccccattcccatcgctgctgccacggcatggccgttcccgccttgtgcacctcaggcacgcgccccgccgacgaggtgcccttttttctctcgctctcatctcccccattcctcccctcttcccgtgtcctgtcgtccacagctccccgaccaaatccctagccctcccattccccacccagcaggcctccctcgcccggtcacgccgcaagaccgggcccgacagcgctgccgcttcttgcccttctgccgcggttttcaagaggttgttgtcctgattcgctgcagcccggtaggtattgtccctttttctcgttggtaagtttgccagcaaaagaaaacgtgtttaatcctgaatgttatataattgagcatctcatggtgtctatgtatcagcatatgggtcccgngctcgggttcggcccaagggatcctgcactcacctcttgggggggggggnancngagattttccggaactccccagaaaccccanaatacccaaattttccctagttcccacaaattcccaatataccataatgtttcc

SEQ ID NO: 66591 - DNA, 2410 bp, Oryza sativa
  unsure (1)..(2410): unsure at all n locations
ttgtcnannntttgaantcgctcggacccancgggaggatgcatatacacgattacaaataccaactccacctcgaagataatatagcatagtatagggnttgccttcttcgtatgttatggccgaattctgatgcataacaaattttccactatatgtaagctcaaaaatgcaaaaataattaccctcgaacctaaaaaaagtgtatacatgcaagggatcatcaatcctacatataaatacatgcaaataatacacgccctgcttggcagccattgttgcggctgtacctaagctactagctgtggccgcggtgtgcatccacagccacagcaatggctgctcagcaggcccatggtctgtaaaatatttcctggcggcgtgcgggcgacaaatccggcggcggagatgctcctgggcagcgtatccatccacatgcttgcggctcgaggcgcgggaggcggtggatcaggtagtgggtggcgcggcggtggctccgggcacgggctgcagatccagctgccgccggcggctcgacgcatggccagcatttttggcagcagctcccggcggtgttggcaatttcatctgcatattttgcagtttgcttgttgaaaatgtgatgaatctgtatgtggatttgagtatggatctgatgccgatttaaattgattttgaatttggattgaaaaaaaatgcagctgctctggatcttatctatttagggtcatgacattaaaaagaaaaaatagagtcatgccatgaaattattaaaaaagaaaaaggtttgtatttaggtccgccataaaaaaatactctttttttagacggatctcttaaatatccgccacaaaaaatcggcgttttcactggcggctactaaaaagatccgtcagcgaagaacagagctactataaaaaattttggcggcatttaaaaccacgcgctccacactaactcccacatccccgcacatgctcacaaacacatgtttagagggacccactaaatttgtattaaagcactttcgcatgtgtgtaatatttatgaaaacaaaagattcatggtggtaaaagattcatggtgggtaaagtttgtatcaacgactctacaaccatacaaccacacctttagtgtgtcctagtcccttgatcggtggttaaaaataggaaccacccaaaaaaagtggcaaccgacccactcctacttctctgcgtattggaatttacaaaaaaaaaaaaggccggtgcacgcacccgaagagtcgcgcgacaataacggcattgctacgtgattgactccatcgccatgttttttgcgcggcatcacgacgcatgattcactcgagtcgactcactccacttccaccgtccgcgcgactcacatcacaggtgcgacgccgatgcccgatagccgactccgcaacaaggactcgaggaccacgaccgcaagttccgcacaccatcgccgagcgtcgccgccattcggccgccccgccacgagcgccaattgctgctgccgccgcccgcgtggccgcgtcccagtgacagcagccggctagtagctctccgccactctccactgcccacgcggctgcatgctccccattccgactttcggtattctgtgaggtgagaccgcgacgaccaacaacactacttcgtttttcaattttaggtcttctacctttttcagatttatgtttaaaattttaactctggttgcattgtgatattaaattgtagtattatatagtagattgttgattgcatctctttttggaaaacatgtagcaaagaagaatgcttctaaattgctttcttccccggttatggtagacgagcacactcaagaacaagatggggatgaagaagatataatgagcactttcatggccattagaagacgtacatccgataagaattaaaagtaatatggtgatcttattcaaacttttatagctatattactaattttatatgttttaagatgctttattaaaatatcatggtacacttatggtccattcttcattatgagaaaaaccgttgtatatacctgaattttaagctaatccactctatgcccttgaattttggttgcttccttgtatatccccaaaatttgaatttgatcccttccatacccctgcggtcagttgaccgtctaattactataaagatgactattttaccctttggataaacatggaaatttattaattaaattactaaaaatatgaaagtttgtcgcatgaaactattatagttatggggttgttgtgtgatgtattatttatcacaaaatttatttttagataataaaaataaaaatatgtatttattttttaaaaaagtcataaaaaagaggagcattctaaaagataggactacttatgctcactataaaa

SEQ ID NO: 66592 - DNA, 9667 bp, Oryza sativa
  unsure (1)..(9667): unsure at all n locations
aagaaatttgctagaattgtttagccctctagacctttataataattaattatctaaataatataaattgctaaggttatttgacattgcaatggtatgtaatgcaaggtttatttttatgtaattctgttaatgcagatgcttttatttttaaatctagtttgataattttatatatttcaaactttgtgaatttatttcacgcctaatctagaaaaagatcaacgtacttgaaccctttacatgtgtgtaagaaaggattattgtgtttaaatgcgcgcgcgggcagggccggggggcggggtgttaagagtggttacatttttttatcgagcacggctacacgtattaaaatttccttactaaattttactaataatcatctcaaccgtttgatttatatagataaaaatcataaaaaaaattagatacacttatagcatgacacatcattgttagtaagaatttagtaaaaaaaaaagttagtatgtatagcttttccaattttgtcaaggggcgaaaaaatagttttctaatgaaataaaatagtgattgttttaactaataatgtcttatagggaagaacgcttgctagcttcatattggtcgttaatggatgtgttaatcattgtggaggtcacgcaattagttatattactccctccatctatttttgatagtcatattttcaaatctgaaaaatttatttatgataggtatatttcaatccaacaacttatcgtcttagtgtcttttttggatttaatgcgtgactctccattcttccacacaagattggctacatggacatcgagaaatgtaaatattaatgaatcgcttgtttacgaggaatgactagtatcatgtttaaatagatgataagtagaaacacttatcgttggtctgtgtgctaagataaaatatgactattggatggactacaactttaatttcgagtttcgatcgggggtgactctttcgtagctgtcgtttggtctttaataagtaggtgattggaaagaataatctagttttaacacttcgatccatgttgttaattaattcatgctcctgtttatgaggccactaatgcttccgattcggatgtttttgttctataagaaataacacgtttagagctgttgcctttggtttatggaaaaactcgatctcatgatacggaaataaaattccctgtactagctagacagcctgctgctgtcatgcaagaaggctaaaaacgaatggaagtgaagatgatcttatcacaactcgcaagtgaagataatgatggtggcagcgtatctaccacccacaaactcagttgtatttttttacaacaactgtatgtacttcttttttttttaaattacacagcacaacacagatactcacagcacacgcacactcattcttactaacacacgcacgcaaaaccctacccctatgagcatcttcgaagactgaactagtaaatcctggagattgaagaaatcaccacagacgcctcgttgtcgacgggtacgtcgcttaccactgaaagcacaatgccgctaaatcttggaaaattcgctccctcgtggagtcgaacccaggacctaagatgttactgaggctcttgtaaccactaggatcctttataaaaggaaaaagtacgaattacctcccgtactgtagtggtcgaccgaattacccccctaatcataaaaccggacattcttcacacccaactatgcataccgaacgaattaaccccctcgacccaatccgcggtggttttggtctacgtggtgtacgcgtgataatccagtcagcattctatttattaaaaaatatgaaacccacctgtcatactcctcttccactcttcctctctcttctctctctcgctcttcctctctctcttctctctctcactctctgtctgactgtctcactcttcctctctctctcacgggccggtggcgctaggggacacagcggcggcggcggcggttttgaaatgttcacgctctgggttttggtttgggtttatggcatcgggtgtttttttttttaacttcgatttgatccccaatcatttcagattcatttttgtttccctttttgttaagtttgcttcgattctgaatccacttcttgtttccaactgaagattatgtttctgttccaaaatttgctcgattcgagtgcgtctacgaatttggattttacaatttgacagctgtgattatatcgtgcaggtagccgagactacggcgatggtcgatgaggaggagcccctcctgggaccagatcagtctcgcgctcgccgacctgcgcggcggccgcggcctcagcccccgctccaagcacctcgtcgccgcgctcgtcgaggccgccgccgctaagctccaccccaatgccaccacccttcgcctgtgccgcgccgccttctaggggaaggtagtctggatcctcgccgcgacggtcgccaccatgttcgccatcgacgtcgcgctcgccgtcgccctcgtctccgtcggggcagaaggtggcggtggaataggggcggcggcgaattgaataactaattacgtatcaccccggattgtttgggaaaggtaattcgtatttttttctttataaaacaatatttctacgtattgttaatatcttatcctctctctaagaatttaagtttaccatgcaaaaacatccaaaaaaatcagggatgatatatgttgttccaaaaactttacaaccaacttgctctaaacaatgtgcatatgtataattcatttttatccatagcaaaacacgtgtatttaagtatgtcgtgaactttatgataagccacctttcgagaatgacgtgacaaagggagcaacagtacaagactcccttctagaagaaagaaacgttgttggggccagaagcagggaacaggacaagaagccccacaatcatgcactagtagttgtatggggaagaacaaataatcgctcccagttgtttgcaacatacatatcgaatttgtcttgacgtatattcatccggcgattaaagtaccacctcacgtgaaattcatgtggttctagatcgatgcaaattaacttaatatcctctctctttgttttgttatggagaacggcattattgttaattgtagattaatgtgtgccattctatgagctatatgagctacagtgatcaggagtaggtacaattgtatattataagctagctataaacacatttcgagaagacaaaaaataaagagaaaagcagcggactatagacttatagacagctgcagtatggattccaagatacctgtgtgtatatgataggtggaatcaggtattaattttataatatatatttatagataactattgtataaattagctattaaattaactatagataatttagagtgctatattattaaactacttgctcttagtaaacttaactgttaggccgagtttagttccaaaatttttcttaaaactttcaacttttctatcacaccaaaacttttctacacatgaattttcaacttttttccgtcacattattctagttttaactaaactttcaattttaacgtaaactaaacaaacgctagtattttataatggtgcattcctttcacacgaagtacttggagtgttacagtgttgtcgcatcacgctgactcagcacagtactactatgcatgtggctttgggatccccacattgggcaatcgagcatatgccacgctagaacgtggtccaagtgaccatttctgggtgcggtagcaagtacgagtatacgactactcttttcgatcaacgacaaattaagttaattaatatattgtgatatagagttcctgtacatattactctatatccaacaaacaagcagtaatgaacaggcgaattaacgtgatgatcgctatatgctgcatgcacgtctgtatcatctagtactagtaacctaaacaccacataattatgtggtcaagtggacaatgatcgatatacgcatctctctcacgacggaagaatctgtaggtgagcgttagacgtgcacgcttgcgcttgcacacacatttctcgtttcccacctatcgatcaccccgaatgaccttcagaattatatatttcggcgccgcgccgtgcactccacgtgccctcgctctttgacaatttgtataatccactgatctcttcagtcttcccagttctcactgtctgatacttgaagtcttcccagttctcactgtctgatacttgaagggtgtgtttgaggagaaggggattgaggagattggaagatacacaaaaagatgtgagccattaactcatgattaattgagtattaactattttaaattttaaaaatggattaatatgattttttaaagcaactttcatatagaaaatttttacaaaaaacacaccgtttagtagtttgagaagcgtgcgcgcggaaaacgatgtgcattcttactccctatcacccaaacaaacacagccgaagcacagaagcagtaggtttggcccgggtaccggtaaaaacagtaagaaaattttccaaccatattatccacttctacaaaattaatactccctccgtttcaaacgttttgactttttcatggtcaaattgaagtttgactagggctgtgttcgcggctagggagtttggaactaaactctccgcacagaaaacggagcggtccattaacacgtgattaattaagtattagcttttttttttcaaaaatcaatcaatatgagtctttaagcaactttcgtatagaaaccttttggaaaaaaaacaccgtttagcagtttgaaaaacgtgcgtgcggaaaaagagaatggtgagttgggaaagggggattccgaacacaccctaagtttacagaaaaatatagcaatatttttaacatgaaacgaaagatctattaaaatatattaaattttagttttaataaaaactagtttggtgtaatagatgttgctaattttttctataggtttgatcaaacttaaagtattttgactagaaaaaagttaaagcgacttataatatgaaaccgagggagtataataataatatctttatcagcaggtacagtttccaaatattagtttttctactatctattagcatcacattgaagtttacattaaatagttaaattcataaatataaaagatttcaactatttttgtaaaaataaaaagaagagactattatcgatcgatcgttttcatctctaggtttgggtcgccctaaaagtttttttttataatactctagttttagttgaaatatctttttaataaaagttatcaatcaaagtttgtaccttaatgccaaaaacaacgtgttctttgcggggttcacaaaaccaatggaattctgtaaaaaccgattggttttcgtgaaactactatgtctccgtttgtgaaaaccggtcggtattaaccgattttcgtatagtattgactgaaagttatcggcttttatcggttttcggtcggatttcaggaaacccatgaggagctgtttctactctgaaatcaaaaagttaccctggttcttctttgtaatcggagcgagggagtaatttagcagacatacatatattggcatatcatatcgcacagcatctgctgtctaattattcgcatagtatattcagttgtacctcccaagcacattagaagtaaaataacgacaagatgcgcatttgtttcgttaacagtacgtttcaatctagctacggagttcactattcacagagacgaagaaatatagagttatgatgcagatgcaatacacgagtcatgagtgacgttcatatattcctttccttgcctatttttttcctctattttgttcgtaccgaattagcagtactccatgacgttcattagcagctgcacagccacgtgattccgtgactactccgctaattaattaaggctctgaaattaaagtaaagaagctgcatcaagtagctgtcttaccttccagcatatttggaaccacacaaaccggttcatccggccgaccgatcacttcgcctagttttgtgatcattcgtgcttcgggcattcatgctttcaatcatccaaagttcaaattaacatgacgacatgacatctacggacagagcaaacttattcatgaaattcaatcagacccgtcattattactccaggtctgttcatagggctttagcttctaaatcttactcgcgtgctttgtttcacctctttgtttcattcttttgatcactctaacccgctaattcattctctttttgataaagctgcaaatttttgattgagagctggatctggagcccatctcaacatgtgcatcctatgatctttggaggaggccaacatcgacgcaatcaaattcatggctgcaacattcgtacggccgaccaaaaccacgcaatcgatcgcgtcaccaacccccccaaaagatctccaacaattgtcacccaaaggaaaaaaaaaagaaggaaaagacccctcctgtcctaatccaacgcaaaaacaaatgagggaattcccaaattccaatcacacgaaagcgtgaagcatcattggattagacgaggtaatcaaattaagcggcaaaaaccgtttaataaatagtagtactaaatattcataaaatatatagagaaaatcccttgtatacccctaaaattttagctaatcccttctacgcctctgaattttgcttacttcattatatagtctaaaatttgattttgatccattctatgctcctcccgtcagatgaccgtctaatttctacaaaaatgaccattttatcctttgaatgaatataaaaatttatgaattacattattgaaaatgtaaaagtttatcacatgagactattattattattgtttgttgtgcgatatattatactccccccgtcccaaaatataaggaattttggctggatatgacgtattacagtacaacgaatctagacagctttatgtctatattcattgtactatgatacgtcatatccaagcaaaatcccatatatttagggacggagggagtatatgataaaatttatttttagataataaaataaaacatatgtatttgttttatttgttcaaaagtcataaaaatgaggagcatccatacaaagctaggactataaatgctcacgatattttttatgaatgctcccaatcaaaagaaatctattgtcctattagatttctctactattataaaaattaaagatatttttgccagtattttggtacgtcatccgtgtttgagttggttttaagttcgttctcttttggaaatacatattggtgtttgtgtcgaattttaagttcgtttgcttttgaaaatacgaaagaagtcgtataagaaatctttttagaaaaacttgcatactagtttgagatgaaaatcggactcctaactgcagctcatgattatcttaaaaatatccaagcaaattcctacagtgaatttcaccatagctaaattgtataataataataagattaaaatattattcactcgttacaacgcacggacatcttttctagtaaaataaaaattttaatttattacatttgttttatttttaaaatttatgtcaaaattttccgcactaattatttagtctcattagttacataaaatgcatatactatacactcaaacaaaaatttcattatttttcaaacttatttccaaacctaaatcatcaagggcattaaagacatgagccaccaaacttaacagtgaaatgatagaaaaatgtaacggcagggacatgaaaaggatcaagctgaaattttagaggtatataaatatgctcatatttccttatttgatctctctgtaaatagaagagttccctttcatacttcctatctatccatctaccgaaatacaaccacgttctcttattaatgagggatactttcgtcttttctctcaatgcaaatgtgaatcctgataattaagaataaaatttattttagaacaaaaatagtaataatccattacacctcccgaaatttcgcttgctcggctggatcctctgactcttccagtctccacgcccacagccgcaacaactggttaaaaagatccccgcgacgcgcacgcgacgcgacgaccacccagccacgcgcgacgcgccggaacagccgcgcccgccatggcgaaccccatcatcccgagcagcagcggcagcgacggggaggaggcgaggacgaagctcgggcggctgaacgcggcggtggaagcgttcgtgggtcgggcggcggttcaagctggcggcgcgcgggtcgacgttcaccacggagctccgcgccgggacgaccacgttcctcaccatggcctacatcctcgccgtcaacgcctccatcctctccgactccggcgccacctgcaccgccgacgactgcgacgcgccgtccccggcgtgcaggttcccgcccgtggaccccgggtacgccgcctgcgtggcccgcgcgcgccgcgacctgatcgtcgccacggcggcgtcgtcggttatcggctccttcatcatgggcaccttcgccaacctgcccatcgcgctcgcccccgggatgggcaccaatgcctacttcgcctacacggtcgtcgggttccatggctccggcacgctcccctaccgcaccgcgctcgccgccgtcttcctcgagggactcatcttcctcttcatctccctcgtcgggctgcgctccaagctcgccaagttcatccccaagcccgtccggatatcgtcgtcggcggggatcgggctcttcttggcgttcatcgggctgcagagcaacgaaggcgtgggcctcgtcgggttcagctcgtcgacgctcgtcacgctcggcgcgtgcccggcgtcgcagcgcgcgttcgtggcgccggtcgtgacgttccccaatggcacggtggcgctcattgcccggcggaacccgttttcggcgggatactcttgcttgttccggccggatgaccttcccgaccttttggcttgccgtcgtcggctttcttaataatcggctcttgcctcattaagaacgtcaaggccgcatgaactacgggattctctttgtgaacttcattttctggccggcaacaccggccgtacggggttcccggcaaccccgcggcgaccagaggtttggtatttcaagaaggtgttggagtggaccgatccaatccaccgccgggcgctttaatttcgggagccggtcacgctttctttggaagcggtctttacgttctgtccgggacattcttacaccaccgggggttttcttctatggaggttccccgtttttgacaaccacggggaatttagggaaaattctcctttatttcacccacgacacattttgtgtttctgtgtgaacttcccggacgggttaatttgttttacggggaaaggggggggggagaggttgtggcgctccccggggctatatttgggggtggtttaacaccctctgtggataacaccgggagagggcccctctttgtttttgtatataatatccgcggggaggatattaaaaaaaaagagnggnggtttacacggggtgtggccctctctcgtgcgtgtgggggttctctctctgacg

SEQ ID NO: 66593 - DNA, 21145 bp, Oryza sativa
atgattccattcgcctctcactggtacagtcgttcatcatatttgtactactaccactattagcagtaatagaaatgtggaggggtatattgtaacaaaaaatgtataaaagggtataatcatcattagcagtaactaaactttttccctcttttttggctttttcgatgaaatatatttagccgggaaaaaacatatataaatgacaaagtaaatcataattattggattagtaaattactattttacctataataatatactggtagtataatattataggtagagagcaccgaaacatcactcaattttctttatttcgaccctagtattaagttgtagtactaccaggtttgtgagattagacacccctgctcctcctgaagcaaaattgacacccttcagatatacggagctgttcattggtttgctgcttatagagaggtatggaggagggctgggcaccccgagactgatagctgcaatgtggaaaaaaggttaaaaaaaaagacaacaaaaagagatatatatatatatatataaacacacacacaccaacgaaatttttttttgagtagagataaagcaaaaataatgtcaagtttcaaaagatctatctatcttctattttattttatatactaaaagtccatgaaacttcctacaaacgctctcaagctgccacgtggtgcttctaaaaacgctccaaagtcgccacgtggcgtattgataaatcctaaaaattctaagtaaaaaacaaaacatctaaccgttgattttcttttaatcgggtagacccattattttcaaccattagatctattttacaaaattaccaaatcaaccaccgttagatctatcttgcgagtacaaaattaccaaatcaatttatctctcttaaattatccctcggtccgtgtacctgtacagcatgtacgtttgtacgtacgtatcatcccaccctacttctttttctatttttttcttttttatttagattagatgaaaaacgaaaataaataattcaagtccattcacaaccattgattttccataaaacatggtggactaattagatttttgttattaaacaattgaaaggcccacgtgtgccacgtcctcccttccatcatgtacatgcgtacttagtacatacatgtatatatcggtccctctacccattcggttccctctctctatgatgtattattagccatcaaatcgtattcacaatggttgtgtagagcctcacacattatatataaaacgttcccaaatgaattatctatcacataatgcaaatatattggagtatacaaacccatcaatttaccatagccttatgtcccatataatccatttattaataaataatgaaaatctataccaatcttacttgcttattgataatttttttttaaaaaaagttgacacatagggtgtaatgatgtcactatttgtcatatcatacatttgaacttaaaataatatttgtataaaataaaacaaaagtgtaaaatgaaccaattctagaaaaccttataatttcttagaaccattgtggttcataactttcccttaaattgagataaccatgcataaccacttcatcatttttaagtgactacatatcaatagacttctctctgttctatgccatagcagaagatagttggctttgaatattatatttcttactattaaatttgggttttaacactcgggttgactaaatgtatttaaacaaatatatagatcacacatattataggaagcgaggtctagaatatatctactctatatttttattgattcatacataagtacgtataaaaaattgcatcaattgtgaaccaattaaaagaaggaataaaacacatttattataaataacctttttgagaattttttttaaataagagcccaaaacatttaattaaaaataaaaacaacaccttactttaatttggattaagacctacgtcttcttaaatgataaagatgattaactttatagataggtgcttatatagatgaatcaaatttacatattgtaaactaacaaatatcttaaaagaaacatttaagcaatgattcatgaatgcccgcgcgaatgcgcgagctaccatcctagttgtgagaataacaatcagtcagtgctggatcggacctgccaacatgttcatattggcgtacaaattaaacggagggggctcagatctggttttcccaaacctcgagctctctactatttgattcaaacaattcgtccggaagattccattaattttagacttaagttccagtatatatgcaaccccatgtccggaagtttcattttaatttcataaactcgaactctctgtcattaaataattcctactaagctggattttctgatctaagcgttgcacaagcgctttcccttttgggttgcctctgcagcttaggagggtgcctgcgaaaatcccattttactgtttgtatatttcaatattatatactccctccgtattttaattttaatgtatgacgccattgactttttaactaacgtttgaccattcgtcttattcaaatttgttatgcaaatacaaaaatacttatgttaggcttaaagaacatttgatgataaatcaagtcacaataaaataaatgataattacataatttttttgaattagacgaaaggtcaaacgtttgttaaaaagttaacggtgtcatacattaaaatacagagggagtaacacttttaatacaatacataaatatcggtaaaacacatatgcatatgcacatgaatacatttggtgataactgaaaaactaaaaaaaaaaaaaccatactctcgtcaacataggggctgattgaaacgctagctactgcagtgctaggctgtggccgtttttagttgctgtcgcctgcacgctgctgtaatagcaagcactaccgaaaacacctattgtgttaggtgaccattgcttattcatggaataagccaaacggcatatttaaaaacgaaaagtaatttatgaataaaacttttatatacgtattcttatcgatttaaaagcaaagtctagcaaataaactttgatgaaaaacctcaaaatcaacttcaaatttaagattgaaaatttaaattttagctgataagtataagtataaacgaaaagatgaggcacttagatttgcaatcatgcttaaacattctaggacgacacatatcctccacgtagggtgcgagcgtccatagcacatgaaaacagtttgacataaaaatacgctgtggacaatggccgtacgtacgtgtacgcagcgatcgatcgatgatgatggatatatactcaccgattaaatcgacgaagttgtagccattgctgaacctgccggtgggctttccccccgggtagtcgatgccattgtgagggaagttggccttgagcagcgagtgcagcaggtagttgttgttccctacgtctgcctgcgagtctccgagcacgtagatcgccgggacagcgccgcgcgcgcacgttaggcagcaagcagccaaacacaggaggacgacgacgacgcagacgccgccggaggacaatgtgcaagaacccatcgtcgctcgctcgctccttcgttcacagcgggtgtgcatgcatgtgtatgctgaagctaagctactagctagcctgccctattgaagctatactacacatagttaatttttcctctgattcccctttactttcggcatgttatttaatttagaacttccctattttgtttggctctagccaagcaagcgctctgcgcggtggcgaagttaatcgattagcggtggcgaagttttacggtgcctaaccatgcatggtttgcttaagagcaagggtcttcgtagttttcttaagagcaggtacattagtcaggcgacactaagtccacgtagatagcaatggtgatatagggaaaagagctaaagagagagaacatgcatgagctggcgcgagcggacgacaattttatcatcgggctgcaacacgcatctctagataaaaacgttggacgtgagagagtgagagaaatgctgctatgcaaaaattgcaacataggatcgatgctgcaattttttaatagtgatgtgaagcatataggacccaacaatacaactagatgttgcgtgtacaagctgcaaagtaagttatagatgagttggacataattggagctaaattaccttattattgatcatgctctaagaattatagatcttgcgaaagtagtacatacatgcaggcactgacacaagagatcatttataatgatcataccgtatgctcagggcgttcacagtgtgccagaagaatttggcctgcctcacgtgccatgggctaaaaccacaccttaaaaaaaattgtctcccacaatgcatgggtctctatgtgtggcttcgtttttttgttttagcccctcatattttctattttagccctttctatttctctattaacaagatggcacctctcccttccctctccatcaccggttcttctcccctccctccctgttgacgacacctctccctcccctccccatcgccgacacctgtggcgatgagtagatcggggtgaccgccgaccagatcggggtagtggcgtagtgcacgggctacgaggtccccacggtggcttgggcctacgccgctgctgagcttcgcccctcggaatccggcggcggctcgtgccgacgaggcctgcaaggctatgtgcctctcctccatcttttgtcttctcttctttctccggttagcggcggctggaaaggtaggcccctcttcccccatctcgctgttgctgccccttttgttctcttaccggagttgggtgaggtacccgcggtggcttgtgggagtgggggtgtgccgtgtgggggccggacagcatcgcaggtccaatgcagactctatcccgtcgctccgcccatcacgcggcctcacctaacacgaggttcgcgcgtcatagtttggtagcacgttcctcgcaggagcgcagcagtggcgagaacgtggcagtccaaatctctgttggcgtctcgagggctgaacgtcacggtgatgcagtgtgaacgccctcacccggggaataatagtgccttgctatttttatagcaaccgcctggatgtctatgggtgagctagagtgttggtgcatccgaatacaccaaaaagtttacagcctagttatttcacattcgacaaaaaaaattggtaaaaatcgtatcaaattttcagccaccgaatgggctatacgatctatgcatgttgtattgggtaaaaatcagaggacattgcgcgaggtgagggtcaaactgacaaccgcaggcagcccccactaagccagcacaacttttgaattttttagggacgtaagtacatgcgaattatattataattacaccataattatatatatatatatttatcgtagttatatttgatatatttttagagggatttttgcgttgaatgttagatcgattatcccaaaaatatcagctatcaaaatatatttttgactcaatatatatattactaataaacgtactataattaactagctaatgaatggccttgagatatacactcaccgagtaagtcgacgaagttgtagccattgctgaacctgccggtgggcttgccccccgggtagtcgacgccattgtgagggtagttggccttgagcagcgacgccggcaggtagttgttgttccctacgtccgcctgcgagtcgcccagcacgtacagcgcctcgactgcgccgcgcgcgcacgtagttaggcagcaagccaaagccatcaggagggccacgcatgactgtttcagtgcgcaccaggaggaagaagaagaagcagccatggccatggctagctagttcacagcgtcagcgtcacggacccacgtactccggtgttttgaatagtcgggtaagacatttagcgatgagtctgctcctatccagatatcgaaaaccctcggctcactcactgtcaccggaggagtggtgaaatgtgaatgaaactgagggcttacatttatagcctgttctaattggtacgcacgaagacgcgctagctagctgtccaaattacctatgccaacttaattataattggaggtgtagtgggctcgtattgatatcctggaaacatgcatgcatggatgctcctgagtcctgattaactgcagacattggcgtactgtcacgtactccctccgtttcaaaatatttgacactgttaactttttagcacatgtttgaccgttcgtcttattcaaaaatttttgtgaaatatgtaaacctatatgtgtacatgaaagtatatttaacaataaagcaaatgatatgaaaagaataaataattacttaaatttttttaataagacgaatggtcaaacacgtacttaaaaaaagtcaacggtgtcaaatattttgaaacgaagggagtaataaccagcacgtacatgcatgtcacgcgttctgatcattattatacgttgtacctaaagaagaaggtgcaacaaaattagactaagataatctttgcatcacatcagcagtactatgagcgagcaaatttaatacaaatggaaagtgctcggatcagcttatctgcacgactaatccggaaatgccctgttcccagcacatgtcgcgaatccatccgtgatccttttgctctcacgattttggaacaaaaaaactatttgtccgtttcacaatgtaagtcattttagttttttccatatttatattggtgctaatgaatctagatagatatatatgtctagattcatcaacatcaatataaatatggaaaatgttagaatgacttacattgtgaaacggagggagtaattaaggttccgaaaatgctatacgtccaaccgacgcgtacgaccagcgcacgactacgtcattggccgtccgccgtccgtaacttctgcaacgatcgctaattcaattgggcttgcgccgtgtatttcgccgttgagtcgtacgctggtcggacgtatagcagcgttgttaaggttcatacattgactttttgaaatgtgggctgttagctagctgtttgctaattataccacgcgtgccataataatacactcaatgatttaataaaattgtgctaattaagggcttaaggctcactgatgatctgcatcttaattactaagcagggccatgtgcgatatgttgactccgataagcattcggttactgagatcaccgccagatcgaggcatgcatgcatgcgatggcagctgatcatagagcatggccaaaattcggaagatggtcatgaagataatgtgttacaccctcgctaattagcttgatggaaacctagctaattagtgtttgccgtggaaattttctaagatactccctttattttaaattgatctatatatagttttttaggttattcctaaattatcattatatttatgtgcattcattaagcctattcgttggagtatttgtgcattaatattggagtaaatggacattgatacatgtatccatgcacacaagtatttataacccacatgcaatatcttgatttgctattgaatagaaaataatgggatggtgtatgcatcgagcttgtttttagagtaaatatagtatgagagagttattagtttttcttggttttggtgtacctatgaaatatgtagatcaatttagaatggagggagggagtaatgtgttacacactcgccgagcgaggattaattgatttgctaggtagttagacggcttgactgccatgttgtcagcttatttactaaatcattcaattaattagttgctcaaaaatacatttcccaaaaaaaacttattccattgtatagtaagaccacttatttcattattttattattttctaaaaatatctaatttatccctataatgaaatatgtaatccacagaaataatccagtcaccaatccattttaaatttatagacttcgatgtaacctatttcttagatcaactatgtacaagatagaaggctagaaacttttgagataatatagcttatcaaaaaaaaacagagagaaagctagcaataatactgtcgacgtttgatgtcgcggttctggtatttacatagtatgaggatcgttgttagtaggatatatgcgagactgaggtaaacgagacggagatagagatttttatataggttcgggtccctgaattatcaggtaataacccaacatcctgttggccgaaaccggtcgttgctctttattcaccataatcacaccagtacaatatttggggtagcctatctaactgttgtcgacatggcggtctgaagttctgactcgtagtcgacaacagggtagtcttccttctcgaatccgtgcccggcgagatcagagatagcgcttccgtctctcctgacagtatccagagacaccgtaggggactagtcgtgcttatccctgaagtcgatatccggcgtcttgtcttggcgtatgttggcttgtatgttgatcttgtgtcttgatctattattccgtagattgtggtgggtgttgattgaggtggtcgtcgattgtccgtgtcccctctcctcctagggggccttgtatttattcccataggtgttcccttgtccaagtagaactaggaaaagcaatatgtatataatccgagcagtccttgtcgtttccatgtagaacactggttgtctttccttatccggaactccctttatatccgaagtcagtttccgtataagacatggtatgtggtgggtcctgccgagatttagtcgactactattaggtatgtggtatccataaccatgacagtagcccccgacttcaatgcaaatgaacgaattcatattctcgaccgctgaccatggagtaactgttatcgagctcaagtgaccgttctcggtgagttcagagataacgttagacttcctttatcagcctcgtgcgggcacctaaagggtttgtcttgagtcaatctccgacgtcaaccaagaaagtacataacatacgactaagtctcccgtcttgctgtaatcgagaatttggattgaagtcaaaaagttttatctcggcgggtacaccatctctttattccgtattccttgtcgagatccagcaaccgttctcgagcgatcgagaaggcgtagagtctgcgacggagccttgtcaacatttgtcgtactcgccttagtcgatcttggtgtagaaccatagagacatggagttttccacaatgtcgaatagaattttccagaaatcaatactcagaaaagaatatcaaatagaaatagcccccgagcaaacgctcaaatggtgacatgttataatttgtatggaaaactaaaaatgaattaaatttaccgaccaatgttttatatatgagcgtcttctctcttaccgactttgatcagtcagtttgtagagtcatacactctccctagcccccagccttgtcgtcggagaatcgttctcggaggacaaggctcttggacccttgacctgccttggttgaacaagcactgatcctagcccccagctgtgaagttggaaaactcaatttccgattacacggcttggttaatacgcacggcgagaactcttatacgaccagatcttacttggtcttttgtctctacaggatccgacaaggccttatcggctctgggcgtccccagccgaagttcccttaggttcctcggaggccttgtcaagacggcgtaaagggacagtaggataggtttcaacactaggtgtcgtcgtggtaagggatctctgggtaaaacacttagcattattgtgtacctgatatcaacttttgttgaggtagaggtaataggagaatcgttacacctctggtcgaggaccaggtagtagccccaactcgaccacttgaagtaaaggtagtgggagaatcactacaccactggtcgaggaccaggtagtagtcgtatcttgaccacttaaagtggaagtagtgggagaaacgctacaccgctggtcgaggaccaggtagtagtcgtaaattgaccactagaagtaaatgtacgagatatcgctacgattaactggttgagaaccagtgagtaggtgtctctcgatcatttggagtcgtggtacgaggaccgctacgctgtcggtcgaagatcagtcgtagctgttcctcaaccatctgaagttaagatgcgagagattgctacgttttactagttcgagaaatagcgagcgagtagaattatctcttgaacaccaatggaagttgcggtgtgagagattgctacgtactggttcgagaaccagcgagcgagtagaattatctctcgaacaccaatggaagttgcggtgtgagagattgctacgtactggttcgagagccagcgagcgagtagaattatctctcgaacaccaatggaagtttccggtgcgagagattgctacgtactggttcgagagccagtgagcgagtagaattatctctcgaacaccaatggaagtttcggtgctagagattgctacgtactggttcgagaactagtgagcgagtagaattatctctcgaacaccaatggaagtttcggtgcgagagattgctacgtactggttcgagaactagtgagcaagtagaattatctctcgaacaccaatggaaattgcggtgcgagagattgctacgtactggttcgagagccagcgagcgagtagaattatctctcgaacaccaatggaagtttgcggtgcgagagattgctacgtactggttcgagaaccagtgagtgagtagaattatctctcgaacaccaatggaagtttcggtgcgagagattgctacgtattggttcgagaaccagggagcaagtagaattatctctcgaacaccaatgaaaattgtggtgcgagagattgctatgtactggttcgagagccagcgagtgagtagaattatctctcgaacaccaatgaaagtttgcggtgcgagagattgctacatactggttggagaaccagtgagcgagtagaattatctctcgaacaccaatggaagtttcggtgcgagagattgctacgtaatgattcgagaaccagggagcgagtagaattatatctcgaacaccaatgtaagttgcggtgcgagagattgctgtgtactggttcgagaaccagcgagcgagtagaattatctctcgaacaccaatggaagtgctagagttgttttattacatgtgtatctcatgtggccagcatgactcacatacccaacttataacatatctggatgtccgttcgcaatcatgtcaggtgatcaagccgacgacgttcgcgaggaattatccgttaacaaccttttctcgagtagtccagccatggccggtgctatgaggtaggtcgtcggtcttcgttggtaggttgggcgcgacaactccgcatttatcgagaatgctctcgatagtgggatgtactcgaccacaacctactcgagtgctcaattgttcctgaaaaatattttctagaaggcaagacatatagcagagaatatcgagtatgtacttaaaaaactgcatgggtcttctagtattatcaggatataacgagcagattaaatatcaatcattatgtaaaccgtaagtaagcatgatttatacataagaaaatagagcgagcccccagcgttaaaccgcagtcgatttaacatcggaaacactcgcacagcagatattgtataaaagacatgctgtaggtaaacataataaattatagatctgacaatatcgtatagattggaaaaagtaggtatgataaattggatataaattattgcgtacctttgtagatacatgccaaatgtatttacgaaattagtagattaatttaaaaaatcaatccactaattaccttgattagcgcgctgatatgttcctgtgtacttgggtaaagtttcgattcgtctctgagtacacgactgtgtatagagtcgctttgacttttccagcgtggcatgtatctggtgtccgtgtgcatgtaggaccaatacaggccgtatacgtacacgatacagatatttggatcaggcgcatatgaaatccaaccgacatacatggatgcatttgtctcggtagaaatcgatatcgcgcatagaggaagtcggccttcgtatgaatccaaggagtacagcgccgtgtagaccttagtctgaatcaaaccaacacgtctgtgcctgcgaggacatccgtcagcttccagaacagtcccatattggatcggtcaccaatgctgccagtatcgttcgtcctccacgacggcgataatttcgatctcgtcggaagacatactccggtcggatttgatcttccccacagtgaagtcgtcgagtagtttattgttggagaattcatctcttgaacccatctcttcaaaatcctgaagcaccaaaatcctcctacttggcgcgccactgtcgatgtttgatgtcgcagttctggtatttgcatagtatggggatcgttggtactaggatatacgcaagactgaggtaaaagagatagagatagagatttttatacaggttcgggcccctgaattgtcaggtaataaccctacaccctgttggccgaagccggtcgttgctctttatttaccataatcacaccagtacaatatttggggtagcctatctaactgttgtcgacatggctgtctaaagttctgactcgtagtcgacaacagggtagtcttcctcctcgaatccgtgcccggcgagatcagagatagcacttccgtctctcctgacagtatccggagacaccgtaggggactagccgtgcttatccctaaagtcgatatccggcgtcttgtcttggcgtatgttggcttgtatgttgatcttgtgtctagatctattgttccgtagattgtggtaggtgttgattgaggtggtcgtcgattgtccgtgtcccctctcctcctagggggccttgtatttatacccataggtgttcccttgtccaagtagaactaggaaaagcaatatggatacaatccgagtagtccttgtcgtttccatgtagaactctggttgtctttccttatccggaactccctccatatccgaagtcagtttccgtataagacgtggtatgtggtgggtcctgccgagatttagttgactactattaggtatgtggtatccataaccatgacaaatacactaagtgaggccagttgttctaaaaaaagtgaggccagttataggtatatttgttggcaactttttgtgccaagtcgacaagcatgatcgcaacacctaaacgccttgcggtgatatggagtcgccaaccacctcgatctagccaaagggccaaatcaagatggatttcgtagaaaaacagctaaaccggctaacggagccgatttagagatcaaaatcagcctctaggccgatttagatcgataagaggataactacccgtctcgtgggcaaaacgggacaaacctacaaagaagtgtcgcactctcgtagcgacggcggacgatttacggcgcaaaccgacaaagatggactaaactagggtaaaatagaaaaacatggtaaaagaacgattcaagtatattgtattcgggggttttacagtgaaccggccttgtcccttaaataagggttggtcttgccctctacaggcccttctccacgcccaactcgggatagaaaccaaaggaaacacgaaacatgccttctcgagcaatgaaacccgagacccgacgacaatagactctgactcggaccctgccggtctgaccgcccacatacttgaggtcagaccggccctactagccggtcagaccgcccacacacctgtgttctgaccgtccctgtgaaggaaacccgtcactttccaaactttggcaattttcccctatttcgtccataggtgccaaatttgggtgtaaacacgtgccccccgcctttttggtgatcatatgtgaacctaaacgcatagaatatgttgtctcagggtgataatccaattaccggccataggacttcctaatcatcttgtcaaatgctcgggaagtatttcttcaagtatttcccattaattgatctctgaaaacaccgtcttgaagtgtcttcatctcgttcaaagtcttcaaacgctcgtgatgacatcttcaaaaattgcttcccatcaaggtcgtataatcttcaaccgacaactcgtcttacttgaaataccgaagagagccaagatttacctcaactggcgaaacggcaatttcaacaatgttttattactcgacttggcttatccattagcctgagagtaagaacttaacaacttaatatcataagattgaccaatgaaatctaaagcccaacctccgaacggctatgatttgataataggattcaatacagcgataggcgctaattgaacattgccgatccgttaacaagcttcactccctctataacatttgaaacaatcatcaattactttcggccaatgaaaccccactctcctaagcaaccaatttatcttacgggccgattgatgaatttcacaaatcccttcatgtactactctcctagcaactttagattgatcattatccaagtaatactacatttatttttcggcgatataatatttgagcgcttgccgccgaatcttccgatcaatcccaagactaggatcattgaaatattctattcaaagtgattctccaatctatttcttacttatgggcacaaatgtccgaattcacaattaatccggtctttaaatcaattgtaacgtgccccccagctctctgcccaggatcggtcagaccagacacgcaatgccggtcagacctcactgtctacccggtcagactggccatgcagagccggtcagaccggccgtgcaatgccggtcagaccacctctgtctatgactttgccaatttcgtccaaacttttgaaatcaagcatcggcctttagtatataatttttcttcacataatagccagatgcttggtgtatcaaattattggaccgaaattccttctctctagacatatgaaaaaatataacatccaactaacatgtctagttgaatactaattcaaatggcttttgaaacaataatcatcatggcatcaaaacacttagccaattcaataatgaatcaccaaagtcatatgcctcacagacatgaattccaataaactacaaatgtaagtaatcggcttgagcatgtatgcaaaatattaacaatgccaatgtttctaaagaaaacaactctagaataaatcatcacattgaccattgacattagccgaattactaataagcaaaacttccatggtacaataattataaaatctatatcttatatggtgatccataaaaacacatacaatttgactttaaataaatatcaaagactcataagccaaatcatacttcaaacaaattatatgccaacctaccaatttcactacttagaactggtatttgcaacatgtatgtataatatcaatttgataagcaaacacatgtgctagatagtaagcaatgttctaacatgacataggtaaataatatgatgatgaacacaataaacccataccttgccttagcatccaacaaaatgcggctcaaagatgtgatgttgtatccatcgctgttcatcttctcttggtttcttcacgagcatagtaatgtcttgccccccaagcaaaatcggctttctcgactgcacgattttgaaggcaagacgaacaccgcaccaacatccatagcatcatgtgaaggagacttatctctaatgaccgatgattcttctctcatcaaattggatttatcactactactatgggaaatcaccggtctcttaacttttacttctttaggtctccatacttgcctaggtgctgtttgaggctctaaattattgcatgtcttgttctccgcatcttcggcctccttttctttttgacctatggcccgaagacgctgtagcctcctcttttgagagcgagataagccataaggtatccacttcggctgtggttgttttccaggagctaagcaatgattcttgatattttttgtcgaagtggaagctcatgtattgctttcaattttcccactcttctctaatgcccctcggtcagaccggcctctaggcccggtcagaccggccataagccgtcggtcagaccggccagtaaggtcggtcaggccggccgtagactggcgattagaccggccagctgtctcggttagaccaccaattttgacagtcacggcgtcggcttcgatctcctttgcttgcgtggtttccaccgcatctccagtaggtacatgaacatcttgagactcctctttgatagcaacgacctccggagttttggcttctttcctcacccacaccttttacacttttttcacctttgatccaccggaccgattcttttgtgggaaacggtcttgtcttgggttagatgaatgatttgacactgtcctaggtgattccttccatccttgataatacggcataggtggttgaggcatccatagcatataatacataaaaggataaccatatagtgacattgaatatggataccatggcatcacaaccggaggtttgtatggagttggtatagttgatggctccgattgctttgatgtttgaccaaatctcttcctacgagatgatcttggtctttttgaatcactaatttgattatcaaatcgctgaccggctaatcctttcttgaacttagcgataagcatctcaaaagtgagcttcggctttttggtcttttgggaactagattgtcgcgaccgagaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacttcttctccaaagcttctcttactgaaggggggaaagattgagcaagaatgagtacaaccacagtactcagcaagtcacaccggagatgcataattaatgcaagggggtacaaggggataataatatcggggttaagttttgcagtaaacagcatttaaaagtcacttagttgcccaaagccattttataaaggcgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccacattttagttattaagcaggttttaagaatttaaaacactaacttgggtacattgctaggcttgcccataaccgagggcgcggctattcgaataggttatactctgatcagaggtgtacatctttacccacaagacacgtcttcctcacgtgcaaccacgtgccacataccaccacggcatatggacggaagacatgacatagtttccaacccatcctagccatagacaagagtaccgacccaacctacctacggccggaacccccagacaggcaggcagaattgagcccctagcagcaggacaccagccctgtgccatgacatctcgactaccgggccgcagcccgtgtagccttcatttgtcctagagatgtccatcgacccccggcttcatccatctccatccgtgtacttttgtttataaccagactgagccacaaactaagccttacccactagacatgtggaagtacggtagtgctttgcaacagaggcccgaagaccggtccttaggtggccgaggtgctactaacaaaaccatgcaccccgagcccagcctaaaaccattttgagggttttgaatagagggggaggtatgcatccaattccacaataatctaaccattccataatgtccaagtgatatgaatattcccaaagtctagagttatgaaaccacctaatgttgcctaattaatcagcgaagcatctacctaaattcatactagtggaaccatgaatagagtgcccactagttggggttttgtttattctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcagagagaacggccttccgaaccttcggcaacgaccgcaaaccacgcttcgggaacctccggaacgacagaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttatatggagatttgcggattattataattaggctttgcaaccataaaacatatgtaagcgctagcctggaaaagacaggaaggctgcgccattgacatgcggaccccacatgtcaacctaaaggaccgcggtagaccgggtacacagagacggtccacgggtcgacggaagcggaccccgtgtgtcaaccgaggcgagtggccgacaaacggactccactagacaccacacgggttgcacacgtggaaaccacgcggctaccgagcggacacactaacacggtcaccacacgcacaagcgaacgactgccgacaccgatacacgggtaccggggccgacaaccgcacaacgggcacgggcgacacctaaaggacgaggacggggcagcgagggagagggatccttaccaccacgcgacgaggcgtgggaacgacaacgacgaacgggcgaggcggagacggacggcgagggaacgacttcggcggcgatccttggacgaaggcgagacgcggccggcacaaggcttgacgacgcggaggcgaggacgaagacgacgacggggctgcagcggcacacttgacggacgcggacgagacggacgagaatggcttgacggagggacgaacgccatgacgaccgggaacgacgagaggacgacgaccggaaccggcgaggaggcgacgagggcagccggcggcagctgcacggagacgaggacggcgcggaacacgccgctgcgatgccgacgacggaggcggcgccgcgagacgacgagccggcgaggatgaacgggcggccgaagggacgtcggcgacgatgaggatggagaggccagcacgggcgacggcgttccggcgaaacaaaggagcagctggaggagaggacaacgcggcgacgtcgatcggtgtaccggcgacgtacaggagccggccggaggcggggagatactggacgccgacgaggaggccactccggcaagcttcgggcgaggaggaggtgatgccggggatgagggcagcgtcgcggagccgagggaggtggcgacgacgacggctgccgcaccgacgagggacagtagccggctggagggagtacagtggcaccaatgccactggttgccggcgggggcaccgttccggcgagtttccggcgaggagacggtgagaccggtgaaggggacggtgttgcagagccgaggaaggcgacggcacggccggacggcgcgcgggcgaggcgggagaggcggctggaggcggccggcggcacgggagagagaggaggacggcggggagaggtggggaggccacgggagagcgcgggagggggctaaaacgagagaacggggcgagggggttccattttataggagaggagagggagccggccatgggggaggtcggaacggcggtggaaaaggcggccggcggccatggaagttggccggagttggcgcgggcgttcccggcgattgggggcacgattcaagggggaaattgggggcaattgaagaggattcaatggggattaaaaccccccaattaatttggaaagagccggcttgaatcgcgtggatttaggggaggaaacgacgctaggtttcacgggagagagaagagagagaggatgccgggcgggaggaggacgacgacctggcgcgtgggccccacgcgggcgcgcggcgtcagcgcgcgtgcgacgcgcgtgcacgcgggaaggaggggcggctcgggcagggggcggcttgggccgggcggccggcccaggaagagaggaggtagatgctgcccgggggatagagggaggaggagggagtgggccgttatggggaggagatgcccaccagactcattgtaatagaggtatgacttggctactttctattacattcatacacacaaagtgtactgtgttccagattagttccacacatgcattgaagattgatggaatttaatgttattaattgactgatttgataagaagatgtgcgtaactatggattctagatcgttaaatgttctgattggttttgaatatcttctttattttcaatgtgaaagttattatatttttttcttacacattttgattatttttttgcgtctcttacgggctgctaatttcttttccatttctcattaaaattattgttcttttctaacacccactaatatttcgattatgacctaatttaacccggaccatagttgtttcttgctttataactaaatatagctgtgagcataaaatttatttttttttttttttggtcaaccaaactgaattattttattatacactacttgttatagcgcttcgttacccataccgggagacgttaacttaccgttttggcattcggctcacacaaaaacccaattttcttctttgtgaccctttcgtgttaacctacatatactccatcccgttttctgtattcacctttcatttatttaatctcttttaccc

SEQ ID NO: 66594 - DNA, 3846 bp, Oryza sativa
taattcatgattcagctgattaatctggtcatatagtttctaaacgcatttcatgaatcatgaataacaaaatgatcccgattccgataattttgctttataagtacattttactgattagtgatctaatactagtatattttttcttgtagtaccgaatggctgggttggctgctattgagattgcccagaaagtttccaaagcatggcgctttctgagaaatccaaagaacaatgcaaagttagttaggagaagggataagcttaacgcgtgccagaacaggggagggtattgcagcacaagtactttgtctggatcaccaacatccagtccaaatgaagacaggatttcctctggaatttctctctcctggcatgatgtctataatattgctgttaaatggagacaaatttctgaaccttgtgacccagttgtttggatcaataagctaaggtgagttaatttctggtgaaaagaattaattattgaatcattcttattttttcaatcattctcatgcttacaaattttattttgtcaatcattctcttgcttaaattttctggtaccagtgaagagttcaattctggatttggttctcataccccgatgcttctaggccaagcaaaaataattcgttactatccatattaccaaaggttaggaaatgaccactatctttttactttgacgtgtggcaatttgcagtgggtcagtaatggtctgggtcagtaatggtcttaacttgttttgtataacatggcagtgttttggaagctgcaaagaatatcatgcttgacttgaaatatgtcaataatgcggaggatcgtgcaatcttccttacagatattgaaaagttgaagaaggtaagttggtaagttatacaataggctgttgaatgtcatagctcatgcatgagtcatgacatatcaatgtttcttttgcacctagagtaagtttatacaatacaattccaagccctaagaggaacaaagggaaagttctagcattccacattggagttgaggaaagtttccaaaagggcattcagggtgatgtagcatttgtataatatgctatattagtatttctcattacatatatctaatataagttacataagcagtggtatcaagcagatgtgaaggatgggcttcattttgatgaatttctgtgttcaacagcactttgattgattctagcatattttctttgttgcatcattttccttcttccaatagatagcatgaagcttaatgtgttattttctcatgataattaaacctgcagatagaagttgcatcgtcgtgctcggagttgtaccatatagttggtgagacctactgggtctctactagatgcgacagcattgcatttcaggggtaaataccttttacttgctcggatatttactaggatgtgtttgttgttctcccatgtgaaactgcagcaaagtacttacaaacagtgttgcactacccttgtgcttatttaataacaaagtttgggctctttcaggaggcgtcttgaagggacaagaattaccactcaaaacatgtaagttgcttaatcagttctctttgttttgctacaccctcctgctttcctgcttacttgtatcatgatggcatcgcaggggcaagacaggattcgactttgcaatacgaacaccttgtacaccatcaaggtgggaggaatatgatgaagaaatgtctgcagcttgggaggtacagttagatttattgtactgtaactttgttggttatggtctcttgagtttacacggtatcggggaaggttctctaaggaagagcttagaaaccatgacatgcttttaaatttattgttgtacactgttgaattacattatggggagccttggaacttcacatgagttgcaatagaaagagttgatgctgcagcagacaacttgtgtttaggtttctgtaatatttacagtttcagacaaactaatagctctgtgatctgcaggccatttgcgaggcatattgtagtgacacgaacccgacgcgtgaccctgatatgcttgatgctgtgaaggcagcaatattgcgtatgacatattactggtacttactgcaacctcttctctttccctctctctctctctctcctcccgtaaaagatacgacaattgcttttgtggggtgctgcaggtacaacttcatgccgctttcaagaggttcagctgtcgttggttacgtggtgttgcttggcttatttctggcagcaaacatggatgtcactgctagcatccctcatggggttcaggtagattgggaggccattctgtctcaagatcctgacacatttgttgataaaatcaagccctggctgtatccatcaataaaaacaagcaggaacctgaaagactatgcagatgtcagcgtggcattcagcaccacaggatcggttgtagcggccttaacttgtgttgacacatgagtttgatattgatttcagcggatactataggttggctgaattgttagcgtctttgtttcaccataatacccccatgaactgttaaaacagctttgtctagattgtcgagcatttttcggtttgctacagtttttcagttgcttcatagagctgtatacctgtatgttgtaatgctgtttgtttgacacaataatgtcattctttttcccttgaacgatggctttgtaataataattaccaataattcatgaaaacgtttgacaaacggagcttgtttcttatgctatgggtggttcagatttagccttgtttcttcatggattcgcaattttggtttgagatttcgggcctatctgtcagtcctgatagtattatccccttgccaagaaggtggaatttgtttttgtcaaaagaactgttcagattcagtgaaggattgttcgactcctgggcatattagttcaaactgaaaatattacgttcgaaagttcagtctccctgctttcaactatttgccacttttagatttagcaattaactatttgccatacctatctcaatgatatgtgggttcacatgtgtctatgacatatgggtccagtggcaaataattaattgccacatctaaaagttcaatatgattcaaacgtggcctgctacggcccagtttggataggcccgttatgattcaaacgtgggcctctgtgcggcccaagtttggataggcccattgggtttcgacctactttctttaaatggcgacacgaacaccgataaatttcgcaaaccccccctccgccgagccgaaacccaaaatgccgccgcctccgcctcctcctcctccgatgggcgacggcgaggtcgagagagccggcatggaaacagacggcggaggagaggatcgcatcagcgcgctcccagacgatctcctctgctccatcctcctccgcctcggctccacccccgccgccggccagaccagcctcctctcccgccgctggcgccgcctcccctccaagctccccaggctgctcttccccttcccctccaccccgccctgcgtcggccccgggatcgccgccaacaccgccccggtccttcgccacgtcgacgtcgtctgctgcgactcccccgccggagccaccgccacctggctccacctcctcgcgccccgcctcgcccacgacggcgtcgtctacttcaggaacaccatgtcccggaggcgcctcatggcccctcaccgcggccttggcctcgcctccccctccccgaccttcgagctcccctgcttcgccaccgccgccaagctgtggctccgcctcgagttcctcaacctggagctcccccgatccggcgtcttcgcccacctcaccgagatg

SEQ ID NO: 66595 - DNA, 11608 bp, Oryza sativa
ggtcattcgaccggtcacagaccggttgagtgcattgcacaccgcattaaatgcggcgtggcgcgatgactcgggccgccataaatgcgggtaggtgggcacctggaggcggacacttaacccaccgtacatggtgacctagagaggatgtcgggggagcccgacccctagtcatgggagggggcggccgccgcccgacctcgggcccgatcccccctcggggaagggccacgtggcgcctggggcagccttctccctctagtctcggccagggagtggccgccgccccacctcgggcctgactcccctcgggggagggccgcgtggcatcggggggcagcctcctccatccagtctctaggaaggagtggccgccaccccacctcgggcttgattcgccccctcgggggagggccacgtggcctcggagggcagccttctccgactagtctttgggaaggagtggccgccaccccacctcgggcctaactcccctccgggaagggccacgtggcatccgggggcagcctcctccgactagtctttgggaaggagtggccaccaccccacctcgggcctgactcccctccagggagggccacgtggcatcgaggggcggcctcctccctctagaactgatacccccgggcccatatcaccgatagtagcccccggcgttagccctgaccaaaacttttcccaggtggtcaaggttgacgccactctcctagtgtgatgatatgttggcccggtctcttcttctttctttgctggcactaggacccatgcacctttttcgccccagcctgagggcgactcgccagctcgtaccttaggctgtgaacttattttctgtatatattcagcaaacgttgttagattctctcgggcccgcgacctcatgtcgcgtacctcgcttgcccctgcctcttgttaacctctgttcgtgttctacttcatctattcaaccgattattttagcgtgagtgtgaggactgaactttccatagctagcaatcttcacccgcgatcaagctaagctgggcaccgtagccagctgacggggccaaagccagccgctacggaagagttagcacaaggggccccaggcgtcgacggtacccaaagctcgatgcagggctaggatagagctaggaatcgtagccaccacacttgtagcaaaaaatcgtttggatggataaagagaatacaaactttttgttaccaagggaggcaagccagcgcgtgacacatgggtaccgcgggaccgcgaggaagagatgagagataaatataagcaataataattctatgcaaatgattatcttcgcacgagtgcgaggactaaattttccatagccaacaatcttcacccacgatcaagccaagctaggcgctgtagccagccggcggggccaaagccagtcgctacggaagagccagcatagggggccctagacgtggacggcgcccagagctcgtcgcagggctaggatggagctaggaatcgtagccccccacacttatagcaaagaatcgcttgtacgaatgaagcaaacacaaaccttgcttgcatgtcgtgacctttcaaaccgttagctcgaagagggcctcccaccatgggttcctaaccatttgggaagcttgcgaccacttagcaaacgctgcgaccacttagcaaacgaggtcaggttcccatgagcctacgtccccacgctacacattctgttcgctctttcctttcggtggcctccttccaatctcttttcctcccacatggacgattacttccgcacgagtgtgagagccgaaaaactccagagccagcaatccccgtccacagttgagccgggccaggcaccgtggccagccggtgggaccaaagccagctgctacgaaagagccagcacagggggtccctggcttcgacggcacccagggctcaacttaaggctaggataaggctagaaaacttagcccctacacttagtgatgaatcgttcatgtagatgggagaggggttgggctcttaccaccgagggagcaaacaaatgcgcaacacgcgagcgtcgcagggccatgagagtagaatggggggaaatcaaatataagatttcaagctgatgaattgaaaaattgaaaatacttgaaacttgacaggatgattagttgagctaggccgggcaccgtagccagccggcgggaccaaagctagccgctgcggaagagccagcacagggggtcccgggcttcgacggcacccggagctcaactgcaagagtcctcctaggagtagaccgaggcaagcagcaggttcatgagccaaccccgcgcttggcccctaagggccatgggaaagaagctcgccatgacctgatcatcgtgcagatctagagggactcggaggggttgacaccgccgttgtacttctcagtgaggctaggccagaactttgggggctatcggacattccgaagactcgccataaaagcctggccgctggccttttccgatgaggatgtggggggcctagccccctgcctagggtggcgcgacactcctgaggaggctgcgccttcccctgcattggcgccgtgacgctcgtcacgccggcgctcgaaacaacctcaaaaatcacgaacgcgccccctacctggcgcgccagatgtcggagaatgaactcctccaccagggaaccgtgaggcccccctttgtgagttcggctgggggcagcgggtgagattcgagggcttggtgagtgaagctgtgtcatcttgagggagttatccccctccaagatgatgagacaaaaagagtttatacaggttcgggccgctgagaagcgtaataccctactcctgtgcttagctgatcttgtgagaaattacaagatcttcttgttggggtagaaggtgttgatcatcaggggctccagcctcccctcctactaggcctggacctccttttatatcttaaggggttaccacatgggccaaaaaacacaacttagtggagaaggattacaatctttgcattaaatgcatgtcttatctcttgacttgggaagcaagcgcacgtcatcttgatgacgaggcctgtcaaatcttgccgcctgacacggggggtgcccctgtcagtcaccatttaatgggtggggacttctgggctcctattacaccgggaaacgggagccttgctttgaccagagcgggagaaccgactttggctgggataagaggatgagaacctctcaccatcattatttgatgggacatgtcaggctgcacgtcgcctgacacacgagcagtgcacaggcgcactaccccagtcccatcggtcattcgaccggtcacagaccggttgagtgcattgcacaccgcattaaatgcggcgtggcgcgattactcgggccgccataaatgcgggtaggtgggcacctggaggcggacacttaacccaccgtacatggtgacctagagaggatgtcgggggagcccgacccctagtcatgggagggggcgcccgccgcccgacctcgggcccgatcccccctcgggggagggccatgtggcgcttggggcagccttctccctctagtctcggccagggagtggccgccgccccacctcgggcctgactcccctcaggggagggccacgtggcatcggggggcagcctcctccatctaatctctaggaaggagtggccgccaccccacctcgggcctgattccccccccctcgggggagggccacgtggcctcggagggcagcctcctccgactagtctttgggaaggagtggccgccaccccacctcgggcctaactcccctccggggagggccacgtggcatcggggggcagcctcctccgactagtctttgggaaggagtggccgccaccccacctcgggcctgactcccctccggggagggccacgtgcggcctcctccctctagaactgataccccccggcccacatcaccgatattattatttgttttgttataactcgatttatcattaaaggtaatttaaatataacttacattttcacatattttaaaaaatgaataaggcaaatggttaaatatgagtaaaaactaacagtgttatatattaaaagttggatggagatgcagctgacagtctgcagttgaccactggtgtgaactttgtagtagtactactattactactaataataatatgtgcttaatacattgctttttgatgtatggaaactgcaagtttaacatgcagaagattgccggccgtgtcataatttatataatcaaatataatctactaattaagcatgggtcatgatgggtatgggtgtgtctaccatcattcattttcaggtggtccatgtgtgactgtgattctgtggacattgtcacatgtgttagcgagttgtaattttctttctaaaaaatgttagtctcacgtttcgctttcactataaacagggctaatgacattcgatcttaagaaaatgttagtctcaaattgctacgtccatgaggctttactcaagcctgtactatacaatacttagcttatactgtacatagtttcggaggataattcctaagttccaaatgttaagcaacctcttccaagagaaaatttagagaaaatttacagtgcgatataatttcttagggaaaagatagaggggagtttgcgtattaattagaggtcctagaaagcaagatcctagatgtatacgttttcggacggaaaaaagaaaaaaggataaagttgattcccatatgaaacatcaaagttgtttcatgtacaattcttacatcagaagttactaagggcatgtttcgaggaacttcaagcagctacaaattctctttaaatcaaacatttgagatttttgctcagattataagaagtcaaaagctaggttttctagcttttcaaattctcaccagctgcttctcagaattttagactcattccaaaacagacctaactatatatgtctggctttgtatcctttgtatctttgtgttatcacatacatcaaactttcattacaaaatgaatgatgcaagtgattttttttctagaggatgattcatgttccaaatccaatggtgcatatttagatgtcatattgtttcacctataaccgattataaacggttacacttattagcgaaaaaaaaggaaaataaagtgataaaaaccttcaatccatttcacattggagtctgaacaactgaacctgcatctgaggacctaggatcattctgtaatccattatgatatcaggggctttaggggaaaaaataactaatctatccaaacgcaccaaagcgccctgcttcctttccccacacacaaaaaaaaaaatccgcaacagaaaaaaaagaggaaaaagagaggggcccatgtgtcaaagttacaccctaataagtataaaaaaaagaggaaaaaaaacaaaccgcaacagaaaaaaccgaaaaagagaggggcccatgtgctaaagttaccacacaacacaagtgagagagagaaaacgagtaactaatccctccctcctctcacaaattcacaaatccatcctcgcctcgcctcccacctctcgttcccctccccttccccggcgaccggccgccgccgccgcgcgccgccgtcatggggtcggagcgcgcggagctggcgagggtatgcggggggcgcaactggtccaaggccatccgcatcctcgacgcgcacctcgcccgctccccgtcctccatccacgacctctggttagtactaatgtctctagtaatctctcgctcgccgatccgcgggatctctgatctggtctagggtttgtgacgcggattcgtgcctctctctcgcagcaaccgggccttctgctactcccagctcgagctccacaagcacgtcgtcaaggattgcgaccgcgcgctggagctggacccggcgctgctccaggcctacgtgctcaaaggtttccgtcctcctctgcttcccttgcggtttcctccttcattatggattgccgctactacaactcatcatattcgttagctggttcgtattggattcatagcattgatttgttctgttactagtgtagtgtttaatcaaaaaaaatattttctggtttcttgattgaagaacttattacttagttatttttgggatggatggagtaggtcataagctcaagtatcttggatgaatgttctttgcttcttgaatggaacaaagacacgcctttggttagcagtacaaggttaagttggactgctgaattgaagttgatctctgaccaaaaatatcttctttcaaccaaatgatatgagtggaaaaatctgtctctctctagccagcttgagtatctttgtgtcttctggtctctctggatcaacttttcagtgatgagaaagaccgcatctttactgacaaatccattaaggccttaacttattatgaacaaagtaatgaaagcgtgccatcctaaacaagtaatagctataatgttccaggaaaccagggtgttgagaacttgagcttatctgaacttttgattcatgagcgagctagcattgaatgcccttttatctacttctaatatagaaagtttaaccctccttgcaaatgctaatgtttatgttgaagtgacaataatttctggtgtagtgcaagctagctttgaaatgccattttaccattctgcggtagttcttttcttttactttagaatgggcaagtgaagtttctttgtaaaccttgttgtagactcctgcaagggtatcatagctaacttttgaagataaaatctagtctttaggagtatatcaagatttcatttggttcatatatatgcccttaatttcacagtacaagtatctgcagatagctaacaagacttatttgacatatgctgatagttttatgttttgtttaagtgcattttactgtaaagaacatttatttttaatagatgagcatgaagcatgcccctgataactgcttgttgtgcctgtctggtagggctcatggacccatgaatattggagttcagtgttctcatcagcgcatgcaactgatagaaaaatgtagtgtgagtgcgtgactatattgttattaggtatagttcaatgattattatttattctatcaagtaccttgggagtgaataatgatgaccaggcagggcccgtggatttgatatgagtctgcattatatatgctttctttcatttctgaatttttcttttcttcatgctagtatctttacgtgtgatccaagaacacctgaatgaaaaaaaaaaatctgcaatgagacttacctagacagtgacccatcttttctataaccagatactcctttattgaggcaaatgcctctagcaaactttgtatgatgatatatatttttggttcaggcaaggcattgtctgcattagggaaaagagaggaagctttggctgtttgggagcaaggacatgaggttgctgttcgtgatacaatggacctgaaacaattgcttgagttggaagaattggtttcctctgttaaaatctgtgagacgatcgagtgtgaagaccgtgtcgtggatgcatcaccatgtgataccaaagttgttatatccgaagatcgtgttgttgacacatcatgcactgcaactacaatggctgatacaaaaactgttgtttgtgaagaaaacatcgggaactctggagttatatcgaatggtgctgtgatattggctaatgataataaagcggacaacaataaagaatgcagcagtccaacaaaagatacaacagggacacatcatactcccaagaaaacaacaaagccagataagaaaagcaaagcaaaaggtagaaaagaaataaacagccaaatcgaagatgtggcagatagcataagttccggtgaaactgtagcagtagatcaaacactatttgcttcaaaaatatcaaaatcatcaaaatccataagcttggatttccgcctttccagaggcattgcacaggtacattccatttgttataattctgactatcggtttatcaaatagtatggcttcggttagtatgtactactctcagtaaacatttgaataaccatgttcagatggcacattttgcatttaaaacaattgcatttttttaccctagaaacaatcgttagagtttgacagcctgatgttcaaggttctaaaagtatctaggaggatatgttatactcaatagtctgactattatctctgcacaatacatattcaggtgaatgaaggaaggtatgaccaagcaatatccatttttgatcaggtatttgtctaatatcagttttttttgggcgtatttgttgtaattggaaagggagctgaaattttgcttgtgatctctttagatactgcgagaaactccaacatatccagaggcactgattggaagaggaacagcttatgcatttcaaagagaattggattctgctatttctgacttcaccaaggttgaacttttatatgcttaactctttcctttcaagttgtgtaaaaatgaccttgtggccttttcttgatggcaggctatacaatcaaacccatcagctggtgaggcatggaagcggcggggacaagctcgtgctgctttaggagagttcaccgaggcaagctcgctgtagttgtcacaatatcaacactaacatggattcaatattgagaaaagcagtaggggttatctaaactcattaattctgttcttttcaggctgttgaagacttgactaaagcattggaatttgaaccaaattctcctgatattttacatgaaagaggttagtttctttaccgatggttgaatctcacttcgcatttacgcttgattcgtgcaccctagtaataaagccatatgtctagactgcaagagcatactgcctactcttgtattctgatagcatatccttgtggtaggaattgtgaacttcaaattcaaggactacaatgcggcagtggaagatctctcaacatgcgtgaagcgtgacaagaaaaacagttctgcacacacctacttagtaagtaaatgggtttccactgaaaaatctgttttctcctgctaggtttggttacccacaaacttcaagttctctcatccaataaccatatggaaatattttccttatgcaccaaaacagcactttattccacttttccaccatttttgatacaataattttgggattatccattggatttcttctgtagggactctgccacttaagtaattaacacaggatttgtaatttgactaagttaacttgcatgctaaaaatatgttaaggttggaattaaccatcttaaatgacatacaacatttaggaaatttgccatgtatttgcagagtattaatcttcttattgcttcagggactaactctttcggcacttggggagtacaaacgtgctgaagatgagcatctccttggcataaaatatgatgagaacttccttgacagttgggctcacctatctcaggtgagttctgttgtcttatggacgtgcaattccatgtcttatagtttcttctgtcaagttatcttttgtacacattttcattcatgttaatatttctatacacatacttgtgtcaagtaactgatatttggctacttgggtgtcttgtgtggtagctttaccttgatataggttgtccagagaagatgttgaataatgttgagaaagttcttcaaattgatgtcaggtaaatttcatgtatttggtattccttctttcatctacgtgattggcttatttatttatttgcccatttatgtatttttcttgattgcttctagctttggaaaagcataccatctacgtggaattctctaccatggaatgggtagacataggtaaccctttctgctgttgcttatttcccatggtataataacatgaattctgtaccatggaatgagtagacatatgctacctctctacatctacatttttatgtccacacttattttcatttacttctttttcctgtctaagtcatacatctatgacatattttcatcatttattcataattgttaggtccctttagtttagtgggcatactgttttatgtcgatgtgattactgataatgaatttccaagcgtagttactctcctgttagtgccatagtatttggtgtctagtttattagttaatggccccaagattaatggggcatacagaccataaatgtgatctagttacgtagaagctgccatatttaatacttgtaaacttttacatgatcttgagttctgggtttcctgttttattaccaacttaagctagaaccagaaaatgtcttggttcatattctactttagcctatttctatgcgtcttctgtaaattttacgatatgcatctggaaatttggttctcaactcaaatgtaacatatatttacttgtttgccctcccacattgattgcttttattggcttgggcaagtgctgtctgtcctagttcctgtctcaaacttgtatcttctaagctccccttaaagctaattttggttttgcaggagtgctatcaaagatctgtcggttgctttaaaacatgagagttcaaatatagagtgcctatacttgcgtgcctcttgtcatcatgcgattggagagtacaaggccgcggtatgttactgtttaatttagtgaaccggcaaatgctaatttaaactttattagggatgataatgattgtgactgctctaaagctatcattctgccatcagttgcatgactgcatctatgtctattttgtcatctatactagtatatactactacattttgcgcttttttaacaaaaaaaatcctttttcctttgaagatcaaagattatgatgatgtcctcgacttggagcttgactccatggataaatttgtgctacaatgtttggccttctatcaggtacataatttattccctttcaattgctttttccatggagcttgttccttatgccaataccatgaattccctggtctaaagatctgaaatccattcgaggagatgaaaaggaatataggcattgcatcccactacgactagagtatcaaccctttctttcgccttagaaatccacagaaagtttttaaagctacaggctatccataattaacgagcttataactacagtattagatacctatatttcattaggaatgcaaatctcacatcgagtccaaaacttactgtgattgttaagttatcttataattttgcaaacggggccaaagttttctttacataactattgttgatctctcgcaacaactagcactagcatgatgcataatcaaaacttttgtctgtttgcctcagatcaagcagctttatttgaacacaagcacttctttatcttggagtcttggactcccgggttctctactaactaacattatcttctgttctatatctggggtcatgtcattgtttcttttgctactaaccctggttttcttgcctgatattccttgcagaaggaaatcgctctgtatactgcttcaaaggccaattcagagatctctcagtttaacattgatgatgatgttgacc

SEQ ID NO: 66596 - DNA, 5959 bp, Oryza sativa
ggcaccggctgcccacgcagagctgcagcgtgcccggccgcggctcggcgccgccggcgagcgcgcgggacggcggcgtccactgcacccccattgcgacggtgagcccggcgccggagcggaggcggcggccgtggcgccaccgcgtggagaacacccaccggcgcgccacggcggggcgcgcggtcacggtggcgacgacgcggctggcgccgacgcgcacgacgtaggtgtcgtgcttcgtctccgagcgtcggaggcgcgccgacacggtggtcttctgccggcgcgcggcggttctcgccctcttggcggccgtgtcgccggccggcgcgtctcccggcctcttgccggccatggcgcgcgcggcgaagaggacgccaagagacgtcgcttggtttcgcaggcaggcaactgaacaagaacgagaaccaaacacactgaagaagaaatggttagagacagagtgtgtcacaaactcacaattcacaccaccattataaactccataattacgtgtaaataactggcgataactaccccattaaccccactacgcccagaattatgcggcggtaaatttgttcgccggttgctgcatgcaaaactaccacaaggattatctattaaaaaaaaaaaactaccacaaggatatcaatcaaactggagtggctgccaaagaaaacagggttgccagaacaccagttgcgtctgtgatcactgaatagaaacaagtgaaacaaattgtgctcatcatcacaggttcatagcagttggccaattccaaattagtactatcaagcaagcaatttatatagatattagcagaatcaacatatgttcatccaacaagagtatgaaaatctgggactggcatataaaactcatcatcacaacttcatattaccaccaagcaatccctgcagcagcattgtatgtttttaggcatcatataagaagaaggatctgaaatccagtagtagcatatactacaagaaagattaaagatgacatgaacaaaattcacctaagaagataaccaaattggccaaagccaaaatcacctccatcacaaaacataaggagcagatataaatccttcctaactaaaatcccttgcttatcatcagtatcagcaatgaaatgtgggtagaaaataactagtagaaccctccacttgtatcataatctaaaagctcctcctcatcctcatcgtaccaatcatcttctacatacccgccctcctcgacatcgtcgaacgcctgactgttcccctcaaatgcttcatacccaccaccaccctcatcgacagtgaccgtgccggctccggtgacaatgtcatcttcctccaactcctcaagcgtggccactccatttctgacaaacatttcttcagtgccagccatgtcgtagttctcaacagtcagaattccaatgctgctgtgctcgttgtagctctgaacagtcagaattccgatgctgccagtgttgccattgtagtcatcgtcgtcgtcgatgtcgatgttgagagctcccatccccaggacgaagtcttcatagccatcctcatcgtccgacgagagcagtccatggccgacgagctcgaagtcatctgaagagaagacatggtcatctgaagcatagcttgatgagtggatcatggagaggccatcgtcgtcttcctcctcaatgtccgagtccgacgcggcgacgcgtgggcgcacgttgtccgtgatcttgctgctgtactctgactctgacgcgtcgtcgtccacggcggttgctaccagcgcccagtgcgtctgagcagcagcgggctcggcgcgcgcaaccgcacggtacaccggtggcgccacacgggcgcgcacgggagcgtggcgagcgggccgtggcgcgggggcggcgagcacggcgaccgcgcggaccgagaggcaaagggtggtggtagacgggcgcgcgcggagcgggcggcggcggcggcggggcgcggaggacgggctggcgcgcgggcgcggggcagagatggacggcgaggcggaaggcgaggtaggcgtcgacgcaggcgtactcaacctgttcgatggaaaggtagggcgcgtgccaggcgctcatggagacgttcgtgggcttggcgatgccggggtagccgaggaagcgatcggccatggcctccatggaggcgttgcccatggcagccacggcgcgcagctcgcgggcggacgcgacgtggaggtcgtagtaggcggagagcatgcggcggtcgttggaggcgccggagccgacgaatgtgatgcgggggtcggcgaggaagcggcggagggcggcggggatggcgtcggcgtgggcgaggtggaagacgaggcagcggtggccgacgcagagctggagggtggccggtggcgggggaggggagccgcggtggagcgggcgtcgaaggggggtccactggacgccgaggccgacgaggagccgcccggaccgaagaagccggtggtggagccagcgcgtggtgtggacccagcggcgggcgtaggccgggtgggcggtgacgagggcgatgacgcggcggtcggcgacgtggacggtgtaggcggcgtgggtctgggtggagcggcggaggcgggtggagacgcgggtggcggcggcgtccatggcggcggcggcgggaggaggggagatgggcgagggttttgggtgtcgtcttctccgcgtctgcgtggttaagttgcgaaaacctcgtggttaggcggtttcgctaactcgcttcatcatcacatacttggatatgagattttttggttcatttttggcacgcttttagatccaagattcattatggatttagatttaataaagttttactattttttttctctaaatagagacagcatggttcatccaaaacttatgaaagtaattttagatctagttaaattatctttggatttggaaatataccaaatagatacataaaatgatttaaaagatatttatgctactcttaattagagattgtttggttatccagaattaacgtggaagtcattaatacatactatccatgaagcattgagaattttacgatcttcctattggtataattgaggattttgtggtttcacgccttgctggaatataagctagtgtcatatgagacgtaaagtcttaatcatatcggtatcgtataaataacttaattatcaaatagattatcatattctcttatattcagtgacggagctaggtttggaggagaggaggggctcagccttcttcttcctctttcagcccccccctctctctccccctattttcttcatcctctccctctttccccccctcccgcccccacgctggctccgccgctgcttatattaggtcaaaatttaccaaatagacgctaaaaatgatttaaaagatatttacgctactaaatagagattgtttggttatccagatttaaagatatttacgctaatcctaggaagcatggttcataatatcgataaactatttttggttaatttcgaatgaattttgacaagttttaaatgaaattcattaactctcaataatcgagatgcacatttcgagtcggatcaagatgatagtcgaggttgtgaaaggtacaccctagaatggagctagtcattaaaataggttatccacaaaggttgagaatttccgagacatgtttgcaattgaggactcattgagtccttttctcatactccgtataatggccttgttcatacgtggctcttatcccgtaagtcaggtataaattcccagttatcagtttcaccagaaagaaattcaattatcatttgtcaattagattacggaattttcttagtattagctcaatttttcagtgttcatgaaaataataaatcacgttctgatgttcatgtctatcaaaataccggggaaggcgcaaggctcatcgtacgaatgctacgacaacattttaccaaagcacattgcggcttacaactgtaattaatctgctagtctttttttttttgttcttttcttttgaaaactagagcacgtacaccggtacacgtatgcacgacaatacaagtgtattcccttttttatacatcttgacattttagataataatgatatggtgtccaaaatctatttatgactatgtttttaaatatatttttatttttgctatagtactttgtaagacaaatctatataaattgttctagttactttaaactaaacatttttgaaagggagtagctatatttatggcgccatatttttcactaaaaaatagtcggtatgcatttacattgtaagtccataaattacatatgtaattttagtgtatttacaatgtaagttttaaaattacatatgtaagtcaaaaaattacatatgtaattttagtgtatttaccatgtaagtctcaaattacatatgtaagtagatataaatagaagagatgctagtgcaaattcaatgggaaactaatgtataataggagcaacatgttcgtagtacagagagatcaaataactagagacttagcaaatcaaacgttcgttaagtcaagcattaacagtgcaacacgaatctacatgatatccaagggtcaaattaaccgactgtgatcaagctaattttgtgtcgccataaatatagcattgtccattttgaaattattgatagttataagagtttcaccctattttttaaaaaacattgctttttcaccgaaattaaatggagctagctggttagctgcgccctgagtgtcatcttctgtatatgacgaaaaggagtcgggctttttataaggggaactgttttaatccctcgaggggatatcctatcgttctttgcatgtcacttaaatggttatgaaaaaatttgaaaaaaattggaaaggtgtattaacatttgatataacactttacaaacatgcaagttcaaattcaactttacatctcgtaacaaaaaaaaacaaattgaaccggagctagttaacgtatattcagagtcaaatttgttttttttcgttgcaagatgtagaagtagaatttttacttgcatgtttgtggagtgatatatcacatattaatacatcttcttaatttttttttaatttttttcataaccatttaagtgatatgcaaacaacgaggggattcccctcgagggattaaaatcctcttccttttataaggcctttgtttgtggaggcctcgatcctagaaggaaaaagtacaccgaaggtctctcaacttgtcatcgagttacaaaattgtccttcaaccgcaaaaccagatatcggacatccctcaattaacaaaaccattcgcttgatgtctttcggtggtgttgaccccggttttgtccgacatggcagctgagtcaacagcgggacccacgtgagccccacatgtcatactatccacgtcattcttctcttttcccttcttcagcaggtaggcaacgccgacggggccgagacgggtggcagtgcgaagctaagcagggggcgggcgccaccggagttgggctgcgacggggcaccaacagcagccgccgccgccgcgctcgcctgccacacgctcgcctgctgccaccgcgctcgcctgccagacgctcgcctgctgcgctcgctgccacacggacggcgatagcaggagcggcgagtacgccgccgcggctagcttcttggccccgtccctcggcggcgggatagccttcacgatgagccaagtcggcgtcggcgccttgatctggtggctgtggtggtggtgaagcgccgccatggacatcaatcgatgggggcaaggtcgacggcgacggaggcgttcttgcggagggagcaggcgaggaggagcgggtaggaggacaggtcgtcggtggagaggcggaggacgaattcgagctgctcctggagcacctcgagggaggaggggagctcgac

SEQ ID NO: 66597 - DNA, 7851 bp, Oryza sativa
cccagcattttttgcacggtatggatagcgcaaagttgtagtgaggccattcatctgtatatacatgagcacctggcatgcactgccaccacatacacaatttccatcccaatgattgcaatccaatatttgttattcagacaaagattgtaatgttctagtttacatgaagtgcacagactcaacactaccgacaacagcaaacagaccgcaagtagctgcaaattcagaaagttagtggcaagactgttatttagtgcacataatattgtcatattaaaacgagtattaaattaagaagtagtagtatgtatggtttgttcacaatgatatatgcctagtttataaagaagcaaagcaaaattctttccacttttcatttttaactctaagtgaactcactttcatttttaactctaagtgaactctcatatttctatgcacattaatccacaaacacactaaaacaaacagtgatatggcatgtttttctatggacaacttcaatgttgtaaagttttcaactaatcttgattttcatgaaatgaaattataattcttatagaagtattgcgaccttagttatttgtggatcaaacatgttgtatgtttttaactaatctatatctcctatggagatgctgatatcttgtgttgttgaacaacaaacttctcttagtgagtggaacatgtaaatggtaattatatactaatttctcaaaaaaatatgatcccctagaaagcaccctcttagtgagtggaacatgaaaatggtaattatatatattaatttcccaaaaaatatgaacccctataaagcaccccttgggggttatttataggtttacaatccgagtttccaaccctaggattggtggccttttacctttttttttttacctttgatgagatatttacagagatatttttttctttagccctcttaattggcccatcggccttaatgtattaccctttagtagcttaactaataataatatctaaaatgcatgcaacatttactcaagcataactcaatgccctttgctactagacaatccaatagacagatgcaaatgggcatttatatgaacttgtactactatatgcaatatagctaatatgtgattcttgcatcacaggagggaactgttttttatgataaacaatcaacttcatccatctcccaaatagacaaatcggcaatagtaatattaactgacctgtttgcttgcacgatttctacttggtctccctgccattgaatcaaactttgatgcattgttgatggaatgcaacaattagcatgaatccaataccttccaagcaacaagctatatgatcactttccatcaatgatagaaaattgtaggaatagtcttgctccccactgttaactccacatttaatactcccttggcatctgatcaattcccaccaaaatccttgagtactatgttggtcttgctcaaatcttctggtgtcttctcaagcttccgataagtggtatatggcatcaaatttactggaactcttccatcaaccaacatctttgacaacggcttcccattgacaaagcccttaatatacaaaggcctaagatgttgatgcttagtttcttcaggcttctcaaatattgcttgttgaggtgacaacactaactacgccattgatacttcaacaacctcctcatcggatgtggaaactttatattctgcaggcaaaataaaaaccatgtttatagaggacgaagttcctgcattatcaatcttgacaattgtaatcttcacacgccactccttccttggactattcagttgatgactaatttcttcctccacttcttgcatctgctacctattcctcaatctttgaactcttcttttttgatttttagtagaagtttcactaggacaccattgaggttactgccctttctcttcatgttcttcctcttcatattcaaaataatcttcatggatcggatccaattgctaatgaactggaagcttcttttgaatcagttgatgtgaacttttcatctcatatcggcgagaagaattctcctggtcataagctatctctccaccactgcaacccgaaaaatcttcggtaacctcatccccttattccaacaaaacctgaagaactcacagtcccaatgtgggtcaaaacaatatctatcatcttcatagtagttcttttcttgcctcttctgatatttgttgatcaaacttgttgagctaaccttggtccgatgaattaccctgttattttttccttcagatcttcagggatgaaccatatttaatggaaaaagatgtccatcgatcttcatcgactttttactatcatcaaatttgactttcctttgttctatagctgattgtatctgttgtctgaagactttgcgctcattagtatgatgagatcctgtattgtgccacttgcaatattttctccttttcaactcctcgactgatggattcatgtgattctgaggcaacacgatctgtttctcttgcaatagaagatcaaatatcctattggctttgttgatgtcaaaatcaaatatttcctcatttccaatatctttaacccattgaccaacaactgtcatttttatcctcgcccattctatcaagctaatatctggatcttcatcttgatctgagtcagaagcctaattccatacattgttaacattgttggcctttttagtaaatttttctgtcaaagacttctggaagcgttgtttaagagccgatactttttgtactaaatgagccaagctttcaaaagcaaatgaagaaaatttgtctttaatcggcccccaacaattcctcaaattagccaactgtgaatcaattaaactcggagtataacatctactccttatatctctgaatctatgaataaaatctggcactgattcatcagatctttgcttgatcgaagtcaaatatgatagcttcatctcctggactccagcaaagaaatactccccctattcacttttgatcatcatattttcaaaaaaaatcatatttgatcgtcatattaggtggggctatggcagaaatgcttcgtacgatgcatcgcatgtgtgccttgctgcttcattgatagaaattttgtttaagcatttaatgcagtcacaaccaaatatgatgataaaaaattaaccccccgagggggggtacttgtgaaactgcttttccaaatcgacccaacctctgatagaattaggtggtaacgacgaaaaccatgtaaacggcgatctagataaagacaatggaaagaaatggtgtgagatcagttaagacaacaaaagaaaaaaatgtaagaaaaaatattggaaactcaagacaggccatgacaaacctagagtatatgcattatgagtttgcaatcctctacataagataaatctggttggcaagcattcagtttcctcccataactgaagctataaaacaacacccaaatactcaaggttaattaactaatatggcaataaagcagcaaaagtaaaataataggaacaatagtgaacaaagaagctgcacagcagcaatagttgtcacatggtatgcaccgtgcatagcaaaatagggggcattgcaggggacaaaggagagagaagttgacaagaaaatttgttggacaacaaatattagccagtcaatctagcagcaatcatgttctaactcgtcttcccttcaatgagaatgaatcttcaaaaaaaaaagcttgctccatatccctattccttaaaatcatcgtatggctctatcggacagcaaaagcatatcaacgatacagagcagaacacaaagaatgaggggacacgaagaaaatatgcagagagaggtaaagaacattcctcgttaggtggaggaagcagtaacgtggtgggtactgataaccttagcaaagtcaacccgtcgaccctcgctgccattagccaggcagaagcgaccaactaccgccacgagaacctcgcagcgaagatagaactccatggcaccagattaagtctcaactctgatctctggtagcacgccaccagatcgaagagttgtacattggattggccattgagctctgctccaacggatcgaccccctcgctgtcgtgttggagcacctcgaaaggcaggaggcggcgatgtttgggtggcaagagggagattgagaggagatgagggtgggaagaaagacggtgaccatcgttaggtgccgtgggaaggcaggtttttcgatttctctcctcaactggaatgagcaagcctagcctattactataaaacaaagtgtaaattgcagcacatagatttttttattttttggaacggattgagtacctcagaagcctagtggtgaactggtgatggatgttccatcatgattagcaaggccctgatgaaaatttcaatcgcacaataaaatcaatcagtgcctttgcattgggaatttgggggtgacatgacactataggagaaggcggcttactccttcacgcaggatcttcatggcgaatgagctgagcaattgaagtggcattgcttctcccctctgactgatcaatggaagatgagattgatttagagaccgagtttggttaacgacacgaccacgccgaattcatcaggcaagcaaatcatatatgcaactgagggataccgaaatccaacaggagactagggaaactcttttaaacactccatccatttcttgcatgtgaattaaatagttataaaaaattcaaaaaaataataagataaattaatatgtgactccacgaacattcaagttaaaattcaaactctatcccaagagacttgcgaggataacctacctgcgtcggtggagccaccgttggggacaggcagttggctgctccgccggccgccgacggcaaagctttgggcgcggcagcgccgcgtcggcgtcgagtcgatcgcgacgggacacgggagatcgatcggtttcttttgtgattttcccttttggtggaattgggctgggtttgacgtcgactcgatcgcgacgacacacggccacacgggagatcggttcttttgtgtagggatagaattgggccggattgatcggtgggccgatgattggcccttttgaaattctatcttaaggacagttgcggcccaccctggcaccctgcctcttttgaccgtagaatttctcttcttttattttttttgtgggggatgggcacaatttactttgcctctcatgtttggttcagctagattgtggctgtacagtcgtagtgctgcagctgttctagtaggaattcgcttgctaggttctgctgattgtgcaatgctgtcacaactagttatttcgaacatattcatacacaagtatcatatctgtcgatgacgagatatctatgttgattttattaatctcaaaatataccagtctaatttttcgaatgtggttataagaataaagtgtgtatgtgtgtttataggggtatgtgtgtacgtgttgtgagcgtctacatgggttatcatagtttctaagagaaaaaacatcatgcaccataattgagcctgtagaatttcttgcaaaatttctgtcactgttctcttttccactacaaggtgttagtctcgcttgcattgccgggcaaccttgtcgggccatgcatcgaccgatccttgcagctcacgcaatacgcacgattccatccatgtttctcttaattatattaatctctccaactaataattaattaattgttcatgcatgtgaaactcaaagccagaaagcgaccatgtgtgtatatgtgcatgtgaacagtgaacacatcattcgtttggcattattattagtaagttaattacgtttctcgattcgatcacggatgaaaactaaaagtcgatcgatcgatcgatcgtgctctttatgaaagcagcacatatgttgatgcatggacgaagttgcatgcaactagctctatggcctatggtgaaataaggctggataatgtttcagacaaagaaatgcccttcttcaaagctgattgagaaaaacaccgggggttttcggctagctccacaagatggtgggctagacgatccgggttcgaagcctcacctcttttaatcatttgatattatttgatattagattcttccctaatattcacgaatcaaagctgatcgaaaggatgggattattcttgccttgatggcaacgaaactgtctttcttagtttcttttctccatgaaagaaagcacatcaagcatgcatgcagaatgtaattaattaattaattaattaaggaggccatcaatcatacaacctccagatataagacggatgatcgagatcatatacatcacacatgtacggctgcgacgattacagttgcagtgaatgatctggctgaaaccgatacttcggagacacaacaaactactcctttgtaagttaaacaattctaacttaaccatcatgttctaaaaatctatatatttttaactgattatgcttatacatccatcattagaaattcttttatgatatatagttcacatgttattaaatttttaaaatttgattattaaagttagaaatgtttaactaaaaacataaactaatttaagacgaaaggagggagtacactaatctccaaagttatcatgggttaattctagctctactgcttgtaatttttttttgaggtaacgggaaggagctctgccatctgattggtaatagatgcagcaaaagcaacttaattagcggtttacatattactgtttgttgctcgatgacaaagagatgagactgacactgactccgtgtttagctgccatgtgtgttttaacctttgtgttaattacttcatcgtaccaaaagtcaatagattagttggatgagtgcaacctacccccactagctgaaagccaaagtgtggtacggctagacagcagacagttggacaccagatgaaaatatatgacgatggcacctttattttccctatctacttctgtaaaaatgtaaattagtctcagagctctggaaactaaccaaataattaacctaccactagttaacgtttaaactctacaaagtcacaaagctgctgctagacggagcatattactacctccggttttcagtaggtaacaatgctaactttttaacacgtgttttattattcggcttattgaaatattacgctattattcttatttgtcggagaataaactcctccaccagggaaccgtgaggccccccctttgtgagttcggccgagggcagcgggtgagattcgagggcttggtgagcgaagctgtgtcatcttgaaggagttatccccctccaagatgatgagacaaaaggagtttatacaggttcgggccgctgaggagcgtaataccctactcctgcgcttagctgatcttgtgagaaattacaagatcttcttgttagggtagaaggtgttgatcatcaggggctccagcctcccctcctactaggtttggacctccttttatatcttaaggggttaccacatgggccaagaaacataacttagtggagaagtattacaatctttgcattaaatgcatgtcttgtctcttgacttgggaagcaagtgcacgtcatcttgatgacgaggcctgtcaaatcttgccgcctgacacggggggtgcccctgtcagtcaccatttaatgggtggggacttctgggctcctattacaccgggaaacgggagcctttctttgaccagagcgggagaaccgactttagctaggataagaggatgagaacctctcaccatcattatttgatgggacatgtca

SEQ ID NO: 66598 - DNA, 17023 bp, Oryza sativa
  unsure (1)..(17023): unsure at all n locations
cataacttaatctcaaacttgattctaattatatgtctaaattaaacatatagctagtagctagcatgtccagattcatctctagaattggactctttttgggatggagggagcacttatatataacaagactattgaatagtctcacattggttatgaaagggtaagagaccaaatatataagtggaagagcctctcacctaattgactagcttatgggtaggaaagaccctttacgattctacaattagtatcagagtctggctagttcaacgtatctgacccaagggacaaagtgtgtgaagacttgatggaccgtgggtgcctgcggggccagtatacctgaggaaccctgaggaaacggtgaaggggcgatgaacggttaagagacaccaatgtgtaaaaggggatattattgaatagtcccacgtgtgtgggaaagacccttaatgatggtgcaaagatatagaccctttacaatcttacaaagacatacgagaatatcaatatatacttgtctcaatatattctgaccattttgatgaactagctagtggccgtacgttcatatatacagtaataatctgatcttatatatgggttctggcaattggttccaccaattgtttaatatggttaaaaattcggtttataatattttgataatattaacgtgtggcgccgctcgatcggtggacgtgaggacaaagcgatcgacatccagaaaattaatctgagattccggataagagccggacctatcaactataattaaatggtcaatatatatatataacttagatcgatcgatcgcaattagggcactgaaacgtatttaggactggttttttttttttgggggggacggagggagtagtactattctttgtagccggtggcgttaattgctcataaaataccgtactaataattatcggctagtacgtacgttacgttagaatgaactgcaaatactcgatgctgtttggtccactggtctagtactgcatgcatgatttaatttaggttctgtttagatcacgtcctaaaactttacaccctatcatatcgaacgtttgaatatctgcatgaagtattaatatatgaaaaataataactaattacaaaaattgtgcgactaatttgcaagacgaatcttttaagcctaattgctccatgatttgacaatgtggtgctacagtaaacatttgctaataacggattaattaggcctaataaattcgtctcacgggttactgacaaaatcnntgtaatagtttttattaatgtccggacaccctatgcgataccctatataatacccgatgtgacacgctaaaactttacacctctggatctaaacattttttttaagcaggcacaatagtggagcgtaagccagctataacatatatcgagaagataaaagaagagggagatagcagcgggctacagatttgtagcgatcagcacggactctcagacgtaatgtgtgtatgacagatgagaccagatattaatattgcatatatatttatagataactattatattaattggctattaaattgactatagataatttgaagctagtagttggatgtaatattaaacttgctcttaattggtcccatgcttgtacgtatttgtagtaattaatataattactacagagatccagccagctagctagttagaggtccaaagatcgatgcaagatgacgagagactgaagtaatttatctcaaaatacaaacaagttagttctaattaaggttttgggtttgacagtttaatttcagaatgatattagtatatgaaaattaacagtggagtaaaattaagtgacgagcggtggacgctagcgagagctgatgtatatatgacaatgacaatgatttgagttgacttaagcgaaactaaacgatttgagttgaactatatctttgtccccaacttcaattaccggattgattaattaattatatgtgtaatactgtagagagctagctaatatactactactaggctactagctagttgataaatgcattagctgctatataaattatctagaataatgttagctacgtatacgtgctatatatatagccaatatgctattcaaacagtatctgaaaattgtaaaaatgaataaatttatgatagtagcagctatagctgagtagttgtgtgaacagaatgaagatcgacggtgcacatatatacttgcgttatttcactatcatgaccgctgtttcgcagtgaagaaaaagtaccgcgcgccagctataaccaattcaccttcgtcccttcttaaatatttagatatttttaagttgtttagcaaatattaattataagattggaaattccatctaaattatcttacttgttaaattttaaattttgtaattcctctcctaaacatctgattagctaaaagtgtttaattagatttccatgcattgaaattattttaattgaaaatatagggtatatataattgtagagatgacgtcgtctgcttgattttattaaccgcaataaaaaatttaaattagatagagatttattttatcatagtttattttcaagccttatcttttaattgaaccgtgctaataatatagatataaaagttctaattatatttttttcgttggttgtatattttactaatatacggttactcaaccaattgaaccagactatataaagaggctggattaactttcatcataaggaaatagagacaataatatgaataagtatttcttccgttctgaaacgatcaaacttaatacggaacgtaacacattctatattctagtattataaatctagacggtgtgtctatccatattaaaaatataaaatataccatatcatatattagatttatttattttacgacggagagaacgtatgagagaggagtgaaataaatgcagagaccacagctagctagctagcagctcactaacgacacaagggaggacactggagttgctactactacaaaataaaaaggctcatggggagcaaagcaagccaagcggtgttgattaaaatccagagaaattaattaagccaagcaagtgaagtgacctctctctctctctctctctctctctctctctctgctgcactactagctagctgctgctcctccggctggccggccggccggagtgtgccatggccatggcgggcgccggcgactggccgttcgccgccgacgaagcgtacgccgactcgtcggccatattcgccgagctcggctgggccaacgggctcgccgtcgtcgacgccgtgggggagctactgccgccgctggatccaccgggcgagctggccacgccgccgccgccgccgctggatctgccggagacgccggccgggtcctccgcggacggcgccgcgtcgtcgtgctccaccgacgacgccgacggcgggaagccggccgccgcgtccaccgaggcagcgtaagtacaataattaatcgcagttaatttgttgcaagagattaatttaatttactcgataaatcgcttgttatttccctccaaattatccaaattatggttctcttagcatactataaaattgaattgaattcgaaacaaggaactaattaatttaaaacttttcaagtctcttctatctccttttcagtttttcctctttttttttgctttgcattttgtttggatggagatgatttaacggtggccaattcgtttacgtggataattaattaattaatttacgcatttctccgaggggcaaaacggtaaaaaaagacgctactagcttctagccaagggagtgtgtttgtgtggttaatcttcttcgaacattgcgccgggattcgcgtgctaaacctccatcgcacatgtgcttataatttcctaattaatttaatgtgttcctcttaaattgaattgtcttgtctttatttacatatatatgctagcttttaggtgagcttatgttcattttttttgctagagataattaagtactggagtagtgtatatttttcagacacgtactacgtactctacatacgtgtatatatatatactctcaatctctcatattatatagcaaaaatctatgagtaccttggaagtgtttatgtttcattaatttatactactatttgccaattaatcgatcggtgcatgcatgtagcctagataatgcgcactagctacaaaaggaagtacgaatacgtacgtacgagtacgtgttggaattaggttgcgaattaaattgcaaaagaggtcgatctggtgagagaacaaacgtaattaattaattaattaagacaggatcatgaatatataggagtattaggcatcgagttaggacattttcattgcaagtcgtcagtaacataatttcttattgcctagctacttctacttgatggcttatagtagtagttttcttttcataacttttaaattctcgatctgaactatatacctttctgacggaaattctctacaatattaattttcatcgtgtggttatgtatgttcaggagcaagtcgctgacgcctgggaagaagagggcgcggcaaccgcggttcgcgttcatgacgaagagcgagatcgatcacctggaggatggctatcgctggagaaagtatggccagaaagccgtcaagaacagtccttttccaaggtgcctacctacattttatacatataaattcatatatggagtattacaaatgcatgcatgctgtagtaataagatgtctttgctttaatttggtttctctaatttcgatcttcttctaattaattaagtaatagttcctgatatgcatgattaatataattaattcagcacatatatacattcattctcgattaattgatacagtagtgcagcaactatgagtgagtatcagcacagtgggttcacatattaaagttgtgggctgaacgaaaaggacgacgtacttttagttagttgtatgcgtgtgttgtaaaagcgtatctactccaatatttttcataattacaatcacggtacttcgattctgaacatgaatatgccaacgaagcaaattaagcaactcagggaatgaaatgcgttgattaattttctggatttgattaacattgtatactttgattttctatgatttcatttcggtgagccacatacgcatgcaacaaaaatgtgtccaatcatgttaataactattggttgcagtaagtatagctaggacgactgctataattaaaggaatgctagtatgtatatataacatgatatcacataatctaattaaatagaaattgacttaggtagtcgtatctttctcaagttatgatgcaaactccaatggtttttggctgttacaatggcggtgaatgatgttttaagctagaaatatcccccaaattactcctttcagcactagagtaaagactatttgtaattttattaaataatacaaccataaccttattaggcaactaccattaattttcttctatatgctcttgtgcacaaattttctagtcggatataaagcatgtgcagttgttttgatggcttttattcataacgtatacacacacactctctctctctgtgtttaaaaatataagacgcgcacacacgtattttaagatttaaattttacaacttttgatcaacaagtagtctaatcatgtatatgtctagaaacaaaaaaaaagataatcgttgaattcgtatttgcttgcactttcatctattttttagtttcagtaccaataataatgtaatttgggagaaattgacggtcaaagtttgacattggagaccataccaaatcaaaccaagtcttatattttttttagtggagagagtatacctgttaagtgtagttactactacttactatagtagtattctagatgatgcattggtcctaaacccttgaaccctaaaatgtaacaagctaatataagctggctgatctccccccaacatgtatatatttcttctgcaaatgtaattaattagcccccaaactttttttgcaaataaattaatcaatcaatctcttggttaaattaattaattaacatgtgtgtgtatatataaaaaaaaaaacaggagctactacaggtgcacgaacagcaagtgcacggtgaagaagcgggtggagcgctcctccgacgacccctccgtcgtcatcaccacctacgagggccaacactcccaccacaccgtcacctttccccgcgccgccgccaccgccggcggcttttcgcacatccacgccatggccgccctggccgccgcacccttcttcgcgcaccaacaactgtacagcaacctgcagccgccgccgccgacgatgccgcttgctgctactactccggcgtcgtcgtcgtcgctgctacagctgcctctgcactgcaaccatgagctgcaggttgttgccagctgcggcggctacccgtcgtcgtcgtcgtcgccgccggcgagtgttcttcccgtcgacaaggggctccttgatgacatggtgcctagggcaatgaggcatgatgggtagtacaagcatgcacaccatcgatttaatttggggttaatttgtagcctaattattaatcttaattagctgcttcgatggattaattagcacggtaagtagttacttattcgtgttgagatcactggaaagataataattaatagggtacatagagatatatatattagctatatatgaatatgggtgatatatatataatatagttcgaaattaataaacaataattgacttatatatagttgtctgtttgatgttcattctaattgtaatttctattaattggtgaattagttgctttgatgggattagcacagccataagttgtatttttcattggtaatatgacaacgacctggtttttgaatgtcgatcgatgttctacaaacgtggtgtgtatagtggtaagtaatataagagcagaagtaagcctttgatatgacccccggacttaagcagatttgtgtgatgataaaattaataataaaataattcatgctaatgcatgtttgactctaaaattaaatttgatcctacaatctttgacatgtaggccacattatcctagtttcctcccacacacatgttcatatctcttctttctataaagataatacccactaaacacatgcaaatatagtatttattagcacttctagaatcaatatgtggctacatattgattctagaagtgctaataaatactatgtttgcatgtgtttagtgggtattatctttataaaaccactaagcacacaaagttcaacatgcaagcatatagtaattatatctataatttatttcattctaaagctaaacatacacatgctaaatcatcaatcttaaatcattttcaaaatatttcaattcaaatcatttaatcatttctacaatatctaacatatattgtaggaacgaatcacaagaactaagccaaccagaggggggtgaatggttggtatacccaaaaaccaaaaacttttagcgaaaataaaagttaccctcgaaatcgatggatcgcggtctgaccgaagtagttgcgccggtctgaccgcctgatgaacgtcggtctgaccgatgtagatcgatcggtcgaactgtcgagaatgcctgccgccgactcctgtcgccgccggtctgaccgccgtgtgcccgccggtctgaccgccggtgcaccgctggttagaccgccgaaacccggtgaaacacaaatcgaagaactcttaaagtagatgatgactttattgattctctctgtgtttacaaagtgcaccaacatcacaccttacaaaaatttcgactaaactcgaaaccctaactcaaaactcaactcaattgctctctaaagcgataccgggaagcctcactgtcacaccctaaaaatcctaaacatataaattgttgtttaattggaattattagaatttattttaaaagcctagaaaagaagatctaattttaaataataaattccaatataaaatggggccagataaaatttcattaaatactttgcttaactctataattcctagatttttctgggatttatttgagctaaggaagtatttttaataaatggaattgcatttcatgaataatttaaattgaaaaaggtttttaaaatcctcttttggctttgggccgaaagtcggcccaaaaccttctctctccctctccccggcccaagctggcccagtccgcccgcagccgcccgcgcgcgcgctcggccgctgacaggtgggtcccacctgtcggactcgtcgtcctcctcgcgccgtcgcccggccggaaccctagccgagccgcgccgccgtctccttccaaattcgctcgtgcctttccttctccggtgaaatcaatagaggggaaaagatcttcgggatctcctctaccttttctcttttggaatcgtcggctaaatcgtttggaaatccgtggattcgagttcgattcggatcgatctctctcctccgaaccctagactttccttcgtgtcgccggtcgccgtgggtcttcgccgccgccttccaacccctataaaaggaccccccaagtcctccgctacttgtcgccaccctcgccttcgcctctcgtcgccggtagagccctagcaccgtgtagcctagcgccgccgtcgtagccgttcgtccagccgtgcgccgccgccgatcctgtcgtcgtcgtcgctcgggaaggctgccgtcgtgatcgccaagccgtcgccgacctcgtccgcccctccgtcgtcgccgtaggttgccggaggaccgtcgccgtcgtcaagccgaaggttgcagccgcttcttcctcgacgccatcgccgtccgttgatcttccgccgttgttttggtcaccggtgagttcgccgcgtcgccctctacgtgttggtgtcctccgttcgcgtcgtcgtgccgtcgttcgccggcgagtttgcgcgcctgagccgccgccggtggtgacgtcaccgctgacgtcatcgtcgtcgtctctcgtggtctggccgtggaccgatggatcttggccgtccgttttggatgggtcaatatcggccgttcgtttccgtgagccgccgccgtgcacccggttcaccgtgaaccctagccgctgacgcaataattcccttttccttttcaaaaataattcattattgcgtcataattcaattaaaatctaaataaatgatttaatctgatttaatctttgaaaattcataactaattcatcttagctcgaatttagttggttcaagtttctaattttttctaaaatagagatctacatgttaaaaatatccacatgtactgttcatgcttgtttgtgtgctgttttggtgattttgctcctttctgtttagattccgacgtttccggagagtccgtttttgcaggagaagattttgaagagttccaaggccagcaaggcaagtcacacagatcccaaacatccctttgagcatgttgatcccgtttaaagctattgtttctattcaactattgcatttattttcgaatgtcattgggtggaattaacctaatgtttgttatagcccttttgttcttgattactttattccttgataccttgggttatcataacttgactagttgagctttatatattggttcagctagatagtagatatgattgcttagccatgcttagaaacattagcacactattgggataacttatgactcactattatttaatgatggcttaatgatagctcatgatggttaatcgtgattggttaattaattaatttgccaactaaaacttgataatggtgggttgtgagcacatggttttgatggtcgtgctcatgacaattaaggaccggttcacgagtttcggttgtgaaacattaaccgtgccaaccacaagccagcgtgggcaacggctttaccttttgtataacatggttcattgcggggcaccagactgagaagtggcggagataagcccacgggggtcgctggggagtccatgccttgtttataagggtgattatgatccaggaaaggtgcgctgtggtggattgtgttgtgcgaggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtttcacacttctcatcataataaaagatgctataactggtaataatttgtttagcctcctggtttggaatggtatattcctggtttggagatagatatgtacagccgggtatggttgttcaggatggttgggcctgagcagcatgggtgtgctgtttagtgttgattaaaattaatgattaattactctactgttttataattctcaaatgtttgctaaatgctgcttttgcaaatgagccatatattatgccattctttggtatccttgtgcacttgcatatttgctgcgtggcttgctgagtatgtcatatactcaccttgcaatcatttatcagaggaagagttctacagtgatgctgatggtgtggaggattaggtgtagccctggtcaagctgcctgtggagtggagtcgtctgcgccgtttttcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacactcacgctccccctctatttatacatgagataggcagcctaaagccatgaaccaaactcatattaggagtcctaaacaccttaggaaacccactaatacaagaaagaaactttacatgaccaatcgtaccaaatttggactccttccaaattcgactccgcatcccatacgcacacaataactccatcgtatgccatatggaatctccatcaaccactttcatcagctctagcctaagtatcccgcatgatctctgaccaccacggacgtcgtcttatccccaagccgactcccggtccatcaccgaaaccgacacagtgtcggccggtcagaccgcgggctagccagtccgaccgctcgatcaccgccggtctgaccggcatacacagcccagtctgaccggtcacataaaatgataacctgtagattcacctgtgaaatccaatcatctccaaaaccacttcgtgaataaattccaaataacaaaaccaataatctccaatggccaattattcatcacagaataataatcaaaaacacctttgattttacatatatctcgtagcaaagcgcggagcattatctagtatatatataatattaaaatacgcatcatctcgtagcaaagctcgtagaagtgttatgttagatggaccaaacctttgttgctttgctactaaaatggtgcaaagcccagcaaatgcaaagttagacaagcctcccattggcagtagatcatggtgagttcctagttagtgagaatgagattacagagaagttagggctcccaaggtaaatttatgtattcttccgctattatagttcacaacgaatggctcggaataagtcggtgtcctgaacactaaagctagcatcaccgatgtaattatcgacgacctgataaataagacttactacatctctatattgagaagctcttgtataaactataaagtaagctagccatcaataaagagatagacaagactttgttcttattatttttattaaacttacaatttttaacataccttaaattaatgttactccttaatccgtataagttttataaaagaaagtttatccaatagagcagtacatttgatgcacatgtatctggaactgagatatgattggactgaaatcccagaaatgccagcgatcaggcgcccgatcagtggcaaaaaaaaatcgggcgcccaccgcttcccgcgcctccgcgctgttcctaccacgcgcctcaccacacgcgccattgcaacaaattacccacgtattagaaacgctctattaagtgaatctgtttcatttttttccaccaacaatgttttacaagtgtactcatgatgtttcactatctatggatcaaatgttgcagcaaattgaaacatcctttcgctatttgctgaaacattgtttttatataaagtgaaacaatgcccgatttttttggaaaccattgtttcaaaccttgtagcaaaatgtttcacgaggtgatttggttgtgtttcagatttttaaaatattgaaacaatttcgatctacttagtgaaacaattctgatctacttggtgaaacagcgccccatttgaacggattaaagtattgtttgcatgccaacaattttctagtactcttatctcaatcaatgtgtattttcttttgtttgcttcattttacctattataaaaccaaccccaaaatcgacattggtagctaaacgcggaagaaatgtcataggagatccaaacacgatgatgacaccgaggcatgatttgtaggtggccccctgaaattcagcccaggcccatacatttacaaggatttctccagcttttccttttgttttggttttattaaggggaaaaaaccaagcgatttacaacggctgggattgctttaagattctcatcatcctcacctcttcattttctcgccacgccgccgtcgccgccggcgagcccccgccgccttgttgccggagacacacacccacccaagggaaggcatggcggcggagatccagacggcagtccgcctccctgtcgtgcccgcgccgcgcctcttccatggcggccacgccctcaaccggccccggcgaacccaccaccaccgccaatccagtgaaggtactctccccttcccatcctgactccatcctcatcctggagtgctacaagggtttcttagatcgtcccggggcgggagtagttgtcgcaattctgtagtgaaaataatggatcaacagttgagcaccttcagtccttcagagctcagagcagagttgggatagagaaaagcataggaaatatcacaactcaaatccttaatccagttagtatcagtttatctatcctagggtttgatacttggcaccagttgaaaggacaattacaaggtgaattctaccaatgttgagtcgttatggtggccttggatgtaggtctttcatactatcagtttagggacaattgctcatttcaccctatttcagagcctaactaccaatctgaccttttttttttagtttgcttatttgatcctgcttttcaaaaatgaagttaccgtctgaccctatttctattataccgttagggtttcatttaggaaaagaaaaaaatcacattattaatcaaactgaccaaaatacctttcatgactcaaccctatccattcactcccaatcctatccagtcactctcaaccctatatctctcagcgccggtgcacagacggcggcagcagctactccgtgcggaaggagggaggcgcaggtgctcgccaccaccgcggggtgcgaagagaggcgcgtggcgtgggagcccgccgccgctgggcgcggaaggaggcgcgtggcacgggagctcgcggccgcggcggggtgcgaagggaggcgcgcgacacaggagcccgccgccactggccgcggaaggaggcatgcagcgcaggtcgaggatggcgcgggagctcgccagcaggtgtttggctgctgctagaatttcaaaaatgcttaggatcagacgttcgacgcaaccaacaaaaatcggacggataaactactacctccctgtccacttcacaaatacatacatgctataatggtcttcagaatattttttctcctcaacttcttatccaatttatgatatgatcgcaccattatatttgttataattaaatctttacaacaagatatcacatcattacattccgatgaaacaaaaacatatgtttcaatccgttaaatttaatgtttcagacacggtagcaatatgtttcaacgtgtgtttttgttatgtttcataaaaatttttaaaatatttcaacaactgattttttgtttcactatatataactcaatgtttcaacaactgattttttgtttcaccaatgtataactcaggcctcttctctctctctctctctctcctaccatctattagctttctccccacaccatgcatgatgcaagtatttagtcgtattaaaaatcttttttcttctaaactacttatccgatgaacgattcaatcacaccgttgaattcgttataattaaatctttacaacaagatatcacatgattatattgttgtgaaagaaaaatatatgtttcggacaataaaagcttaatgtttcatacgtgatagcaatatgtttcaccatgtgttcttattgtgtttcacaaaatttctatatgttttataggctgattttttttgtttcaccatgtataacttaatgttgtaccaacggtcaactgaaacatttgaccatccgattttttttcaacatcggacgtccgatttgtagctctctccctagaattttgctgctttgtttttgctattgctgctctccgtctttctctcgcctctccttgttcttgcccggctggagggagacggagccggtgctctcctggtctggaggactgcatgctgctggtgtagagggattatgtattttttgtgaaatttatcaaaaatctgtcaaatgtatgttaagtttgtcgaaaatatatcaaatctaagtgaattttgtctgaaaaaatttaaatctgtttcaaacttgtcaaatccctcaaacctaagttagatttgtcacttatcttagtaaaaataatgtcacattttcagataaaaatacacaaaattaggcaagcaaaaaactttgaaaaaatagagtcaaatgagtgagggcataaaagtcatttctctctgaattaacaccattatgttgccttaacggaatagggccagacctaacgttcgttttaaaaaaagagggtcaaaatagcaaactgaagaaagcaaggtcaatttggtagttagaccttaaaatagggtaaaaacgcaaatgccccgtcagtttattgtaccaatattcattcatctttgtatgtatggtggcctgttttgtatgttgtctagaaacaggaatgcagttgaggtgatggattgtctctgggcttggtttccaaggtgggtaatgcaattacctgttgtctaaaaaaaaataattgaggtgatgggttataaagcatataagctttctgcatagtttcccaaagattttctccagactgttggcctctcagctgtcaacaatccctatttatcatatgattctgttggattggccaaactgggtataaagtgaatacataaacttcaactttctttttggtggaaaagtttagaggaggtttcccactatggtctgggacaaatgatagttcgttggttggttggaattttaaggactacatatttgtaatctttggcttctcaactttacattgggacttagtttctctgtttctttctttcaatttaatacaaatacacacacatatctcctgtaggatcttgaaaaggaaaagcttggtgcatgataaagcaattactctctccataaaaaaacacttctggatttaattcttaacatagccgacctatgtctagattcaaacccagatgtggggttttttttttttatggagggaacaggtctctgaacttcttgccctttctcttcatgggacaaaactaaactgattgaggtttgcaacatttgaatgtgattgtggtgtctcctgccatttcgtttagatgaaaaagctttgagtttgcatcccctattttgtgtcaattgatcttgaaggctggtgcatatgcagtttttcaactggtgatgaaagaattgcaacgcgtaagaaatgtggctatttacattattactacaattgactcttttagatattgtaggaggtaatggttgcgctaatatatgataaattatttgttgttacgatgatattcttaatgacaaatcaagatatataaatccattaatgttatagctacacttcttaaaaaaaatgttaaaaacatatttattattaattattattaaacattatgtccattaacacaaacaatattttaatagatggagaggtcataaccgtgtgaacacacgacttaagatgctagtttattggcaaattgaatagtttgtgtgttagtttgaattgagaccaaatatttggtagcgcccctattctatttggttatattctagaagtttctttactatactataagaatttggctttttattggcagcaattcaaatgttaactaaataattttatcttaccaatattttggtagtgccaaagtttgcctagactttagcactgccaatgaattagtagggtaaagaaccaaacaagctcttaatataaatactaagtgtcgaatctgcaatggtgagaatatatctcacttaagtatgctaattaaataccataagaaatctcaaacacttactttattaaatgaagcatccaccgaggtacaagtgaggagagagcaccgacaactccggcattcctccagaccttcccctcactctctatctattttttccacactaataaagtgatgcctaaaatatgaaagtgagttttgtttttgttgttgtgtgttgtgcaacggctggagctcatccttttatataaccatatgacggttggaatggcggttgtggaggtcggtgtacccacaactatcattgtggaaggtggaggtg

SEQ ID NO: 66599 - DNA, 17070 bp, Oryza sativa
  unsure (1)..(17070): unsure at all n locations
cgaagggtagggttgacaccaaaagagaaaacttaagattttctcactaaaatatattttaaaataattggaaaagaataaagaaaaggatccttccttgactttcaagtaacaaaaaatcttaagtctatacttgctataaacagtcatcaacccaataccccgtacataagtgtcctctgggtgtttcaagagacaacccctggtagctaagtcccttacaacaacctgtcctggccatccaaccgggggctaaatacgaaggagaaccctccccaggaaattgcacttagaataatatacacatgcagaggacacccatattgagccgtcaccatcagcggccagcttttgaaccactgtatattaccccaattaatggtatctaataaaataagcaccgtgcttatattactaaatactactctacatccttgcaaccgacatagagcatccgaatactcagacactaaacccacaccaatacacctatctggaaagctagttgcatggatatattgattcaagtatgaagtaaagtcggcactcaagtaatatgaatggaatacccccccccccgcgttttctgaatgaatgatagtacaatcctgcaatctgcatgccttcctcatgcgtcacgcgtgcgtgcatccagcctcatggctcatgcatgcatgcaaattcatggcttaattaccattatattgtgcattattgcatttcactggtgaccgatctcattcttctacgcatagtacttagctagtaactattacattcgtccacacaaagtataaggagttcgagatgagttccacacatgcattaaaaattgatggaattaaatgtgataagttgtgtgattggttaagaagaggtgggtagctagggattctagatggtaaaatgttatgattggttgagaatataataattattttagtttgagaagttattatattttatactaacaaattttgaagagttattgtgttcactaccgagctcctaagtcgaagtccataacacaaaagaattgttgcgctagcctaacgcccacgaagtttcagattagtaccaaattaaacaggacaaaagtgtttcttgtattaataataaatatgcttgaaatctaaaaaaatgatttcttataatagtaatcaaccaaattgaatcatattagagacaacgagagcgatagcgcggcgtgacccagacggcgagacgtcgagctgaccgttgcaccagccgcgcacacacaacgaccgattgccctgctgtgacggcctgccgtctcgccctaacaaacacgccgcgccggtctcgcgtagtcacgttgcatttggtcgaatcttctttcacgcctagcttgacttgttttcttgatttttcctgttttgctactcatccgatatactacctccgttttattaaagtacgacgccgttgacttttatcaacgtttgatcattcttttatttaaaacttttatgcaaacataaccaatatttaattcatgcttaaaaacatttgatgatatattaaatcataataaaataaataataattacatattttttaacaagatgaatggtccaacgtatcttactaagtatacattagtaagtatatattatgtgttgactttttattagagaagttaatagcagtgccacatatttaaaaagaaaacacactatatgaccaaccgttcagcagtgcaggctgaccttaattgattaagtttgctgattctactttctccgacacaaatttattcaggtaaccagttagaaatagctatatttttagacggaaggggcaggtagaaatacgtttctataatatctgttagtggcgtaatttgaattttgtatgttaacaattaacagcaccaggtgtgctaccgttgacgtcgtaccaacggtatatagtcaaccttttatcataggctagctgaacacgtactattggcatacgtacttaacaggacgtgcttaaaataaaggcaacaagactactgctactaattaagtcagcatgttgtctaggcaaattcaaccaagaaggtaacgcatagattttaccagttggctctagttggttcggcactaaatatcttctacagagttttattttttctgaaataaaatatcttccatgaactgtcatggtgtgacatgctacttgtattgacataaataaaaatatattttttccatgcactccttttgtttcttattataatcattttgactattttcttagtcaaaattctttatatttgattaaattagttttattaaatttaacatagaatatattttgatacaaagtttatttttattaaaaatattactatatttttctataaatttatctataaatttagtcactaagaaaaaaaattaaacgacttatatcttctattatatactaaaagtccattaaactttctacaaacgctctcaagctgccatgtggcactcctacaaacactcctagatcgctacatggcacagtctaatctcaccgtcgattttcatttaaattggtggacccattattttataccgttagattagatctatacatgccgtcgattttcagttaatatattatatccatatatatatatatataatacctttctctgtactgtttgtcggaggaatagaacgtatgtacgtacataccacaaccaaaataaagcatacatgcttagtacgactatcaaaaaagcaaatatcactctacaatataaagatatattggcccacaaatatatacatgcaattgaatgattttcgatccattattttatccatatatattatcgatttataaattattggacctgttattttttactattaaatatgtaatacctttctcatgtgcataatgtttgccggaagaaaaaaatatatgcacgtacttaccataagccaaaataaaatataaatacttagtaccatcaaaaaaaaccacggtctttaaaatagaactatcaacgatataaagatgaaatatattacttcacaaatatatagatgcaatgttaaactagatctataatataaatatcaaatcaaccatctttaaatgttcatcttttcaaattatttttaaattatatatccaatttgtgatctacaaaacagtactaagtcttcatgtggcgttcctacaaatacttctagaccgccatgtagtactgtataatctcatagtcgattttcatttaaattagcggacccgttattttagactattagattagatgtatatatatactaaccgtgaaaaaaacataagtacatatacaaacgtacgttagattgaaaaagaaataaagcttcggtactactattcgcagcaagaaaaactattatatactaaacgttcattaaactttctattaatattcctaagtcgccatatgacgctgctataagtgctcctaggccatcacatggtactgtataatctcaccatcgattttcatttaaattggtggacccgttatttaccctctaacgtggcatacaaatggccgagttgagtgggcccagtgtgtcataggactctatgaaagggttatagtaaattagacattaaaattgtgcttcgggctgatcttgaggggacacaactacccaattttcaaggtaatagagaaagaaagtctctacggctatgaccggcttcacccgttagtgatatttttagaatatttatatgtggatttggaaataagtgagacataaacacttagctaagtagtgtattaataatatattaggcttattttattatgcgcaatttcatgtattggtagttagcgagcttttaaaatagtgataatgagttgttacgataataggaaaatttatatgtaatcgggacaaagtgtttttaattctgggagacattcttataatttaactatattgaagtctacgatctatctcacgacgtagaaatggtgagatatgacttcttttagcactatttcataaaacaataaataaaaagcccgcgcaccgtgcgggcttccttcctagttataaaataaagggagtaattttattttcttttctaaattcgttgagaaccaatgacaaaatgttgattgatgcacgttggctacttgttgatgattccatacagcttgtaatcaatttctgtacgtgttcatccgacgttgcttgtacgctcaagatatgtttatttccttggttgttatacctataaaaatatatagacacatataaattttaaggttcacgcaatagttggatgtacactataatgaactatagtttgtagtttctccatatattcgtgtgcacttagatttcaacctactaggtgaagccacaccatagtattgccttctctattttgttaattttggtttttggtagctataaatttaggtggagacaaattatattttttaaagataactggagacatattacctaatgaatgataggtcaagcacatcatatgagatatcagatatctagccaaagggtttttccgatatgtccttttcagcctggccataactttttcccccaagaaagtgaaatggaaattgtccgttggcgaagccaatcaattgagaacaaatttggtgtcattctctacttcactttcgtgggtcagattaccatacgtgtacgtccttaattattctacatttgaggatcggatttaggcgatttacctatttgatgttgacaagctggttattattgttctaaaaaatgttgtggttaattaatttggaattttattttatcattctttagtttggctacaacactgttttctttaatttatctcttgcaagcttgctggattgaccttctatgtataggttatgtgccatatggtggagctccaataggctagaggcataagtttctcatgaattagtccataaaagatatgtaagtttcgattttggaaggggacctctacattattgacgagaaaaaaaagaagggtgtgagaggacaactagcaaacagcttttttaaaaaagtcagaaaaacaagaaatatatatatgtgcattagcaattacaattttcaacttgtacatacgtacgttctacacagcttagcccttacatactaaccaccagggttcaaatttttattttggctattttctatcaggtactgaaataatttgaattttaataaaatttggtcacatttaaacaaaatttgccaaattcacaaaaaatggaaaaaagggtggaatagttttggttttgggggggggggggggggaggggggcgatagacccaaaattttgaaaatttcagtccgtaattttgaacctgcttattacatatatagtacgttaatttaatcatgttattacaagcttcccgatccttgtgtatccgatcataaattaatttatcacttggtcatttttgatatgaatggtgcattgcagctgagaaccttgggttggcgacatctccaccgtacctcgccatatcgtcaagcagcagtgctaactacgtgaatggcgtcaactttgcttcaggtggcgccggagttttcaactctacaaacaaggtagttctaattagtttcaactcgtacacgtaattgcaataacaaacttttctcatagattaccaggacgtaggattatatgtatgcatgttagtcgtcaacgcactatatataaagttcattttttttaaaaaaataatacaaatggtttacatatttctgtcgacagtgatatagtcaatttgttttcaacttgttttagagttgaaaattggttttaattacttgtgttaaacattaatgcaggatcagtgcatcagcttcgacaagcagatcgagtactactccaaggtgcaggcgtcgctggtgcagagcctcggcgaggcccaggcggcgagccacctggcgaaatccctcttcgccatcaccatcggcagcaacgacatcatcggctacgtcaggtccagcgccgccgccaaggccaccaaccctatggagcagttcgtcgacgccctcatccagtcgctcaccggccagctacaggtgaggatcgaggtcaccgatcgacagataattaaatcgatcatcaaatgatcaatttcatggtgttacgttctaatggtgttcgatcgattgtgttcagaggctgtacgacctcggggcgcgcagggtgctgttcctggggacggggccggtgggctgctgcccgtcgctgcgggagctgagcgccgacaggggctgcagcggcgaggccaacgacgcgtcggcgcggtacaacgcggcggcggcgtcgctgctgcgcgggatggccgagcggcgcgcgggcctccgctacgcggtgttcgactccagcgcggcgctgctccggtacatcgagcggccggcggcgtacgggttcgcggaggcgcgggcggcgtgctgcggcctcggggacatgaacgccaagatcggctgcaccccggtcagcttctactgcgccaaccggacgggctacgtgttctgggacttctaccacccgaccgaggccaccgcgcggatgctcaccgccgtcgcgttcgacggctcgccgccgctcgtcttccccgtgaacattaggcagctcgctgctatgtaggcttcatctcatcttcacggtgtactgatcgatcgagctgcttgtgagattccacttttttcaagcttcaagtacagccatagaaatatactactatataccatgtaaagtatactagtgtatttacttacgattggtacatatagcggtagaatcatataatatagcaaattcataataagtgattgttgaagttcatcagaaattcacctggaattggggtcggaatcataacaagtgattattgaagattgtcagacagctatagtacttaccaagacgagaagatttgtggtgcagcaatttttctttcagggatactagcgctcaaaacgtggcaggaaaaattcactttagattccgcatagagtaaattgcactagcggtacttaaacttgtaacgatgtttcacttaggtccacgaacttgcaaagcgcacatcgagatccctaaatttgatttattgtatcatcccggtccaaagccgcgtttgaccgtggtcttgcctacttggcacgccacgtagacgatgacatggcacaaattttaattttcctttttttctccccatcttttctctccttcctcacctcgtatggtcggaggggacgcggggcaggagcggcgcgggcgtgctcgggcgccggccgacgggaggagaggagcggcgcgcgtgcgcggccagcggccggcgagaaaggagcggcgcgcgggtgtcggctggcgggaggagagaagccgctgcagcggggcggcagggcgagctcgtgctcaacggtgtaagctcgacggcgacaacggccatgtgagggctactgccggagtggtggggcgaagaggccgaggcgcgcacggggggtggtgtcgccagccgctcccgggggaggggtcgccgaccgcggccgcgcgtgcggggggaggcgtcggcgggcccgagctcgacgacggcagcggggcggtggggcgagctcgagctgggcaacgcgagctcgacggcgacaatggccatgtgggggccaccgccggagtggtgggacgaagaggagggcggcacgtcattcatgcggaagcggctgaggtgcgcgaggggggaggtgtcgccggggcagccaaagcctcgttgacgggagggagggaggacgacggtgattgggggaggacacgccgcgcggcgcctcccagccgcgtgtcccttcctcctttcctcccctcggcgtcgcctcctagctgcgcgtggccaagccactgcgccgcaccaccttcctcctgagctgtgccgcctccctcccgtgcgcgcgcccggccgtgctgccgcgctcagccaccgccccgctgcctcatgccacgcccgccctgggcagcctcctctcccacaccgagctcccctcccttatcccaccgctgcccctctcccggcgctgtgccaagctgcgccgcgccgacacgccgctgtcgcctcagccgcgtcgtcgcgtgccggctgcctcgcacgcgacagcccgcgccgacgccgctgccccgagctcccccgtgccggcctctcccttccatcgccgccgcccgtttccgctcgagccaagacgacgccgccgccgagttttcctctcctctcgatagccgccagctcctctctcctgcaccgccgccaggtcgccgaccccggccacaacctcctcgcaccggtcgtcaaccgcctctccccgcctctctcctgcgccgccgccaggtcgccgaccccgcccacggcctcctcgcaccggtctcgctggctccctctctccctttgcctgccacagatgcatctagaggtggaggaaggagagaaaaaaaaggaaaattaaaatttgtgccatgtcatcgttcatgtggcgtgccacgtaggcaagaccacggtcaaacgcggctttagaccgggatgatacaataaactaagtttagggatttcgatatgcgctttgcaagttcgttgacctaagtgaaacctcgttacaagtttaaggaccgctagtgcaatttactcttccgcatataacggttgagtttggatagtgcccctcatcttctaaaaccactttaaatatatagtcccgccatatgcacactatatttcttctctatggattacatgtacgttgacccacttttttttgttgttgttgttttatcgtataagtttcacatagacgccacattagataaagaacaaatcaatatggcacgttgaaaccgtcttcgttgggactacatttcctctgttcggtaaagataaggattgcgttagtacattgtttcgcggttgagagactcgatcgaaactcaaccttagatgagagaccggcagtgaactttttccaaacgtggttcgtggcccatcaaaattccaggattccagcttatgttgggccttccagatctgcgtcgttgggccatatgggccagcgtgcttgttcgtccaagcacaccgccccacggcccaccgtccgattcacacgtctagtagttccccaggccaagctaccggtgctgccggcggcggcggcggcggcgggcgccggaagcacgaacggcgaacggctaaggcacctgcctctcgggactcggggaccagcggcagaatcttctccgggcggcccttttctcttgccccagtggcctctgctgcaaactccgcacaaatgccgcgccccgctgagcctcccagttctcgccgccggcgatatgtgtaggtaaaattatttagaatgagttaattttttttggttatgcgcaaatccacaattaatctacatttgagctaactagttgctccatagtttctttgctgagctggagattggatgcagtattgttgccattcagatctcttggtcgagtttgaacctagaactgggcctataaggctataatttgttactgcagctattatacttctatacgttatatgcatttcaggtttgtgactagcctgattcaatccaaagccttgactttaactatctttttttttaaagaatacgtagaaggtttgcatgccatttcttatagcgataagagaaaaggaaccaggctgctatgagtgtccaaatagtaccaattacaccactcaggaaccactacacataatgcagctgttttctccgcaaaaggtaaataatagttggttgtttaattcacacaatcacaccacatgacccatgagagacggtaaaatatatatgtagctaatatggtatgagctcctcacctgtaaagcatgacgttgattaggtgattattacttataggttgcagtgttctttctaatttttataccaaattaagctatctattcatcctcttcgctactgtcatcactgccgtactgaatttcctcatcttctgactgctcatggtcttgctcatcgttgtcctctccattgtcatcttcgtacaaaagcccaaactcctctctgtgctcgtcctcacttgcatcattcaattcattcagagcttgttgctcttcataccaagcatctttagactcatgtaactgagagaagggacattaattattataaataaaaaattcagaaaaaggaactaagaaaataaacagtggtcctagtactgcaaatgcactaataaaacttaaagcataaagtatttgtacgtagatggtgatagagatctatacctggcattgctggtgcgaaatttggacttccaaccagtctgctagcaatgggcactttgtgatggtaagtcgctgaagctgtgttgacagtggtttatcagatggtagctgcagataaggacatctatgtatcttcaaaaatttgagtgacccaaggctgctaagacccattatagagtgaagacgtgggcaaacactgataaccaagacttcgagcaatgggtgattctgattgtcaagtaaaaggtgctcgatgctccgtgacagtaacactttcagtgatctgagatgcggaaagtgcaaatcattcagaatttgttcatttatcttgctcttcaagaccaaagtagtgaggtttggaatagctggtagactagcaagtttgctgcaatccttgataactaactttgtgagggaggaagatagctcctgtgggaggtacctcaactcgtggctatccttgatttttagcaggcggagtgaaggaaagtcatcctgaccaacttgagaccactcaacccatttcaacatttcttgaaactccagctcctcaacagctgggaatgcctttgtggtgatgtttccacggaactcctgtcgcacatgctccacatctgtcatgcactccatagagagtatgcggaggcgtggcaattccccaagtggaggaaggaacttgcagctttgctgacataggattatctttgccaagtgcatgaaggtagaagccccaaaccagctaggatatttgtatccactataattgactacctccaattcttcgatgttcttgtgcggccgtaggctctcaaagatctcttcctcatgctctgggtctggggtagccacatcattttggctgctaggatgactgcagttgttggggcaaacaccatcagaccagtctaatctcaggatttgcaattggttcttactgactaaattagctgtctgagcatcatcaacatttataaccctccgtagtcctgtaatacataactctccatgtatgttcaccagatggtgtagctcggcaacattggaatgccaacctccgcttccaatgctaaaccttggcaatgtctgtagcctttttagcccacctatcccacatggcatgcaaagtggggaccaaagatccaaattgagatggcggaggttgaccagtttttttatgccttgtgggagctctctaaggctgtccgttcttgcatccaagaccctcagattgtagaggtcactaattgattctgggatagtggtaattcgtgtttggaaaaagctaagatatctgagtagtttcaattctcctattgaatcaggtacttgtgcaagtgcagtatgactgaaatccaatgcacgaagttgtttaagattttgccatgtttcggtaggaattttaacattgatgctactagaaaacaacttactggaacatcttcgattatcttgtgcattgacaaccttaaggattcttatacctccaggtatcgtcacagaatttagtgctacatctgtatgatcagaagaactgacaaccaatgacaagtagcggaagtttccaatggtttcatgcaaatattgagtatttattctcaagaaatctcctccagaaacaaaatgtaccagatcatggataagatcatgtgtgacaaagcattccagtttttcatcagattctgctcgttgaatcattgccctctgaattaaatcatcgaagtacatcctgccaatgttttcatggcgcccagtacaatattgcttgaggagtcccaaacacatccagagatttatcatgtcttctttccagaaatagtaccccttagggagcagtgaaaggaaaacaaagcagcgcttcaattgtactggcattcgatcatagctgagttttagtgctggcagcactcgatcctcttccgcaggtaagccccattgatcactctctgagacatctttccatgtctcttcatttgtctcaccgcgaagagaggatcctattgccttaattgccaatggtaggcctccacattttcccacaattttcctaccaaatccttcgaactgttgatccatatgttgatctataaatccaaaggccatctgcttgaacaactgccatgattcttcagaagttaggaagctaagatcataagaaggcattgttcctatcatttttgaaatagtttcatcgcgtgttgttaataagatcattcccaactgagcacccaccaacagggaaagcaaagcatcccagatttccttctgcacattccacacattgtcaagaactagaaagaacttcatgtcttgtacttgcgccgttatcatattttggagattacccatatcttctatatcacatggattcctagtgaacgacatgataatttttcttgcaattgccttaacatcaaaatgaccctcagaaacatccacccagccctttagttgaaagtacctgctgactctttcatcattgtacaccatttgagcaagagttgtcttacccaaaccccccatgccaacaatagaaacaacagacatatttgcttgagcagcttcatcggaaattaatatttcgatgatgttttccttgtcttcttctctaccaactatgtcaaaatcacctacatgcggggttgtagatatcttgatgtcataggcctcctctcttattggtgcgtcactctcattgagttggagatcatcccatgcctttgtgatctcattgaatttttctaaaattttcctcacccttgctgccaaatcatctggaacaggaactttgataggggatggttcaggttcctgtacatgcactaatattattataatccaaaggcatgtagtatactgtgtactaacaagagttaaataaaacacacatatgtacatgctcctttatggacccctttttgctcctctactatcccaatacttttatatggctatgtcaatggttgcttatgcatgatatgcagattgctcatgtattattgagagaaacaaattgcttgggagcttatctttttatacaagaaactttgagaggaggcctctgcaatttggaagctttatttcatcaaagaagaaacacagactattttttctgataaaccaaatgtagcattggttatagctaggataaggggataatattaccttcttgtcacctttgcgcttgcgcttgcgacttctgctgctctgcctttgattgctttggtcctccatcctccgtcgaagcaactcatacctgtattcatcgacagcatcctgggcatcatatgcaagctgctgcagctcccacaggcgaagtctctcggcttcatctcttatattgtgttcatccatcgcatcgagggtccgctgaatccttgccatcgtcctctgcagatctcttagatctctgaacgaagcactttgctcgtcagatgatgatgaaacgatttgaggagaaaccaaggaagaaagcttgtttgttgtccactttatgattccagatgctagtagtccagccatctcttctcaactgctctttctgatccaaagacagagttagaccaagctgagagatgaatcagattaacaaggcaagaggaacatatagaagttcagggtgttgaccttgtggacaagtgcaatgcaatttttaatgcacaagctgtggtttccaacctccttacaacaagaggcatatattggttttcaaccaattcctgttattatgtttccaacctccttacaacaagaggcatatattggttttcaaccaattcctgttattatagtgtcaaaactgcataactgcgcacacagtaccactagctgaaatgcattatctgctctttttttttttgcggggaaatgcattgtctgcgtggacacatcatttcagaatatcaatgtaatgctcagaactattcttgtatggtgacatgcattttctgtgtccctaatctagtctgtaaagggccactatagaaccattttctgtggttcatatgctctgtagaaccatgaattgctttatattgccaagccctgttgagaacagcatagttcaatctatagaatcacttaattagaacaccgcgcaaggaatcttatagttaaaccagaaaaaaaaatctctagtccaattgtagtttgttttataaagagaaattgttgtcccttcatctacctggtatatactccaaaactattttcgctgtaagtgttcagttttgcaaacgtacactagcagctgcacattttgctaaatatgagggcaggtctatcctacttttctccttccctgttactagtttaaaaataaaatttagatatgtggcatttcatgttaaacattgcttccaactcgtacaattttgcacaggagaaaaaccaatgaactgatagtaaccgaagaggcaaaatttagggaaacagcattcctctaacaaggtgagcataaaacatcaaaaccagtttcagattttgttccttctatcaaggatacgagactgttacagtgtgttcgcatggtcggactggaccacgtgcccatggacatagataggatcaaagtatacttatgcaaaaaaataatagagtaataataagtatctttagttaactcttatgatttttttttctttcactgatcaggaggactatcttccatagggcagaccgccacttcagccacacattatcccaaaaacaaatttatgtatagacaaggacaaacttctttgacatcacaacatcagaaagcggcaataaatatgcaaggctataaaaatgtttgacgttgagctaacaaacatatcaaattttacaaaattataatggcatggttctaatttttccctatttattttctaagtagcatttggttcaatcaagctaaccaggatataaaaatcaattcagatccctaagaattgcctcccaacttcaactgcggttacacgagtagttcttgttttaatcataccctaatccccagcatcttactccagacaatagcaatttgcaaccacatatggacaagtttgtacacaaacattgagtgcgtgcaaatgatgcaacatttaataaaactatcaaaatacccatgttttgtctaggtgtcagtgctttttttgaactatttcgtcccggtgaaaaacatcacacccgcatgacccgatatcgacactaaatgaaaaaagctcacccaacgagtcaccgagagattttttttgaaacaaacgctctcaatccattccaatatgtccaagtctcatgttacggtgctttttgaactaattcgtttcggtgaaaaacattgtacccactgttgatgtgaaaatacggcagcctgggagatctgcttaactctagtgtaggtccaaggctagcctcaagtgtctcaagggcgtgccaactgatttgatcctgcaatcagcaataaagaataaaagcagaatcaattgactgatagccaattggccgataggctaatagcgtattgttgatggtctcagcattgtcgtggcgtggtagctcctggaaccttcgcatgatcatgttcacgcggggtgtggtgctggcgtggcatgtaccatcgtccactcccatgtaagggtagaaggttgacaacgccagaccatttttcatgacgtactggaaagcgttcaaggcgaggccccctgcgcagcctttgctccttggatggcaatccacgagctcctgctctgacaggagcaccgggttgtcgtagtttgcccctgcatgcgatgacgcggtggctctccagcgcgcccgtcatggcgaacgcccagcaagagccgtagcacccccatgaacatgactggaccaaggcacggctggccttcgcaggtcttgttgcgccaattgatggagacagggagcggtagggtcccgttgccatcgtgccttttcacgggccaaaacgcgaggttgctctgcttcgtcatcatgtgacacatgtcgcgactgagtgcttcgtcggtggcttcggcgaagatgttgagacctggagcttggcttgcaactcaaagaagagaggcaacgcggtgcatcatctcgttgaatgctactaacggcggagcttctcgacgatcttgcgtgctacattgtggccaagtgatagggcggccggactgtgttgcttgcctcctttcatagaaggtgcagagagcgagcgagccaggtaggcaagtagccaaccagcagtgctgtcgaaacatgaattcggcaataataaaacggggtagcgcacgagacctaaaagtggatggatgcggagacaaggatttagacaggttcaggccctctcaatgagaggtaataccctactcctctttgtggatttgaatccgccgagtgtagtatagatctgacgatctaattgtctcataccccctagaaggcctcctgcccaccttatataggatggggggtaggattacaagatagaaaccttatccaatacggtatcggtttcctaaatctactttacaatcttatcaaaccaggactttaggccgttccgtaatatacaagaaaacgtaatacccaagtcatgatctgttacagatttcatatatataagttatcccttataactagttggataaccatgccgtgtgggtatggggtacccataatctncacagtagcccctgagaccttcacagtcgaaaagataatctctcttcgactagattactncaaagccgag

SEQ ID NO: 66600 - DNA, 21686 bp, Oryza sativa
agcaaatgtgactattcggaaaatatgcaatgatagctcttggtggtacaattcatgcgaaaagtgtcttagggttgtcaaaccatttggttacacctacaagtgcactggttgctacaatattgcaatggcagtaccaaggtaatagatccttaatttttgttttatcactgtaactacttgtcaccctgtttacctaagcgagatcataatgtataggtacaagttatcggtcttagctggggacgatactgcggatgctgtgtttattctctttgggaaaatagctcagcgcattgtgcgaaagccagttgagcttcttgtcgagcagacacccagggagagcaaatttatccttgatgcaataacagctctgcttgagatatcatttacatggaatgtcagcttcacagagaatacacttaggactggggatgtatcattccaggttaacagtgtgatttccatgagtgttcttggggaacctcttatgctaatgtccccaggaccagcagattctcctggttcttcagctatcatgtcacctggaccaagcacttccatcatgtcacccacaagaacatctgagattgccatttcctcacctccattagctacaatagcttctccagtgaccaggcgtgcagcacctcaaacaccaactagcatactttctttggctaccacagagcaagcaagtcatgttgatccactgtctccacccatgactcaagcagtggcctctgagagtacagaaatggtactgctttccatgcttacaaatgtttgctctaaactataagaatatgtacatatcacagtaagaagctaacactttacttgcagaaacagaaggctattattatttctgatgacatcacgctgccactggctgcatctattccaaacagctcaaccaagaaaaggtacattctttagacccattcagatgctatttcattgttttcatcgcttctttgctcaaactacttgtgttgctcgatagaacccgcccacttcaggcttcaccaacagctaaaaaactgttcactgatgatggtgctcaggaaaaggaggttactgacaggtatttcatgttgaactgccatatctacagatacatattatatgttatatataaattaaatgtttactcaagcatttcttgttgttgcagcctgtcagataccgcttgatcatatgctcatctggctgaagtattttgggcattgacttatggaatcttcatgggcatgagaaaggaacaatagcatgctcacatgtctagatcttttgctccagactttactccagactttagacttttatctcttattaattagtaccaagtgaaaatgtactgcgatttcttttggacaactacctctatgtataagtgcacctattattattatgccagctatcatcccaccacatgctcagggtccattactattgcatctgcgatagcatggcaatgaactctgaacagttggctcgggcaaagctacatggcactaaaccatgttaagactcatcgttgtttctcttatgttgctaccttgctatcaaaattgagcatatgctccatggttatatactattgtgtgactatatgctccatggttatatgctctatggttatatacgatagggcgcgcgaagcgcgcttgatgtctagtgtaaaagaaagagctaaactgaaataggagtaccttgttttttccattgatgttgatgaccctgaaagggtgccaggatgagtcgctgatttcagcttcccactttgaatagagaagcgcagaatcaagctgttttttagtcagtgtttgtgtgcaagcattagcaaatgcttttggatcaagctcacccatcctcctgatgccaatgcttgcgcggccacttgtcagctcctccaaagcctgcacccaagatcaatttgaccgaataaatacaaagaaaattgatacaagttggtcaaaaaataaatgaaaatataatttagggctcagtctttcgttttcggcatttgtattgggggtgccgatatggcaaaatttcttacggaaatttcggtctgaaattatttgaacttttgaacaaatattgccaattcacaaaaagtacaatcaaaatttaaaatcggccaaaataatatcacaatggggtcgatagaaccgaaatttccgaaattcgttccggaatttcgaagcaacttacatgtatgagctgtttgcggatggcctgcaactcatcgttgatcgccggagcctggttgagcgactccattgccggcatttcatcggtcatcttgctcttggtgtcgtcgtcgtcgtcttggttgagcttcttcgacgtcgcggcgatcccctgcatcttcttgctcaccgccggcggcggcggcggcgcaaagagatccgggttctgcgcccagatgagcctctgccagtaagcgccgttgcggcacgcgtccgtacgccgccatctcgccatctccctcatctcgttctccgcgagctcacagaggagggtggcccagtcgacccagtgcgcctcgccgcgcctcaccctctccgcggcgcggtccacctcccggacgagccggtccgccgtgtccagcttcacctgcggctcgacgtacgccgccatgaacgcgccgcggcggaggcggctgcggcggcgtcgaggtcggcggccgcgcggatgtcggggcgcgtgcgcgggagggcgagcgcctcggcgaaggcgacgcgggagacgacgatgctcccgccgcggacctcgctccgcttggtcagcgcgttgtagttggcgacgagctcggcgacgaggtcggggcgtggggaggcgaggtcgagacggacgaagtcgaggaggccgagggcgcggaggccggcgtcgtgggtggcggacggcggagccggcgggtcgaggaggcggagcgggggaggtgcgggagccgccgcttggtccgagccccgccgacgcattccgccgtttggccgagtacggggaggaggcgagattgacattggcggcggcggcggccggcgagtggtcacgatcaaagcgaatgaagaagacgaccgacgaaatggaatcaaaggcgcgattcttattcaggttcaaaaatcaaaggcacgattttttagggatattttggttcactgccatatctaaaaattcgtaagcgctaaaatgcaggcaacttttgcgaaggactcgccttgaacatctttggtttcttaccaaatggattcaaatcagggaaagtgcattcctccgtcgagcagatatcttctcgttttatgtatattatctaaatagtcaaaaaaaattaaaataaaataacagtatagattaatataaaatatatcactctataaacatgtgtaagttaaaattcaacttatataagttataaaaaaataacaaatataactgtagataaatatttgtgaagtgatatattttatattaatctatgttattattctttttaaattttttataacggtttaaatgacatgcaagtgatgagaggacaaattgtgatacagtgttagtaatcggtagccggaaagtcgccaggcatttgacttcaatccagacaactcaagaatactttcgagttaccgagccctgctattatttttttggcaagaaatataattgatatcaatacaaaacactgtcaagaagtacaggtgtattttttttgcctttttatttatttgtcgattaaagttgaacattaaaaacaacggcaaaaaaaagtactccaaggcccaagcaaattgttgcacaaatataagcaactaataatgcaaaacagtttaataatttatctctccattcaaacaacaccacaaataaaaaaaaagtcaatctactaaaatcttgaaactcgtgcacaaacttgggttaaaaaattatattaagataaattaattattaacctcatacgtctggaatgatatttacgaattttttgaaagatctactagtttaacatagaaggggacaacatcaatgataactaggtggtaccccgcgtgttgctgcgggatacatgaataaagtaaaaaataggcacgcctggcaggatctgtaacaaaaaaggattcagtaatcatcataagaatattttaataataataaagtagctatgggtgattgcttcttggtgaacgaattatgttggatgcagctgagtagacccacattgtctatgaattacaatcgatcatcatgtcaatgaacttggatgaaacaattcaaatagaagaaaaatctatagtttgcaaggtaacacacttgcaaattgcagaaaatcccaagttaagtaagacaacaacgaatccagatactctgcagggcccacatgtcagtgagcagtactgcagattaccctcgggtccacatgtcagtgagcagtactacaggtgcagtactgcagaggacccttactcaacaacaacagtgttaaaatataatgaaaaatcaacctacgttgacataacttttgagttgtcacagtatttacatgacctcgccaacatgaatggcaagtattccaaaagattgcacaacaaccgtgatgtacggtgttgctagctggacttaggtgcatatagtggcgattgagtacatagtatccatgtagcaagtagcaacaaaatgaaaaaggaactaatgcaaagaacaggaagtgatactgcatatctgggtgaaataagaaagaacatgggccactttttattcgtaaaagtgtcatcaagtattgatacagacccaaggatcgatctagaccggcgtacgcgagagacatcaaccacctctctcgttagctaacaattatgtacattgtaactgggccaacttggctgctcgcacaggccacgtgcgatgaagggcctcctcgcctaatgggcccgacaccgagccttgtgtattatcgagccaacgcagctgttgtgggtcgccgcggccttattcattttccctatatttttcacccaaaaatatcatttaatgtttacaaaactaatttgtaatcactttgagccatcattttaagatataaaattgctgaaaaatttgtgtgtgcattttaatttatttctaactaaatggaaccaaggaaagaacctagaaaaataattaaggcttccagtaaaagtttttatccatcattcatcacacgcggaatcaacttcggtaattagtttcttttggcaatatttagttttctatttataatcacatccatttcctaatctacaaggtataaaattcagagatatttgtgatgtatatacaaatttgagttgcacatgtgttataagtacacaagcaatcttaaccatccaaccatatttgtttgatattcagttccaacagacatatttgctagtatacacacatgtatgcgtgtgtgagaaaaaaacatttaatatctgtgtgtttttagcggtttaaaagccaatgctttaaaataaactacagcaaccccctcccacctaaaatcgaactcagacaaataagttttaaaaattatattttctctttcagctaaatgatgatcctccaatccatcctttcattaatatttaacttacaccacgctaagacaaaaggatattaggtgcaaggactgtgatagcctagccagcaaaaagtcatcacaaaccacacgataataagagtatcatataacaggagtacatgtgcagattccagccgaagacaggacagcaatagtttacaatagtttagtgtgcttacataacgcacagaagcatttccaccaaagattttttttattttttttgaacttttttattttttaattttaaaaataacccctttctaaaacttatttctcgaatctaaaccttttggccaaaacaatactgagttttatcctggcgtggccaaataacgctgtcacgccagctagaccggcttgaccaaataacgctatcacgccggtctggctagcgtgataatgttgttttgtcaacccagtccggctagctgggccaaaaggttcatatcttgaaattaagttttgaaaggatttatttttaaaattaaaaattgaaaacgtttaaaaaaaaccgtcttccaccaaactcggcatgcttacacactcccatctattttaattttagcaatcaatgacccaactgcaccggatgcaacaaatatggcagcaacattacagccccacattagcttatctcgaaattcccctttgggcatcccacaagaagtcaacagcctgtgtatatgcatgccagtacatatatgaaggtgaatctagggtggaaaacaataataagccttaaactcaaaagctaacataccggttgatacaatctctatcttcagtcttcgctctctccaccttctccacatcctcaacaatttccctttgcaccatctcctcaaattcatcaaatcgttcgatccttttgacctgattatcattcagtagcttgaacatcaaattacaacaagattgatcaagaagttgtgaattcctagtgttagagagaagcattcatagactcaacatcaacagctgtttccagcatgtcttcctagtatattagggaataaaaaatatcttcctagtatattagggaataaaaagaaccagcagcatactgcagggcttagaagttagaagcagagttagggctagtgctgcatagcgctttgcaatctagtgagttataagagtagcctttaccaatgcaagatatatttttctgttagtaactcttcaaaatgattgcattctctgcacatgcttttattacaaagaaaagagcagattgatctaacgtgaatcacacccacatttcttttaactgtgtagttgtttttttaggtgtacgtatttgagactgatgcatgtatgggtattatgtttgcattcttaacatgtacttcataaacgtagtttcctaacttcgatttgtgttggcaactcggcatgaacaagtaagcaaaaatcacatcattcctataacatatcctccctaaactttgaatagaagtccatttagcacttcaaactttaaaacaggtctctacaccctcgaatttgcaatacctttgatataaccccctaaagtgaactttgtggttttacttatgtgggatatacatttgaacagacactaaaatctaccggaacaatgccaccatgtcaacacagtgtcgtcctcctttgccaaaataaggagtgagaattaatgaggcaccaaagtgtcgtcttaatttgccaataccgctcaaagcttccccataggcaaaaccaccatgaaaaaaagaacccattttaaggggttatatagatggacttgtatgtggccatctttttcctttttctcttgtatgtggccatccgatgctaaggtttgcctaaaaaacacatcgatttcccatcaattgcttccttgtcgctgctaattgtaactccgtcttgtctgatcccactgcaatgcatgcttctggaggcaaggaagtacgatcctaacaagataatgcaagtgtgggcaaagatgctgagatggaaaggaaagagtttggagctaacatgatctgggaggtgttagagatttagagaccattttagatgataggttacaacttacaacgtctaattaatttttggtttgttcttgattcactattgggttgttgtggtcagaagtttaagttcgatgaactcaaagacatgatcgagtactaccctcagagctaccatgctactgatcgtgaaggctgaccggtgtacatcgagaagcctggcaaggttgattgaaacaagctgatgcagatcacctcagcggatgtccatgttgtggtatatataccaatgacagggctccaaaattctgaatatttgtgtattgtctgtactattgaatttgtcattccatcagtttatttctactgttgttgcgttgtttgttgttgcaggggctaaagaatttctcaaacaccgcaaaggagcttgttcaccatatgcagaaaatagacaatggctaggtaattttatatttcaacggatgtgctgtgtatggtgtttttttttttgagaaatgccaagttggaaaggaatgacatgagcaactacatttgccaattgcagaaaatattggttttgagctattgctgtatcaagcagacatactgaaaggcatatgactttagtaagggttgatattgatctgttctttacattggcaagaaattgaccaggatatttgcaggatgttgatgaaggaagataattgcaatagtttttttgcaaaagtaaagttggatcagattattgtgatggtcttcagtgtgttggcttcagttcttcagttcccttgcctgctaatgagttctctcttttttttttgaaacctactaatgagttctataaatgaatttttaggaggaatagaatatttgatccttgatatgctaatgagttcgggcatttttcagtatcgaagggtactgtaggatatactatataaatgattattttaagaggcaattgctatcgcttgacttcagttcttcgctatttataaaacacattctatagtgtccttgttagggacaaccgggagcagttttttttttcaaatgaacctggagctatggttgatgaatcatgaataataactcgtgtttaatattaatccttctattttgtgcttgtttgaaaaagcatatattgtattcttttggttgtttaatttgtattactgaatgctatcgtagcgttagcagtagcacaggcaaattactagtgttgaataatttaggcaatgagcaaggcaaggcagaggcacaggaagagattggtttagattggcgcgcgtctttaacagctagcacatcctcactcaacaatcaaaagtgacaggtaaattggtcggcttagttgtagttgtagtatatatactccgttgtcaaactaactagtacgagtactaggtatatattacaaaaagaagagagaaaaaaagggagggggctagtagtggagaggaaaggggaataatttgatactcttggaagcgccggtcaccagaaacataaacagaaaagggaggaggatgatggtaacagatacctttcccgaggaggaggaagacaagctgctgcagaaggatcgggagcggtggcggagaagcctctgggacacggcgcggctgagcatccacgccgccgacatcgctagggttcggtggtttcctctctttcgattcgagttggaggttttttttttttttttttggatataggatattatgtgcattatgcagtaggctaccaaagatgatgggccgggcctacccaggcagagttaaagcccaaaaccgagtcctctccccctctcttttctttctagtctactacgagtagatctctctctctccgtgtctgtgaggtgcaaagcgtggaaccctagatctgatggcgttgcgatcggtgttggccggaaggttgatggtggcggctaaccgcgccttccgcggcaggcccgtctccaccaccaccaaggaacggctggaggtaagtaattgattagcttgttcatgttgttgcttctaatttaattgggtatcaccttttgatatcgatcgattaatttgttgtctctctctctctcccttgccctcgaggaatttgatcgatcgattttttttttggtgaattaagttgaagatgagcagctatccctggacgcaaaacgcgatggacaacaggctgcgggagggctgtgccatggctgtcgataaccacaatcggaggatcatgaggcttgctaacccttacagtgggtatgtttgtaccttattatatattctctctcttcttaacctttaattaattcgagactactcaatattataatgttcgctcgctgctaattaatctcctattatccccaactcaacagcacaatcgatcgatctacgcgttgcatgaactaatctatctccattcacatacattgatcgcaggccagctgatggagacatcctgtataactgggcttggagtaacaatatttctttccttatcattctctgctcgtgctttggattgtgtcatgctgtgctccatctgccgcatcacgcgtccaacaatgtgtccacagcataactagctaggaggttttattatgctataactacacaaatgtaatgtcctgctgaccgaaactagttaaagccaccattgaggttctgttggatatcatactctctatctcttaatgtactctactcctatacctactataccgccttaatttgtatgctatcgtgataacttgatagttgctttctatgttagctttatatatgtttctggattttctgttgtgtctgccccaaaatacaacttgctcagttgatatttctcatgctatcttttgatgatatgttcactacgtcggttaacatggcagcaatattttacttattatgcaatgaacataatggatctcttattgcaaaatcaatgtcttacttcatggatatgagagaataggtgaacagtcggaaggatcaataaatctctctttttttcatatacattcatggtttaggcacatctttcttgtgttattacttattagactggaatatcatcaagctagaatgtggccacctactactagtatcttacagcatattatagattcatagtaccctactatgatattgagcttggatttggcacacttcgtgcctgcatgactatttaacatgaacaatagtagaatgtgtggcttcgaaattaaagctacctccttaggtccctcttacctgatagggcaaatgtttccagtaattttgactctcttgccctgctgctgaagatgaacacaacatgtttgttgttattttggttaagtagtagtgcatgtgcaaggcatgtttttacaatatatatttacataagtaaaatcacagggaaaagcagtccttgcaagggcatgttcatacactgaattgagaaacatggcaagggtatgtctacacactgaagtcagatacattccctgtttaagttcagacaataatctggattttataagtgcctagcaatccaaatcgattgttaagtatgagttcgtataatacaaatgcagtatgaacttctagagatcaaatgaccttgaatgttaataggagtatattgtttacacatattgcaagggccaagattagacactaaacccgaacaaagcttacatccgttggtgaaatcgtaaactttcggtacttgatctactggaattcaaaacataacattaattagctcggcaaattaaaacattgaacaacatttagatgcttttccaagctcagattctaaatcagatactcctacatcatgaggataagcctgaaactaatacgccaaatgctcagaaaataatataagaaatgttcctacatcatagggatggcaacgggctgggtcagacaccgacagagcgaatccatgcccagcctgagacccacgtgcctgcatccgatccacatccgcgaggtctatcgggcaaaaatccatgcccatgcccgtgcccatcgggtacccgtgcgccgtcgccacctacgcccagcccgctgtgcgccgccgctgcctgcgccccgcatgtcgtgcgcgtgcacccagcccggcgccgcttgtgcccaccgtcgcagcccgcgctagcaccgccaagtggagtggacgtggggataggatttggggatattaggtttagggttttatgtggatatatattgctgctgctattgggccaaatgaagggaggtacttgaactattgaagttacatgggtcaaacattttcgggttgggcatgggttacccacgagcgaaatataaaaccgcgtgtgccgtagttagtgtgaccgttaagttcgcgggtatcgggtcgggcattcccacgggcaaaaaaaaagatgcctatgcctgtaccgatcgggtcgggtatctgcggatacccgaacccatgggaaatactggcatccagtgaagagagggttaatccggtgcaacgcgagaaagatatgatatgatcaggcgaggctagcacggtgcggtgccaggcagcggcatgggctgcgcaggcacggagggcgctgtggagggtggcccaagcagatgttgcatggcacggctagggaggcatggcggccggggtcctacgcggcaagccgaagggtggcgtggcagccgggcgggtgcggcacgacgggcggcgaccgatgtcatcatcggtgccctctttttttcatttttctttcttgttcttctcttcttagaggcagcgctcgcagctgcttgggcgtgcggcgaggcggcgagcggcacaatgtgcagcgccgcgggcggctgctgcagtgctactttttttctgcttcatttcttattcgttttgtacttcttttcttctttctctctcctgtcttgctggtgctgccatgacggccgacgtgggctcgccgttgggcgcggtggcggtgcttagcacgccatcctagtgtggcctcgggcacggctgtggcgcgggttgctgccgggtgcacgacggcgcgggccgcggccagtgtgttttgtcggcaggcttgcggccatgatgtcgcatgcgtgagctcgcagccatggcagggctcgggttcgccaccatggtgcgtcgtcggcacgctaataccgtgtttgccgaccgcggtttctaccaatcggcatacgccgctgactccaagtcagctgtagtagatttcgtcaggaatggcagaagtggaacgagaatgacgagaggaattcattttcgtgattaaatctgcgagttcttacccatcttttttctaggtctccggtaaaacgtcgtgctgcccctgtgctacgtgcgtattccaaaggggttacataatgtcaaccaaaaatggtgacgcaagatgtaagggtaggacattctctcattcatttatccattgctcaagcgaacaatatcttctcctcccctctatttatagagatagccataggtaatttccatatttagtgatgggtctaattagtgagtaactaggccaggccttcgtggaccaccggtttcctaatggttccttagtgcggtacaatcttcccaaaatcgcatcaatagtgtgaaacttatagtagtatagtgttgatgcgaaaaacacacactggcctgagagatttgcttcaatctagtgcaggtccaaagatttgctttcgggttctgagcgtgccagttggtttgatcctgcaaccaacaagaaataagaggaaacaaggttaaatccctaaacgatagccgatcagctaggctgccgataacgtatcgtccagtgtcatgccgatgtagtatgggtcagatcagcaataaaaacatgtaagataagaatagatagatctactcaatcatctgcagatatcaatgatatataatctatgcctcgaaatatgcttgaactaattgattggcatagatcatatagtatgccgagacagtataaatcacttatgtctagacagtataaatcacttatgtctaaaggtacttcaaagcaaagattatatatattcataggatagccgatgaagcaaacctaatgtgtatcggctagtactccgataccactctacactaagatgtcaacgtagatgaacatactgatcatgaatcaatctaatattaggaaaaacttaacagattgacagcaagcttaatatattttaatcaattgagatcttaatataaagggcagatttagcatatcaagtaaacatataagaaacaaagtagctaaatcaggtaagatcggctgaaaccctaatgctatctctattagcaattataagacaaattaaatgttatggttctaaacattacttaatagatcaaacttaactgatgcagcattaagcataaggagaaacataagatctacacgagctgataaaagcctttctgagatggtggatacactgtataatctaattcaatgtcggtatctaaccctatcggctgtttttgatgatggaggttagccgatggggttagataatgatattgatctagattatacctcatatatgataactcggcgatttagatgagcgagattagagtgtcatgaagatgtaagcactaatctcgagaacgcaagccgccataacaagctttaccttttcgtcggagatcgaaccctatgcagcccaacttgaaagcaagaactcgccgaaacaatgaaagtagaaaaaaggtggcgatgtgccgaaagtattattgaactgtccttttttttacatcgtctcggatcatatttatacccaaaatacataaaatgtctttgtcggacacgactctacctctattacaacttaaaaatatgaacaaatcctttaggtggactcttaccgaatatatctataaagaaactactaaaaacatcctaattaatagatacagttgccttctttggactctttccatacatggcattaattcttgtgcggcgtctcaatcgatcccaacaatgattctagaaccaccttcctagaattgtctagtttagtatcaactgatgctgcagacgatagccaagatgcttcccgtagccggccgatacggtttctgcttctatggacacagaccttctcgtttctgaccttggatccaatctatgatttatcaattttggtcgttaaatcaaaaccttgtgctacggtaggctcgaaagaaggctggtccggtttgtatccaaagataaagtgaataggacttttagtttcctcttcttcttgagttgtaagacgtcgagaaaagaaaagaaaaatgatttttcgagcaaaaaaaaaaaggctatcagaatttttagttgctgggccgagttctgttgagggtccaagaagaataggcctgtagagtaaaaataagacgatggcgggagagtgatcgaatgagatgagggtttccaatattaattagggatagtgctctcatcgggcaattccgcaccctaaccctagtcgccggaagatgctgcgacgaccagccgccacggcggcgggcagggccatccggcgagccgcgtaccactccgacggcggccctcctccccgcaagctccggggcccccgattcagccctctcaacaggcacaaccacgaggtaccatacctggccctcacattgttcctgcacccctaattaagttcattccttggtttcgatctagagtttaccaccccaaatatatagggttcatgtcttgttcaaagttaatatatattattatagtcccaaatcctcctgtgtcatctgtttatcattgcacttgtttcctcctagcttgaaaaaatttacctttttcatgtgctcccaaccttaccccgcgcacacacacaaaaacaacaactatggattcaagtatttagttactgcctcaaaattcatgtgcaactttccaaagtatttggttcgccttttgggattgctctatacggttgttaatttatgtggcaatcaaaagcacactcctcttgggtaagagatggcacggtcaaatttcattattgcattatgccatagattgtccatgcttatttatgatgaatgaatttgtacaattgagttatataatttcataaggttttaggcgttgtgatgtttttaaggtgtgttaagcatctgtcactttgcactagattaattctgactcttgctgttaccacagattaaaagcttgtcttttgttcaagcctccatctctaatttatttatctctataacttaaataccttatcttagaggttgaattaagaacgctctcacaagaaaaggaaaagctttcttgtgcacagtgcaatgtgccaaatgatgcatttaaagccttcatcttttgttcctccttcctatgttgttcaaagttagtttggtgaaaccctcgtggctcggaaaacaatcactgtacttgttcacagttacacctgttttccctgcaaactgggggggggggggggggatcaccttttccttttttttttacaaaattttacctgtcctcccatattgtcagggcttaaccactacaaattcccaaatatttggttcaagtgccaacatcaaacttcactcaattttaaattcagtatttctgatgatgctgcaatgttataactaatatgccaattgaagctcaccccccttgatgaaaataaggcactgtcaagaaagaacggagctgcaagttttccttctattatggccctctgaatgcatgttccctagattatatatcattgtgtacacttatttatgataaatgagtttgtggggtcgtgttccctaagattttggttgtgctcactgtgaagttgtaagaaatccagtagttgttgtgtgcttaattatgtagtagcatctgaacatcttactctaaaattttcaattctaagttgttcttttacagtttatacacatatgattagctttttttttttgcgcaagcattcatatacaatgtttttccttatcatagtggttgaatcaagaaactttcacatcttaaagaaaggttttgtcgggcacagtgcacttgtttaaaaaggatagatgctaatccttcatctttagtcctcgttcggaagtgatgaaatgtggatgaaatcaaatggatggtctgcttgattaacacaaaaaattaatattttgagaaatgaacttaacaaatactccctccatcccaaaatataaggcacaaccacttttctcttatgtctcataatataaggcgtgcatgcatgcttacattaactaccatcttttggatctataaaattgatttgttttaaatcttatatcattaaatctcccaattacattgcttgcatgtatcaatgtgatataaccatgaagttgattaaatgttttcttagtttttgtgctatgagtggttatgtcttatattttgggatggagagagtagctagaaacaagtgttctaagcaatacagtagaataaagttattttaaggaatcgtattttcagaagtgtggagcaaataaattgatccagggtagattatagttgatcatcacttcaaaaaggggccttaattagttttatggatgacttaattatgactctgtgggtacactgatattgtgccaaattttatggagaactgcagttaaatataattcttttgtgtaaatctgatagcagatgtggatgtctaatattacgcacgttgatatatgtgcaggttgatgcgttgctcgaggaagtcaagaatacgccggttagcatgatttccgattacttaattatcagaactgtgcggcagtacgtaaacctctgaattccagcttatgttattttttgttctgtgtcttgttaaccatcctaaattccttgtctgcttctctagttctattttggctcgtcagcagattctggttcaaaatgttctccggtcatgggtgattgctgcagcggttatctcaggctattgctgggggtacaacagagtgatcaccaaacgtcctgtggctggctctgaaccaccaacagaaggtgaggtggagtagaggactggatagtgttttcttttggagatgggagtctggaagtctgggagaatcaagaatgcagtgaagatatgtggcataatctatcctgtgcataataactataactaatttagtcctagatctaattggtgtgggaattctataatagtactattatatacatagatctcactcggtttgaccggcctgtacatgtgttcatgtggttggggattctctgttgctgaaactgatatatatgtgcactgggagatctctctttgggttgatctgtgcttcaatatattcacaaggttcttccattcaccgctccactgccaccacacatgataacaacgacgtcacccgcttcaagtttgcctcgctagctctaccgcaaggctgaacatgtgcgagtcccagctcgatccaccatgtactcacgctcacagtgtagaagtggctccccacgaaccagggccccatcattctgctccaaattttaaattttaagtttatttcataatatatacttttaaatagctaagaatgtatatatatacaagtttaatttactcacaaattattttgtcattgataataaacggctcggataaatataagcgaaaagatagggcactagctgcgcctgaaaccgcaaatagtacgtacacaagtagtagcatatgtttaggttcataattactagaattggattttatttatttatttactacctgagtggccgtgagtttcaacgggataaaaatatattgaagctaataatatttaacaatttgctaaactaaattcgaattaaaatcagggagaatctaactccccatctgatttgctctcgatttgtgcttcagtgagtttctcctcgatctaaaatttgctcctcctatgtgctccagcgagttttttctccaacttgggtgaccttgatgaagactcagtaattaccttcaccggttagggctatgacttccgatcgagttgaggtcgaggtcacttgtggcaattttgcaacaaggataacaatattttatagtggaagtaaatcaaatgtgttatgcttttctaaaaacgaccccttgtatatataattatcctcgtatatagagagagagaacaagacagagaagagaggagaataaaagagaaaagaaaaaagagcaaaccctagggagcggggatggcggtggcggcgcggagggcactctggtacagcggcgtgtcaccgaaagcgcggcacatgaacagcgggcgagggcgaggcctcgacatctctgagcctaatggacctctcgatagctacatccggaagttgatggtgcgtgcgtactccgcaaattaaacccgcttcgatcttaatttgctacactacaattttggcctgaatatctgctatatggaaatcctttttgctgtgctgtacaaaagtataactgccaacctgcttgtcaactcccagatgatctaataaatctctggatcgtcagggtgccgtgctactcttttttattttttattttttgaggggaggtacccttgatttttttttccgggatttggtcgtcgacctaatttcattatgaagggaagttcagttactacaaattacaacactgtgcttaattacaagcctcagtcccagcaagcaaagaacatatataacagcccgaaggcttagacgctaatggatgctactatatattacacgccgtgaaaactcctgcggccttccacaccatgcatgatttcctctttgatctcttccaccagctgcatgctcagtgttgcgctccttccacagaaattaagctactcttgatctagctggttttcagttaagcaaatagcctcctgtctaatcgtcctggaacttggtgtgtgaatcgccttagcttgtactcactcaaaccccctattctatgtggggcagctgctgcttaattttctgttcttgattatcttgtgtgatgagttcaggtaggaattcagtccaaacatttatttgaaatgctaaccatcaaactcactgcaatcaattgattattatcttactctttcttgctttttctcgtatgaagagtcgatcagattcttttttttttgtgaataattgggctccatgtattttccctgaagtgggcctctgagaaggggatagtcagtttttataaagtattccacaagtgcaccgagcctgaattcatggagaaatacattgagctaaaactgtgttttgttcggtggaatgtggaaataccagatgttcccgaacatactaatgtcagtatatccttgttgtctagtgttctttttcccttagttatatccaccctataactaggtctggattgaaacttaacctgttttgggaattttttttctctcttgaattcttgggatctgggtttgaaatttacactggtacgtcgtttgcagcaatttatccaaagttcccaacagaacagtgacagtcataaatctctttttgagtatgatagctttctgaatgtgtgaggcaatacgaaatcttaagtggagcagactagaagaagaggaaaattaaagctccatatgcatttgttaactggaatgcaccaacacgcaatttatattacccagtggatttatttcagtaggacactgctggagttctttttttcttgtaccattttttaattgggatggaagtttggagaaattttaactttgttatgttcttgtttttctttttgcaccacttaccaggattcttatttccctgcccgtactaatgtcctactagcgaagtttcttgtgtttttagggctgtggatttaaatgtgcagatcaatgaaaattgggatatggactgaattttacctgtcttccaaatttagtcttgattgctttggttgggtatcacaactatcattagttttgtgcaataccaagtatggccccgtgtattggtatggtttgctttgttgagactgaacatacaggtgagttgtgagtgtcgaagaacttaatcaaaaaataaaaatgcacagctgacacgaacgcaatggcctttttggctatctgacaaaatttcgaatagaagagggacagtcctacacttgtacaaaattcgttcttatcctccccttacgactatgatatttatctgaagtaatacggataatatatattagtacattacatctttggcttgtctgaggttatcgctcatctaagccttcaccatacagcttctggcatagaaggtttgtatattaatcatgttgctttgcaggatgcaggaaacctggaggaaataaacagaatagggaagattttgtcaaaaagggatatggtgaaacaaagctccgagaggtagaacttgggatgcaacatgcatgaatttttcctcactaatgtacccttgtctctgcacacatcataatactccatccgtttctaaatatttgataccattgactttttagcacatgtttgaccgttcatcttatttaaaaacttttgtgaaatatgtaaaactatatgtatacataaaagtatatttaacaataaatcaaatgatagaaaaagaattaataattattaaaattttttgaataagacgaacggccaaacatgtttaaaaaaagttaacggcgtcaaatatttaaatatttagaaacggagggagtataacacttttcaatatactgcagcctgatctttaagcgcaagaagaagatgggcacacacaacatgcaagatatgtggaaggttgctggcatcactagttccgcgttcttgttcgggacagcattcatttccctttttgcagggagcctgcatggagaggaggaagaggatggaattctacaagacaagaagaggcttggacttgaagagtagtaagagggtttaagtttaaccttaagaccgaatataatggattagaaataatgcttccatccatccatatgcttaaatcattgttgacttgagacctccccttttatatcatgtaactgcagtacttagggggt

SEQ ID NO: 66601 - DNA, 2287 bp, Oryza sativa
atttttttttgtttttataaaaagtttataaaactctcttaatagagaagtggtgcgtccactgattttgaaaaaattacgggggccccccaccttcccctcgaggagaaatatttcttcaaaagagggaggggaagaacacggagattttttccccccctttaggagggattttttttttttttaagggccctttttgggtgtagtggaaaaaaggccaaattttttttttaaagcgcgccccttggaggagaaatgttatgggattttcccccaccccttcccgtggggcggggggtttttgaagagacccccggtttcttttttttggcgccgttgtggaggttctaaaattgggtccccggttttacttccaatcccaattaagggggtacaaaggttttggcaaagaatttacccccccccccagtgtcttttgaaggctttttgttaaacacttgggttggtgttgcatttcccccgcattgccatggtttagccggggtgtcacgttggtgcaagcccagggcccccgttgttggcccttgggccccggccggaagcttccaatgaacggctaccgccgttgaagggccgccagcgaccggccacagcctgtgggcctcccggggaaggcgcgcttgcagctgccgatcggtccgcggctctcacgcatcgtgccaggccaccagtgctcaccacaccgtgccaccattgcccacccccgccagtcgccgccgacgccgacgccgacgccaccgcccgtcgctgctgtagggaggaagatggggaggagagagaattggaggagatgaggtgtgaaggggtactttagaggcatttttgtgtaaatacattaaaaaattaaagggtagagggtcttttggggtggagtagagctgtggagcagcaaaagcccacctccacccccgtagtacaaatttgtggagtagctctgccaactccactccaaaaaatagaaaatttataccgtttggcacagttccagctctagataagttggcgttaggagctagagctgtgctaggccttattcttaatcaacattctaatctatccttaccatatgagcatgacccgttataatgtaggggtatattacttatctattaaatggtaaattattaaagtcatctatactcgagcaagaggaagctcgtgtgctggtagcacagtgcacgttatgtgcacagcgccatagacctagcttgaagaatttcccaaaaagaaaaaaaaattcaagtgattgagtgctctaaataagcatacaacggaagaaacaagggaatttaaagaaaacaatgtgtaattcaagtgtagaaggatgatatgtcccgtacaatgggaatttcattggtatgtgggaaatttcatttacagcattgtatgcttatttctcaagcatagaatgaggatagaggctatcgtatgctagtaatggttgggtccatacatggctttttttttactcgtgtggctcataaacgagtgataaggttatttgggcgtcgtcgttaagatctaaggctgagttcttatctatacttttccaactcacctccctcatttcccgcgcgcacgtttttctaactactaaatggtgtgtgtttttttaaaaaatctaaatgaaagttactttaaaaaatcatattaatctatttttaaatttattttagttaatacttaattaatcatgtattaaacattacttttgttttgtgtgctaccaaccctcactcccaaatacaccctaaagatagtggtcatcatgggctgggcacttgccgcagccatctgagcaaaagtcagtccacgcactcgcaaaactaccgcaaaatactagtacctctactgatcatgagcccaatgtacaaaacatctcggcctcctccactaaacaaaactccattgatcattatttccttacctcattgccactataagcacaacacttgagggaggagagcgacgctgatgccgcctcatataatctccatcctagaatgtaagaaaattatagcaaactgatggttgagattaaaatagtgcggccgtgtctttacccttacaacgggaaggaatacgtgggaagaaactgatggtttcacatgtggtttaggttaaaacttgctagctgccaacgcttcttctcctcctgatcttattattttctttttgttgccttaatcttgccgcctaagctaatatccattgtggaacgctgggaaaattacagaaactggtggttgaaacttgaaacgtgtgg

SEQ ID NO: 66602 - DNA, 3800 bp, Oryza sativa
  unsure (1)..(3800): unsure at all n locations
tgtaaaannnttagaatccctctcgccacccatcaaatattgcatattccctatgagaattgctatgaaggctactcgccaaagaaataaaaacacccataaagataattaagcaaacatactgataaattgataatatttaggtttggtacaaatcaatcatggtaaattgatgtcttaatcctactgggagttttcctttagataagtatgacaaatcacagactctaaaatttccattctcatgttattgtggaggatattatccatcctattatttgtcttctcaaccatttttgtgcatcgaaattatcatgttatagtgatgtgttctatcaaaaaaattgcacctccaaatacgagcaacacatagaaatatttttatcaatcttgcaaaagtggtttataaaaggtagctctattattgataatgcccttgtctttgtatctaatttattttgaggcccattctacttcacaaattcttatcttaatctttcttcaaatattaaacctccatcaaaagcatacagtaaaattagcttaggctcttccaatgtcttctccgaatcaagcctggaactttcgacaagtgtagagtggagatgacaaatattgcttgaatgaagcattttccctacctctataagcatacaatgaaattcacattgtacacatgggtaataagcatataatgggaatattgcttgaacatgagaaataaggcaataagcaatgtacagacattttctctttctcaataggcatacattgggaatttcaagtgtagggtggagacgccaaatattgcttatcccctatgaaaatttctatgaagactactagtcaaagaaataaaaacgccaataaatataattatgaaaacatactgataaattgataataagttaggtttggcacgaagcaatcctagtaaattgatggctaaagcctactgggaatttttcttaagaaaagtatgggatatcacagcccataaaattttctattctcatattattgtgcaggatattatccatcctattatttgtctcctcaaccatttttgtgcattgaatttctcatatcatagtgatgcgttctataaaaaaaaagtgcacctccaaataccaacaacacacagacatgcttttgcacaatcttgcaaaagtggtttacaactagtagctctattattgataatgcccttatctttgtatccatattctgaggcccattctacttcaaaaattatgtttttttaaatctttcttcaaatattgacctccatcaaaagcacacagtaagattggtaatgaatatgaataaagaaatcttccgatagtaacactaagtataggtatgttttacgctgttttctcaattgtttttgttcctcgaggaaattaacgtatgcaaagctattttgcataaagtttctcgtgtgtgcacaaaatctcgcataggtcctcgaaccacctgaagctaggtgcgatcttgtaaattaatttaaaagttgtgccaactagtgcgacaacttgtctagctgctatgcctttgatcttaactaagaggtaccacgcgggcaatatttgcacaccaacaatatttacaaaaccaatttaacaacttgtatgcatgtagttgaatcagctaaggaatatgttggttctttttactatattcacttttacagtataaataagtgctaattaacatgtttctgaaaaaaatattgtgcaaatcttatagagctgcaatagttactgatggttggtgtcatacattgtcggttcacattaaagtactcgagtagagttttcattcgattgtgtggcatagaaacgagcgatagaggttatgtgtgtgttgttaggatatggagacagtggtcactgtagactaggcacctaccgccaccagccaagccaaaatcagtccaggcgcgcaactctaccacaacaaactagtaacgcagccggtcgtaagcccaacgtacaaaacatcccggcctcctccactcaaataactccatcaatcgttctttccttgcctcattgctagtgtaaccgcctcattcgatagagggaagcgatgccaacaccgcctcagctaatcttcatcctggaaggccaggaaattacagcaaactaatggttgagattgaaacaacacagtcgtgtctttaccctcacaacatgaaggaatgcgcaagaagaaattgatggtttcgaatgtggtttaagttaaaccctgctagccgccaacgcttcttctcctcctgatcttattattctcttcttgctgccttaatcttgttatgtttggttcctgatcggtgaggatgggtaagtagggttaaaccattattacttttttccttccataactaattggcaggcatgttgtgtttgattcgtttaagttaacaaggttatgcagcggtcgttggtgctaggaagagcaagaagcaacaatgcattacctctccctcctcagcgatcaacttaggctcttccaatgtcttcatcgaatcaagcctagaactttccacaagtgtagggtggacacaacaaattaatatttcttgaatgaagtatttttcctacctcaataagcatacaatgaaattcccattgtacacataagaaatagacatacaatgggaatagtggttgaacatgggaaataagacgataagctaagtacaaacattttccctacctcaataagcgtacaatgggaatttcatgtgtagggtggagacgacaactattgtttatcccctacaaaaatcccaatgaagattactaggcaaagaaataaaaacactagcaaagattattatgcaaacatattgataaagtgataagataggtctagtccaaagcaatttcatgccttaagcccactaggaattttcctttaggtaagtacgacatattacagatcctaaaaaaatttgttctcgggttaatgtgaaggatattgtccatcctattatctgtcttctcaaccattcttgtgcatcgaatttctcaagtcatagtgatatattctattaaaaaaggtgcatctccaaataccagcagcacagagaaatgcttttacacaatgttgtaaatgcggtttataaaaggtagctctattgttgataatgcccacaacttctaatctaatttatcttgatgtccattctactttacaaattgttctttaatctttcttcaaatattgacctctatcaaaagaacattataaaatttgcaatggatttgaattgagaaatcttccgatagtagcactaagtatagctctgttttctgaattgtttttgctcctcgatgaaattaatgcgtggaagactattttgcaaaaagcttcttgtgcgtgcacataatctcacatatgtcctcgaaccacctgaagctaggttcgatctcgtaaattaatttgaaatttgtgcaaactagtgccacgacttgtctagttgctataattttgatcgtaattgagaggtactatgcaggcaatatttgcacaccagcaatgctttcaattgtgtttcgtccactgattggttaaactatgcttgtatgcatgtagttgaatcaactaaggaatatgtaggttctttttattatattcacttttagagtctagataagtgctaactaatatgtttcttgaaaagaatattgttcaaatcttaaagagctgtagtagttagtgatggttgggcccaaacatggctttttcacattaaaattttaattaatttcccattcgaatgttagaca

SEQ ID NO: 66603 - DNA, 2483 bp, Oryza sativa
  unsure (1)..(2483): unsure at all n locations
caaaagagaataaaaaaaaaaggtgagaaagaaaaaagagggccccttatggaagttattaatggtcattaaaggggtgcgccctgctcctgggagagaaaccttttaaaaaaagagccatatttggaattttccacccacaaagcccccttttttttttttaaaaacagacttcccccaacagcaaacatttttccatggctttgggagcccacaagagtggcgaaaaaaaatgttttcatgagtttttataacacaaagcaaagtatctggaagaaataaagaaaccaatcttaaaaaaaaaaaagataagtaggccatccttaaaaagaaaggaagtaaagttgaccacttaattgctaatcattggtccacagcaaaaatgatagaatttactgagtgcttcaaatttctgaaatcttgggcttttctaaacacaattaaatttctgaaatcctcggcttttctaaacacaattgcaactttcaaagattcacctgcaactctctgtaagtaccactgttgacactgtatgcctaatatcctgtaatcagcaatcacattacaaaaacatgtgaaagtactcaaatattaagtaggtgctatgttcatccagacgacgatgtgaggtagcttatcctttgatgtatttcaattacgaacactgaactgccaacaacaaaaaataactagtattacactgcattataagttcagattccttagaatccaattacattgttgtgcgaatttcattgagctatggattttgggaagacagaagatagaacgaataataagcaaaaggataagcagtgcctttcctaaggcaacgaaacatttcgacattgaaacaattctatggctggccatgatcttcaggttgctgatcctggcgttcaccttgccaagcccaaacaatgtccttaagagctggtttcatgtcctccttccacaaatgttggtattctagtgtatctccattgttcttcttgatttctaccaaatgaaatgaaggagtcacctcgaagatctctgcatcgattgccaatacacctttccttccttcacttgcaccttccattttcagcacaccaccttctttctttttcactgtcaacttcgaacatgaggcaacatcctctagttttgagataatagctgaagctgattgacttgatgtaaaccttgcttctttctttttatcagtctcctcaaacaagccagaaagatcaaagccttccgaaagagaaataatatcgaaagcgttaaggttggttagctttcctgcatcctgtttctcctcagtctttttgctactactgctacccatggaggagaaaacaacattaacatcagcaagagctgtaactggttcatttgtctccacgttcttaaggattagcttgctatcaagtcctttcttgaaccagtaagtttccattatttttgtaattggcattctacttcttgggtttggatcaagaattctcgaaactaattttcgtacatcagacgaaaaccaagctgggcatttgaactctgctttcccaatctttctgtacatctccatcaaatttgaatcttgaaaaggcagataaccagccatcagaacaaacaggatcacaccacaagaccatgtgtcaaccttgacaccgtcatacccttttcggctgatcacctcaggcgccacatatgcgggagttccacaagttgtgtgtagaaggccatcttgtcgtcttgattcagcaagagcgctcaatccaaaatcggtaattttcaggtttccattttcatcaacaagtaggttctctggcttcagatcgcgatgataaacgcctctactgtggcagaaatcaacagcacttactaattgctggaagtatttccttgcagcatcttctttcaacctacctttagctactttgttaaacaactcaccgcccttgacatattctagcacaaagtatatcttcgatttggtagccatgacctcatacagctgtacaatgttggggtgcctcactaatttcatcacagatatctctcgtttaatctgatccattaggccaaccttaaaaattttgtccttgtcgatcaccttgatagccacactttgtgaagtcacgatgttcctaccatgataaaccttggcaaaagttccttgccccaataattttccaatctcataccttcgcagtagaatgtttccattcttctcaagttccatcattcaaaacaatgctagcggacaattctttattggaattntagaggaaaaccgtanaagcaaaaacttcaaccatcatcagaaattgcatgatctagcatagcagtatttctgacattgatagcatcattattacttntgtgatgcagaatgcaccangtgagcaactgaaaatctcgctcattcaagaaaaatttagggtgggaattggtccaaaaaaaatccaaaaattggggggggggaaaaagaaaat

SEQ ID NO: 66604 - DNA, 2506 bp, Oryza sativa
  unsure (1)..(2506): unsure at all n locations
accgcctttaaaaatgtgtgtcaaccgcccaaatttttgcggccacaaacccttagaagggttccacaaaaaccgaaatttccccaattttcctcaatctggagaaatttcttttcaagccatttaaaaagggggntattttttggtttaagaacgcgaaccaaactccccttcacaattgttttaagaacgtgttttactataagaccattttttttgtttgcaaagcccgggttacattaatacctcgttttcaaaatgggtgtgcaaccaatggagaaagccttttttaatggaatattttttgggggaagcaatctttgtgattccatagagggctttccgggaacttgcattttgcattccaggcaataagccatggtactttttggcagaaccaaaggagcgtattacaatggttaaaaagtgaaagaaattatgcagatacacagtaatgggtgaaaaaatggtcgtcttgttaactattgagaacaaaatgcacatcagttgaaagaaagcangttgttgtagcaataaggttagatgtgagtccattaattgattacaagggtcagtttgtgtgtgtagatgtgtctatctgttccctataagcttggtctagcagattaaggctacttttcaagcctttgaagcaaggtacaggtccaatgaaggttgggcttaggggtgtggcaaagcctaatctcaagttgggccaacacatgccctgggccgatgtgtgaatgtgaacaattcacctagctagaagcagcatccactcaggaaaaagaaaagctaggaacagcgatgcactcatgcacatggataggtatgtggccaattaacataattgataattcaaactccagtaagtccaaatcatattttggacaaaagcaagcaaacagcacatgtgcacatgtgcacctaaagacaaaggaaatgcatccatataaacatttggcaaaattttccaaacaaactctgccaaagagaaaatcagaatatatctcatttgttggcttaaaaccttatagtatgtagacaccgcatggccaaaaaatgatgatgtaaatatcttgataaaaataaaaatatagcaatcagtactttagatatatactttaattgactagaaatcaggtataattttattattaaggcccactgcagtaatggattccattactgttgtccttatcagcagattattaaagtttggtaggaaaggtatgtagaacaaagtagatcacctaaacctttaaaggaattttttttacaataaaaagcagagacactgagaaagcacaaggtaaaaccagtgataaatcaacccagtggattatctgaaattttcttcctatggcaataagtgatgtggaattgtggatagtctgagaattcactaaaacagcatgacttattctgtagatttaattacagctttccaatttactgaagtaggtccctaaccagttaaacaaaaatatctagagaaacgttttatggaaaggagttgaactatttggctggatacattaattagcagcaagaatatgtgcaatcaattactagtaaataagaatgctaagcatccttgacagcttgacctgtatcactcaacataagtatggtcaatgaacactcaataaaaatgaattgaagcccatgtggaagtgaacatgcatgatggttttcgaacacgtattagatggaggttacctaggggttcaggtgatataatgtagatattggaccacacagtattttttttattccaagtggaaattttgtttgtccctatgtgattaacatataattgagtgagagatgcactttctgtaaaagtacaccatatttttaccataggcatagttttaggcccatgaaattgtagcgggcccagtggctaaattggttgtgcagagaaaggaaatctagatctgaacagcaaattctatttaacagatcgattcattcagtttcaccagaagacacactgacacacaggtaataccagctgggttaattaagaacgtcaatactagaaatgggttcacaggtgatagtctctctacctctcttaatcctgctacagcctatgaccacacaagaattcctggtctggtggttatgctacttaaaaaagggaaaactctttacgaaagagagctcagttgcataattagcgcaaacaaactatctttatcattggaacaccgacaattcaaaggggaacccgttgatattgagctaagattctaccaccgtgtaaggcttatgaaacctttcagtgttgtnggccccggagacaaatttttcttgggcctttttcccggtttgtaggatcacggccaaagtttatgaatttctattacttttgaagaccgacaacccattaggggtttatcgcgccccctttaattgaacccaaatctctcgggttatggggatttgcttatcccaaaaacccttaattatgtgtgaagacacaacgccttcccct

SEQ ID NO: 66605 - DNA, 4346 bp, Oryza sativa
  unsure (1)..(4346): unsure at all n locations
ccctccaccaggaaaaacgggtgttttaaaaagccaaacaaaaagtgttcacagaaaatgtccaaccttttataaccggacagcccatcgccccaaaattcctgtgggtgttttggcctttaaaaaggaaaatttttaaaaaaaaggtcagttgaatataggccaaaaaacataccttaatttagggaaccccccatatccaaagggaaaccgtgaatatcggtttagcactttaacccccggtgaaggtagaaggaactcctccagaagctgtgggcccggaaaacaattttcttcggtgggcttttcccccggtttgttcaaatcacgggcaaaaatgtataatgaaatttccaacaagtcggtcagagttttgacaacaccatgaagggcttcatccgggcacccaatttcaattgaaccccaaattctccgacgggctaaatggcagactcgtgcttaacccaagaaacagccttaaatcaactgggtaaaaagcacaggagggcacaaaccngacccatttcccagcgcaaaaagaagacggatacttttaaagcaccacggatgattgcagccggctgccaagaaacccgaatccgactcccacgacccaagaatgacccgggggcagcaatgcaggtttgcagggtgggacggggggctgctccgatcgcttcgttcgttccttccttctccactgctgttcttggtgaagggaaggttggggcaggaaagaaaaagtgcggggaggaaggcaggaaagtggggaggagagaagagggatggcggatttatggtgagacggacgcgaggtcatgtatgtggtccggcccttcgctggccaccaaacctttcactgcaacgggtggcctcaattatgccttttggccctttgcactgcattattgcttgcttgcttgtttgatttcgagggttttctctaagggccttttgagttcgtgaacaccaaattttttaacatgtaaaatcgaatatacggatacatatttaaatattaaatatagattaataacaaaaaaattatagatttcgcctaaaaactgcgaggccaatttattaagcctaattaatccgtcattagtaaatatttactgtagcattacattgtcaaatcatggcaatctacacacaatttatgtaattaatattttttatatttaatactctatgcatatgtctaaacattcgatatgacatggtgaaaaatttttatttaaaaactaatcaagacctgaattgcctttgcaaagtgtcagatggtatgtctgggaaaatctaagattctaagaatcaactgctccttccattttatataatataagacataactacatttatttaagttgtttcataatagaaggtgtgtataaatgcatgttattaactagcacatctttttcattaaaatattattatttaaatcatctaccatcaagatctctaattttattaggcgcatgtaatatatttattaaggtaatccaaactatgatggtttgggtggtcgtgtggaattgagggagtacttgataattaagatataataatacggaggagctgtgaaacccagcttcttagagtttagctcgttcatgtttcagattatgtatgtagagcgtctcagaatctcaatgaaagtacatattattttggagaagcctttttatttcgagagaagctgcagttgtcaaaaatttttctaaacaggcccagtgactctgactcgtagttaagggtgcattgtccactttttaaaattgtactccttcatatttcacgtgcacgctttcaaaattgttaaatgatgtgtttttgtaaatgttttctatagaagaattgcttgaaacaaatcatattaatttttttttcaagttttattgttgacataaaaattatgggtacttccactttaatatttgtttaatttgcctctaattattggtaaaattacttattttaaatacatatttttgttaatcacataaattttcttccatcgcctcttgcacgaaagcgaccgaggcattcacttgttgctcccatgatacgatcattacactaacacgatcattacactaacgcgtcaggtacatcattcatatcatacatgtgcatagtggaataattatccaaaaaaaaacatttgtgattattattggtcatactaggttgcttaaaaaaaatttcagttaaactttatccactgggtatattaccggtacaacgcacgggtattttactagttttttttcatataaaacagaaaagtctgaaaacgcgtggaccaattttggtaactggccgaactcccattagactttacgggcaaccggcccatcacgcttttttgcgtggccgtaatcgaaaagaattcgtccccctagttgtgtccccggggagaataaatttcctaatctaaattattccgccaaaaatccgccgcgattggccaccgctggctccatggcaagcggaagcggcgagggcaagggccgccgccaccaggacaatatcccaagcgtcgtcctgctcgagctctggggccacgtcgccgacgatgaccaccggcctgacgccaccaccgccacttccacgacgagcaccggcctgccaatctcggtgaccttgtgcgccgccaccccgccaagcctctcgcacctctccgtcgactgccctggtctggtggatctggatcccaatcccttagataagtttgtggcgcccacggtgatcagcacggatgccgacctcgtcctccttcgtgtccctgtcgatcgctttgccagatttgatcactgtttcagcgactacttcgtctacaaggtgcactctcactctgaaagcgcaaagctgcaccgtctcccgagcccacgtggccgtggctttgcagacgacaacattgccatactgagctgcggcaacgacgacgacgactcctacgctgtggccgctcttcaacccttgcatcatgtccacttcaggcttcacctgtgtcgctctacccccgatggaaagccagggagttggacctcccatcagttgacagtggaggagccgctgaggggaacggtgtgccccgtccctgactcagcactgaggaggatcttccatgccaccaccaaggtgattacgcttggaggtgctaaaggtacagttggctgggttgatctctggcgaggcatccttctctgtgatgtgctcgacgagattgagagccccaagctccgcgatttgccgctgcccttgccctctacgggcaactggcctttgttcctcaatcgctgcccctactattgtcgtgacatcgtcgtcaaccagagcagagacactatcaagtacgtcgagatggaattcaccatcttgaactcatctcaagatccacgctcctcgtatcacgaatgggtggccagccaagaatttcgaagttcgcatctagacatcttggtcgatgatggtagcttgaagatcaacacatggaacatgcctatcccggtcactcatgggatgactggaagcctggatgctccgtcacttccaaccacttggacactgccctgcatagttacatgaggaaaatagactacaagaggaaaaatgccgccatatccgtggagagtcttcacacggcttaccctaccctgagcatcgctgatgatgatgatgttgtttacttgctatccaagcgcaccacaagtggaaactattctaatccctcgaggagatgtttcctcgtttgctcaaaaaccatctaaatggttatgaaaaattctggaaaaatttgacaacattcatacaacacatatatacaacttcacaaaatcttaagtccaaactcaactcacacgtcgagatataaaaaagacaaattcagcgtatgaatagtagagtactgtttatatctaaatttgtcttttttgtttctcgatgtgtagatcgaatttgaacatgaattttggtggactagtaggtatcattatactctacattgtcaatttttttttcagattttttcacaactatttgcatcgaatttggaagaaaaaggtataccactccccaccacaaggggagcagccaagatggtattcactcttaacatgagggcacgtgttctcgaagaactggagaaacttcatagcatgagtcaccttggttttatgcgttgcttcctttccactgggatctccaaacatcttaagcctacaggtaatttgctgtgatatctggggaaatttatatataccttatttgtgctgtatgagttgaaaacaaaactcacgctgcaggccgtgcatggttggaaaacaaagctcacgtgaatt

SEQ ID NO: 66606 - DNA, 55130 bp, Oryza sativa
ccccccccccccctctctctcaatgggattttacactgagtaggtaaaacgagttactcgttgattggtatcatgtctaggcgtttttcccccatttcatttgaaggcaagtaggcaacttctagacacaccacgcccatagaaaaaaatttctaggcgcgtcttgaaactttattttagttttatgaataggttgagcaaaattaatgcatccaaaaaagaagcatagccaatatagctacccataaaaaaggatagaattgaaaagatatgcatagccattatagctacccctaaaaaaggataggaacgaaaatatagatatgctcagatgcatcaaattaatcactacatcatctcattgaaggatctttttaagcaaattaagtttatgatatatagatccatgtgtgtataagttaaataatctctattgatttcttaaaagccatcttacttttattccatgagaacaaatgaaatttctctctagattaatatatatatactctgtccgtaaaaaaaatgcaactctatcattcaaattttgggggaaaaattcaaattatatagtactacttttcctctaactactcttatcaaatttctctccacctttaccccaatggcccaatcacccattattttacgagggacatccaagtcatttttcctacactactattttactcccctccggttccataatttgatgttttaaccaaggttgaggttaaattttataactttgactaacaataactttatatatatatatatatatatatatgtcttacaaataactataataaaagtgaaaatgtatttatttattatatatattataataaaaatatagtcaaagatatattttagataccgtattattgtctaaaacgttaagaattatagaactagagggaatgtaaaaaaaaatgctgcaattgcattgtttttctactccttttgggacaaaaggagaagatgcaaatcatttttggtcacacttcttcttcttttttttcggcaatggcaagaattggccattgccaattttttgtaccaaaaagttggctagacatttgcttaccttttttttttaccaaagttggctagacattttcatttgctttgctaccaaaagttggctgacattcacttgctttgcaataccattttttttctacaaatcaaacacatgactattttttttgtcattgccaaaaattggcaattaaatatttataaaattcaaaacaatattaataagtcaatgattacagctccacttaaaaattttcacacttttatttcaccagagaataattgcattcacatagacatacttgtatgttgttcacctttaggcactgattgttttacttaaaaacttcattataaaatgagtaaataatattaatccaagccaaacaagatatatctatcacctcccaagtttaggagaattaattgaagaatgaaaatagtgaaccataacgtcaacggataatttcttacctagaaataaagtgcatccacgtataactctcagcaccctcccataaaaccaacccctccagccaccttctccttcaccaatgcgcctagccgtcttccttagctcctctttggactcatccgtttccaccagatccccacgttccttgcaatcgattgatggagcctatgggaatcctgaagtgcccttccagcttgaagctctccgttgctgttcctggtcatgccctcaaccccttctctggtaagttcataatgcaaccaaacacgcgcaaaacattaatttcattttatcgccatgccaccaaaattgttgtatgggtgaatttttgcatgtgtatatgcagatggcggtagtggtagtggtagtggtagtggtagtgggtgcaacaacaataacacaagagaactgggtatccacttggacttggaccgcccgtatgcaagagaagagctaccgcagcaaggtggcagcatggaggtgcagaaaggggaggagagaggcggtgttaggcacaatagctccaaccataggcggctttctagggtgcaatccaagcaacttgatgaattttatcgtgtaaatcacacagttgattccgtaagcatgtttcttttttcaatatttaaaatcaccacagcctttcgagttattagttcattaatatttgaaatatagtagattaggaattagatctatatgtgaagaatggatttagaaaccattagatcaagcaagttaaactttatcactagtattttgtacaaccatatgcatgtgcttgaatttttcatcgaatatttgttttgatagatcacacgttactacacactagtcaccaatatatgtaaagcagaggttattattgtgaatattataaatattaaaaaataataatacaccaaatattggttatttgaattttgttaatatatatattttttttcaaagttctaagtattttttatttatagttcaaaagaaattagttgcaatatgatatataaggtccatcctaaataagaaatcttatgttattttccattttcttaagttgagaattttaagtttctattcagtattgtattaatctttactcgtataaaaggactccaatggatagccatatataaccattgtaacttttagatattaagctatgaactttctaatattagataacaactaatcggatagccatatataaaattaaatcaagatgagtcttctctatatgaaaatgtgaataacataagtcttctctacacgaaaatgtgaataacataagtcctatctatatgagaatgtgaataacatatttcatgaaaaatatgcttttatttattttagaaaataatatggtattttttttccttttacctatagcaaagcatgggtatttagctagtttaacagagattcagaattgataagcatcaaactgcatatgttaagagatttcaattgtagatttttcacgatttaaaataattcaagactttataaataacttatatcaacttatactttgttttgagtctctatatatcatttttatgattagaattatgaaattagaaattgataaggaagatgtttatcaatttatagccccaattatatcttttcagtaatctaataagaaattagaattaagcaatattgaatcgtacatggtttgggagcctcgattataacttatacatgattctactcagtttttgagagttatagctttttcatgatttaataattttaaaagttcacagttaattaatatcgagttgtgttcgctttggagtcttaattatagcgtgcttttccataagtttgattgactgccatgataattcaatccaccccacccaatcaccatttttttcctagttaagatcaaagctctctcaaagtctccaattaaaacaagtatagacagatttagttaacttcttattttgcaatacaaggatacaactggtgtttgtctttgtattgctacaatgctatactagagttcatgatgcttgcttgtactgaactaaacacaggtcgagcagttcgtacttgccttgaccgttttttttttttcaaataattagtagctcgattgttcattgtcaatggagaccagtcacttacgctctaggaaattaatggaacattttcagaaacaaaagaaggagttggcagatcgactgaatcttcggataagtcaggtggatgcttggttccgcaaccgcaggttaaggtaattagaagttttttcaatgctctcactaattagaatgttcagtcatactcattctttcttacatatatgcgtaattctagttctggttttctcttgttctgaaggttaagcttatatcacctttaacaaaaagagagataaatctctttgtttttctttaacgtgataaatctagattgagccgtgcaatggtctagacttccattctaaactctgaaccttttattttaaaaactcatgtctgaaccattgcacagctctacgccgtgtaatccttagatcctctaccataatgttactatctttacagtcattattatgtgggtctcacctttctattaccccacatgtcggtgtctgtagaggatgtgaacccaatgattccagtaagaaagcccttactagttttcacaaacagcagtacaaatcagttagcagtgtagaacaagttcagagttcatcatccgccccagtgactgttatgctattactagtaatacctttcagattaatcttcacaaacctacagtaagtgtgatgttgctactacctgctcaggtcgaagcagaaatccacggagatggagtgcgcctatctgaaggaatgcttcaacaaactgaaagaggagaaccaccgcctccagctccaggttgagcagctcaggtcaacgagcttgcagctgcagctgcagctgcaactccacagcgagcgagtcgccacagctcccactggacagcaagccggcacttctgcggctgctcgcatcttcactttgcctttgtccggatacaacccttccagggggacttggttctcgccaaatgcacactgatcatgtgctcatgccaagaacacaagagggatgctacaagattcgtcgctgtcatgatcaactgataaaaaaaacctgataagtcacagccatcttgtaggacattgatgaagaatgagcttgggaagattagcgtcgatgggaattggatactgtttacctttttttttttcaccgggccggcgtggccaagaatttagtgctttatttcttttgaaacctgtcgttcttcgtcgttgatcatgagggctgactattgctagatcagcttcagtttagcctgtcattgtttttgctttgaacaatcattagccagtcatgtttttgttttatctctctcttgaccgacagattttgtggttctgcttgcctcggaaaagaacaaacatttttggttaatctctgaacaactgaacgttcagtactacgagtcaacttttatatactctgctggagtatctatactttctataaagttataacccactatctctaaagcttaacatgcaaccatgccacatcatcacccactaacaataattacatattcaacctcatgcaagcatgaaagagcatctgcaatctatttaattctacaaattaacatgcaaagcatattcaatcaccacctctcacatcatttccccaatagttttacaaatctctttatcatttttatattatttaatatatacttatcaacatgttctacattaaagtgcgaatatcatttgtttcatggtaaatattgataagccctaagatttgattatttttttttctttttactcctagctgaattgtaacgaaaaaataatattgaaaattacttagtaattcccgaagcaaagcgcggggaatccctagttacaaaaatcctctgttgagagtcgagactacaaatggccaaaaaaaaaaaaaggtctgcaaggatcgaatcagaagaacacggaaagagatatgtgcagtgaacaactaaaacattgattcagctcagtcaaaaaaaaaacattgattcagctgttgttttcgcttaagttattccattggtccagcagtcggcaacaatcagatggtaagctcttcaaatctaccgctctcagccaaggagttccattgagcaatgctaagttagcagctgcaactgcacgaacagttcacacatgatcagaaatgatttacagtcatctaagaaaaaagtgaattacaatttgtttagactaatcaagcgtaagcgtaggtacatacgttagaacatgtgtcgtccatccacggttctgcaccatccggatctttgccatgtgtaagattttgtactaccgttcctgatcagttcatagtagcccaagaataatatagtagaccaaggtgatggggagagctattagcatgccaaatatgaccctgaaagcgatgaaaatgttgatacattcagaatcttgaaggcttgaacagtttgcagtcatgtaatacttgcaattttcagggtaactctgctgacttacaaagtgcaaaggatggtagcgtggaggttgtattccttagcgaacacaaatggcacaattccttgtggcagggcggcctaacaaacattcagtgcattcgtaatcagcgtcttgatttggctcaccgtttaaacccaaccaaaaatacaaggcagtttcagagatcatcgagacatcgactcacctgaacaatggcgatacgcaagagcgtgcctcggatgccgacggcggcggacgcggcggccatgatggcggggccgaagaagaagcggacgcccatgctggccgccgcgacggagtagccgcaggcgatgatcttcggctgcgtggccatgaacaatcctgaacggaaggttcagtttagagatctgcacttctctgaaccaaatacagtactagaacagatggtgatggaactgaactcacctaagctaaacatggccatgcctaaccctgcatcggagagaatggagattgatttggctactatgattggcatcgtgatgtggaacctgcaccaatgcgaaattgcccattacagcatcaacgctgaactgacaaacaatcagaaattctgaatccaatttccagcgaactgatcgaccaggtgagcttgctttaccggaacgcgatgagcgaccaggtgaggccgatgaggctggcgtacgtgttggggttccggatcagccggcgccaaaccgtagtgaggatgagccgcagcatcacgccggccggcgcgttctgctgccctctcgcccgctccgcgcccgctgcgccgccgcccttcgtcgtcgtagtcaccgccgtcgtctgctgctccgtcttggcgccggcctccagcttcgctagctcgtcctgcccgcccacggccttgttgaagctcgccgcgcgctccccgcccgtcgctcccggcggcggtcggataactgaggaacataatgtaaggtgtttgttggattgatcaagaggaggttggagactgacctctcgacgaggcaatggatggcgcgtcggaggggacaagccggcgcgtctcccggccgctgcggaacaccggcaggccggtgacctccgacgcggcggaagcgccggagctccactcgatcatgtgcgtgtccttgaggtcattggtgggagccacggtcgcggatgctctggcccgcgccgccgcgtgctcgtcgaagctggacggcctcggggtgtgctgcctcgacgaagagtgcagcgagaagaggtccgcggcgccgaagctggacgcgcgcagcgcgctgttgggcggctggtgaccagggatgtcggcgagggtgaaggtggagcccctcggggtggcgttccgcgacgagctgatcgagtagatctccacgccggtcaggttcgacgcgcgcggcgtggcggcggcggcggcggaccgcctcgacaccgacgagcggcacacgaccatgcgcagcctcccgtcgggcgccacctcggcgtgcgcctccgcctggctgccctcgagcgacaccacgtccgggtcgacgtgcacggcggcgatggacgccgcggtgtccgggaactgcgccgcgatgagcacccgcgcggcgcggaactcgaagaggaagagcaggagcgtgtaccagacgatggactggagcacgacgatctggaccatgaggtcgccggagtaagggccgtacatggagacgaggagcgggatccccatgacgagcgtgttggggagggtggagacggagaagagcgtgatggagcagtcgagcggcggccacgccggggggacgaagcgcgcggggaagcgcgaccacgcggcgagcgcggcgaggacgagcaccttctgcagggtgtcggcggcgacgaagcggaggttcatggcgtaggggtcgctggaggagatgaagtggaaggagaggagcgggacggcgatgacggcgacgaagcggttgatgccggagcactgctccggcgtgaggacgccccaccaccgcacggagccgtacgccaccatcatcgccacgtacagcggcaccaccgccgacagcaccatgtacagctcgtgccacgatatcatggcggcggcggccgatcgccggtctgggagcagctgatcgatctgtttcctgcgatgcgatcgagaggagcagcgtgcgattagtgtgttgctgttacatgcagagagtgagtattgcggcgcgcgatgccgcgatgggatataaaagtacgctgtcccgggctcccggcctcctgcgcgctttgactggttctcttcgaggtatgtccgtatgtgacacaaattttgctctggtggagaactccacggagcaactgaacctcgtggcactgcttcaaaaaaaaaaaaaaactcgtggcacagatatggctacgtagccaaatctagtaatctcgaaataagtttatttttttattcttttttgtctttaaataatttgtttttagcaattattatatcgaagtttataaaagtatgacataattaattgtattgtatgtagatgaagaaattaataattatattgaaatttgataaattagatgtattataggtttttattagtacgtgcgagatagatgaaaatgaaatttattttaaggctgtgtttagtttacacttaagtttggaagttaagttaaaattggtacgatgtgatagaaaagttacgtgtgtataaaaaatttgatgtgatgaaaagttgaaagtttgaaaaaaaaaactttgaaactaaacagggccttagacggagggattggcagtagacacggctagtgtacacattttgcaatgaatttttccgaagaaaaaccactgtagatgtgtcagtccagtcgtctgtagatggtctagtggccgttatgtgtgctgtcacgtcaggccggcggggtgcacctcgaaatgccgtgcaattttggatggactcatggcatgcgaggcattgtcagtgtggctggtacagcccgtgcagatgcagctgatccgatggcctcgcaggctggcaggctcttttcaggcagcagtgcagcaccggcctagtatgcagtctccaaatcccacgaggccgcaagaaggcagcccgcaaactcggcccatacaaatgctgaactagttatcggcccaagagcagtaaaacgcttctttcagcgcttccggcccaggagcctcaaatcacacctcagactcgaacatgaattgggtcgcgctaccaactgcgctttgctctacacttactcctatcaaagcaagaccctcactttggcatcgcagatttgcggcgtcacatggctgccgcggcttggcttctctccgttgtgtcgcacacgaagagtgccgctccgtactttctacttgcagtagaaatcaatctgatccgtagatctagttatatccaaaggctcagatctttttatactccacctcaatttatagtactagaagtgtggagggtcattattgtccaaagaaaaataagcgctcatgggtaaaatagtactttcatccttttcttttaaccctacccccctctacgttgccggccgctcgccctcccctcgatcaaccggcgtcgcgccgccgcctcgcttccgccgccaccgccactgcctctgccgcttcacttctcgtctggacgacgccggcctcctcccccaatcgcagccgccgccgctcgcttctcctctggagtctggacaaactcctcgttcccacgtgtccccatcgttccccgtccctgctgcctcctctcgtccccgatcccagtccccagaggcgtcaatcggaaggagctcgagggcggcgccgactccgcgtgcaagacctgcacgatccaccagcgcccaagcttcgtcctctcagtctcctgcgccgttcgtccttccgtccccgccatcgctgcctcaggtcatccctgccgtggccgagcggcggtggttgggcaaaatggtggcagatccgcgactagatgccggtgaggaggttgcggatcagccttctttcatcccatcacacaggaggtaacgacgtaacgtcctgttctttcatttactctcatgcagatcagtttttgccccattccgtgttgaatggtgtggttgaatgttttgttctcaattatcagaaattagaggcaaaccagatgcaaagcgaggtccaaggagtgcaaagcaaggtccaaaggagtgctgtcccatattacctttgtgcgttctttgatgttggcttgaaatctgggataaagttgtaatctttgtacataagttgggaccttgaattatattgtgcaattttagaagtcatgattttatctgacttcaaccgtgctttacatgcttgctcatgccttctttgatgtttggctcgaaattgggataaaattgtactttataagtcaaggggcatccggctgggcagagacagataaccatggagcgggaatcaaacaaacacaattttccatactgaagatttttcacataaattgcaaattatactttaatttagttataccataacaattgataagtcaaggggcaccagcagcatcgacagttcacgatgaacagcaacatagctgaagccatcatcaataataaagaccaccgccaataaatctgacaccctattattttactgaggactcagagagagacgttaattagtgccagtcaggggctctgggctaccggcggaactacaagggcatatgaatcggagaaaaagaaatcgcgtcaaaacatgatatatagatcgaaaaaggattaatagatggaaaaaaaaactacagtggaacgcgttgaaaaaaagaaatctcgtgaaaacatgataatatatggaaacgggataatagatcggcctaagatgtggtggccgcgtcgtgcctgatgcaatcaagccaaaattacccctaatcagtccctgccaaaattatccttaatatgtattagaagattactaatctacccttcaaaataaacggtcaagattaattctagttgtagtataatactacaagtaaattgcaccggagcattggtcgcacacgaaaggaaatctcgcaaagcaatttaacgggacgagtagacgagcgaggcgagaccgcgagagcaacgggacgagacggagagagacctcctcatcagacactcgcatcgcggcccaggcagcggctgtgcacggctgctctttatcgaggaccgtgaaaagggggcgaaagctgtatgtatctaggagtagcgtagtggaggcgattggcgatgataatacaatgatggggttcatcccaaagtatacaatctacgactagtacaccgtagtctacgtactggagtactagtatactactacaactaccaggagcaaaaacagcagaaaatttctgagggggtgtttagatggggctaaaactttttagcccatgtcacatcggatgtttggacgctaatttagagtattaaatatggactaataaaaaaactaatttcataaatgagagctaatccgcaagacggattttttaagcctaattaatccataattatcaaaagtttactgtagcatcacattgtcaaaatcatagcgtaattagactcaaaagattcgtcacgcgaattagtctaagcttatagaatatgttttataattagtgtatatttaatactctaaattagtgtccaaacatccgatgtgacagggacttaagaataagtccctggaaaccaaacagccactcagagctggggtctgtacgtgttgccgtgttgtaagcaaaattgttgctttccggcgtttccgcattgatttgcagctgccgccgctgcttctgcggatctactggcaccggtgcagatggctggagtagcctgtactagggtgttggggatagctgtagagaaatgcatgggaggcaaggctctgcaatctgtgccatcggttgcctcgggatgacaaataaaatgcgactagccattgcgtgcctagcctacctcctcccctctcgtcttccccacaagcccacaagagagggaccgcatctcatctcatgtccttgctcgtttttcagactttcaatcactgcatactccaacctcaatctactccttcactagtgtcattcactcactgattactgctttgcaaaaacactttgattagtagcagtactgctagtactagtgttgtacacttgtactgtgctcctttgcctttgcattccggagtgaaatgttaaagtgttcaccaaggtttctcgtgaattttttccaccgttttcttgcattcgtttcagttttgactacgcacatctgctagtaggagtagtagtacggaagtaactagccctacactgactaatgtgtcggtgacttcatgatccacaatccacatcatatcatttgatggaactgaaattaatctaagtactctcgagagagacagcatcaaagattcaagaacatgacaccacgccagtgtggtctggatcctcgatgcctctggtcgggtgctaattaatcactgcggaaataaaaacctgaagcatgtctgttccatccctttttcatcaccgtctttgggcgtggtttagttctcaaatttttcttcaaactttcaatttttccatcacattaaaaattctgtacacacgtaaactttcaacttttccgtcacattgttacaatttcaattaaacttttaattttgacgtgaactaaacacacccttgatagagtgacaaatagtaaattctcccattgcattacacagctgaatggagtatgccagcatctcgtttgcagtttgcttcggtctcgtttagttccaaacttccttcaaacttttaacttttccatcacatcaaaacttttctacacacataaacttctaattttttcgttacatcgttcaaatttcaaccaaacttctaattcattgtttttctcaacatcctagtgaccttaattcaggcctttggcacgatgactgtgcaccggtattgctgaatagatgtacttccgtccgattgtatattccgtattgctatattttggatggagtatcgtaccaaaagaaaactctagtacagggcccacagtaaagcatttgcgagtcttttgagagaggggaaaaaaaactagaaaactgtcattctgctgtgtttagaattcgtcattggttccataccatttgtttagtttttttctccaaatttgtagttacatacaaatgttagccttttgattaaaaaaaagagaaagaaatgagagtcgtgtaaattttggtgttgttggtagaaaagaacggtaaaccaacacttagcctatgctcagttaaacaacgatggataagctgaagccagatgaactaagtaatcaagaataatttacgaataaaacgtttatatcttaaaatccaaaggcaagaaaatagcgcgccaattaactaacacacacgtatttgatcacccccacaccattttataatacggatcataccagaataattttattttattttttatttgatgtggcataatttaggtcttcttttttttttctcgcacattagatgccacacatgattcttcctgcactctaaacgtcatggcaaaggacaaaaactactgggaaagaaaattaaagagtttctttattgattattacaataaacgcagtaatgtaccactattctaccacttgcatttagaaaccacaccagagagtacttgatttgccagagcactaatccttcatctatagagtcattacagtctgacagcagcatgactctcttatcaccacgagtccatgacctaacactatgcataatcaacactaaaccaccatgaacattcatctaaagtctaaacagcaacttcctaatccatttccagtgatgatgagatgacatgggcaaagaacaaggaacagagagagaaaaaaaaatcagacatggctccgttaaacccggaggaggtagacactgagctcaggaccgccactgttgctgttgctgctggtgcttgtgctgtccgggttcatcatgtagaatgcctccgagtcgcgcgagcccaccacccgctcgaaccgcgcgcgcatgtacatgacgtcgccctcgccgccgccgcagctggcggcgggtatgacgccggcgcccatggacaccggctccagcgcgcgcagcacgcgccagtcggcggcgccgcactcgcggcgcaccgcgtagccgcagctcttgccgttgcagtacgcgcgccacaccgtctcctcgagcagcctcttcccgccgcccgtcgcggtgggcagggcgggggcggggccgcccttggcgcgctcgcactcgagcgcgatgcgcacaaggcccgaggccatctcgcgcaccagcgcggcggtgggcgcggcgagctccagcagcagcgccgggcacgcgcgcgggtcgagctggaacgcgaggtgcacgtggccgcgccggtggccgtagagcgtgccggtgagccgcgcgccgaggccgacctgccggtgccgccccgtcacggccgccgccagcgccgagcgcaggcgcgacacggccgtgcggaccttcctacgctgcggcggatgctgctgctgaggatgctgctgccgcggcggcttcttgggaggagaaacgaagtcctcagaatggaaactcggacagacagaggagaacgccattgtcgcctcatcctcctcctcttcagcttccgagctcttcatgtaatcctcctcccctctcgtggcgccatggctgtagctcttgccaagaaccggccacttgaaatgcctcctagagaaggagagggaatcatgggggtttcttgctgtgatggttctcatagcttgagttagccaagcctagcttcttagcagcaagcaaagcaaagcaaagaggcaaagagcacactgctccttcactgagctagcgttgtgcttgtgcagctgggttgtgtgagaagaggttgtattcagaaaatgtgtgtgcagctgaactgtgcttgtatatgtgtgtagtatgctttacttctagtgttatctgtccctgcagaagcaggcttttgtagtgaaggagtggctggtgagcagaacacaccaaaaccgagcgaacaaaaagaagagagagagctagcgatggagagtgtgctgctggggttgggttcttgtgaactttctctttgtttttttctaatgaggaaatggtaggcaggaatgcaggctgcggcggtgggacaaggctagagagatttatggcagataagataattgagaactgagaagagagtgacaggagagaaggcgtacctggttttgatggtttggcttttatcagtggtggggaactggggattaattagtgtgctagtgattatctgagtggatgatgatgcactgatgaggttgcagtgaagtgtagtaattatatttcgatgttatggttaacagacgaattgggtatgatctctgaaaaacagagaacaggttagaaaaagctacctaacaatcatgattcttaatgtatatgatactttggaaatggccattagttcccaacaaacttagacgacatgagtgcagcaccgcaccacatttgcattccctgtgatgtcaacggcttctgcaattggattgggctccgttcctaatcagcaatctttcaatactcgtcatgaatgacatatagctcaaaactataattaggaatctttcatcttttctttgcacaagctgaaatgatacaacccacaagtaagattcttccttaaaatacacaaaacacatggacatgcagctttgtctaaccgtactgcctcaagcaacgaacacgatcacaaagctacaagtaaactcgaatgccgaatggtagtatagtacattgatattcatcagagaatgttaaatgtaccaaccatttcagagtttcagagttctttttcttaagccctgtttagatcctccaaaatggcaaaagttttgccattttgaagtactttttgccattttggatctaaacactagtaacaaaacttggcaatttggcaattggcatttgctagtccatagtagcaaattgtgccaaaaagtgctttgggaccgctccctctttctttctctctctcactttagtgctagaatggaaaaagtttaggatgcatctaaataccaactagtacttttgcaataccaaaacttttgccatttgccatttgttatttcaaatggatctaaacagggccttaatcttcagagaatgcacattttacctctctcacaaaccggttcattccgatcatgcaacacattgcttttctgtgtttggttctttctttcaaatcgatcgctgcacagatccaaactaaagcgcgaaggctgcagggttcagaggagaaagacgagaggaggcaaagaaaagaggagaggagaggctggctgctgaaccagcacagtttttgctttcctcgggatcggtggcaatgcaaagcggggcccaaaggggggtaaaatccaaagcgaaagctgcagctttgaccgcggagggggccgaccgaccggtgccgacggcgacggtgcgtggcgacggaagcagcgccctgcagcgccggagtggccgggtccaggtgacgacgcgacacaccgtactagcgacctcatcgtcgtcgtcgtcgtccccggctagtgccagtgctacaacatgctaccgctaggagagagagagagacacacacacaggccacagctactctacatctgtctcctctcgagcttagtactgttgctggtctggtcttatggcctctgcctctcttgagaagatcaaatcacgcttaaattcacctcttctccttcgttcctagctgtagcatgttgctgttcctgtggtctccacagcagggtttctcaaatcgccggggctagggttaccgcaccccagcggtaagcacggttaccgcgcgataaccgtaaaaaccatgcaaaattcatcaaaaattcaaattattttttaagtttatttgaatttaagaaggttatcgtggtttttctactaccgtatcctgggataagaccggtaaccgtgctggtaatgtaaaccctgctccacagctcgcaggcgcagctcagggctcaggagagacgagggagggggaaaggaattttcaacgtgttccaaaggcatgttcattgttcaaacctagtttgtccggttcagcattaacaaatcttctgaagcgcagcttaattgtgcatgcacatttagcaacaggtcaatgtggcctggaacctatccgtatgcagccctatcacaagtagatactatcacattaggatgcaagatcaataataagatgcccgtgagcaccaaagctaaacgaagaaatttatttgactgcacggcagatcaaatacgttaaacaacttctgtgaaaaaaaggtaaacaactgatacctcttcagaagggactaattcggtgtgccagctttatttgccactcagaaaccagccggcctgggataggtgccaatgcatccttctcacgtgcatctgcatcatcagcatggataacagaaataacgtcttcaaccagtttgtccctgccaccccttagtggatcctacaacggaacgatatgttagggttccccagcaaatttgtgcacagagggccatcctgaatcctggtgtaactattccagccttcatattcaaaatgactaacctgtaaaaatacatcagtatgtgttttcccttcatagagtagtaacttggctttagcaccagcttgtttaaggacacccgcaaaagtttcactgcatatgtgatatacggagttaaagagttcttagcagcttgaacatacaacatgaatggattaacttgtatagaaagatggatcaaataacggtgtaacacctaggtagtgtttggttgcaaggatgggatggggcaaacccacttttaggggtgtttggtttagtggtgagtgaggggtaggtccatggagaggaatattcctcttagatccgggaccaagccatccagcaaaatcggtcggacgagcttgtcccacctgggacgagcgcacagcgtgagttgcgccacttcaccgcgcgtcgtgtgcatcgccgtcgggagcagctatagctggcggcgatggcgggctgtcaccacgcgccctgacctcctcctctgcctggaggccggtccaagccacgcaccccccccccccgacctcctcgccgcatccgcgctgccgaatcaggttgcctagaggtcgggggccaccggatctggcctccttgaggtcggggcttgccggaaccagccgcgcctccgacctcgtcgccgtggaccgatgcctctagctccggccaccacgtccacatcgtcattgtctccgatgtcgcgccgctcctccttccgcccgcgccgccgatcaccgctccttcctctgcaagctgcgagctgcgagaccttttctcgctgggagtaacgtggtgcaaacgctgttcatcacatccctaccccatcccttctaccaaacaaaaaattgggatcattccatcctataaaccaaacaagcaagtaggatcactccatccctaaaatcagggattgtgtcatcccatcccacatagtcccaaaaccaaacacgcgcctacagaatgtagaagcatataaaaatagaagtgagaaattaataagtaataggcagtgtttgcctacaataatatgtccagaaagacagcttgtatggaacttgacgttttaatttgacgcatatatcttgtaaaagagaggaaccccaaaacaacataacagaaaagataatcaaacctagtagagaattattaattcccctggaaataaaatataattatacctagcagaaaatggtatagaataatcatccgttccatgcaaaagcacaatctgaggaagaagagctattgtttcaggacataatttcttggcaacagtttctggagagaaatgtggcaatgatttctttccctccattatgctgaaaaggcatttcataagttcctgagttttgtatagttctaattaagaattaaggaaagtagaagcaacacttccatatcaaaagtacagttacactgttacctgagaaatattgaacggtaaagaccacgttcatggaaatgatcaaccaaattttcaatgttgtatctgcaaacagcaatttgagcaatgagaatatatgtcatgtaaacatagaatcactagctctgattatttagtatctcattacacattctgttgcatccaaatgccaaagtgagactgcagaagttggttcaaaattctaaaaggcaccatatgttttctcagctactaaaacacttcatgaggtacaaatctaaaacaagcactcaaaacaccaaatggtagatatctattgctttttagcaggactagccccagtttcacaacatcggagtttataagtcaatcatcatgtaaactaaacaattgccaaaatccgactttcttcacaatcaaaatcagactaacacaggagtagaatcaatagaagatcacttaaatgaacacataaagaaatcatgcgatgttgccatgatagcaggtttagtgttttatattagaccaaaacgtgcatggtatagaaaactaatcaagactcaggagaagcaattctttaataatgatgataaccatacagacatataatcaatcaaaattagatgataaagctatcccaccctccagacaaaccaaagtatgcttttatttgagtaacactccatgaaatctgctctcccctagattctttagccgcttgttccaaaagagcgcatgctgcgatatgtgctcctgctgattgacccattaagtatatcctgcaggatttaacacgatgaatggtaagtctttcactaaaatcatcagtaaaaaaatacaaagcaagaataatggaaaactacgaaattattaggatgcatgggaataatacagtcatcagttccagaaatgaatgtggttaagtctagatgcaagtataacatatactgtgcattttagctttccattcaataagacacatatttctatatcttacacaatttatgtcggaacagaagcatgcccagaaaaccttttaaaaaaacttctatgtgcttgtcctcattcaataaccaccagcatggacttcaaatataatcattcaaatcatgtacattgttcattcaagaaaaccgtttagaaaaacttcatgtatacatgaaactttttttcagtagtaactttattagggtgttgtgatttgataaagtatcacttactgattaggatctcctccataggcaccaacagtctcacaaacaaatgaaatcccatcagaagcatcgctaaccatgtcacttattgttccttgaggaaaattcctgcaaaacatatgcttttatatatcatcaagcaagcaaaaagaaatcgatcaatcagtaaattcttatcagtaaaaaaaaatctaccaaaaaagaattataagaatcatatatgaggaatccatgcaaagtatgagcacctgtaatcaatgcatgcaactataattcctcgctctgctaacctccttccaagaagagcaccccacgccttgtaactagatataactgaggtcatcaaaagggcaaatcatggcagaagacccttataatacatcatcagaagaattttactcacccaatgatccatgcaccaccagtaacaaatgcaacaactggactgggttttttggggtctcttggtatgtaaagatccaacctgtatagtgtgaaattgagtctctagcaaagtccaaaatcagattcttccgtttatatagcagatagtttctatacctatttcttggttgatccccatagatcacgctcctcaaaacttgtcttgaaaagaaataataatacccaactggcaatcaataaataataaattagttggtagatgtacaatcatggccatgctttcaattccgtaaaaagggaaccaagaagagctaatttgccagaacacttattggtacaatcataacattgactaaccatcatgttcaacatagaaatctgtaataaaaggtaaggtcaacgaggccaaaggtaaacatgattttcttttttttatctacctcttatgaaaccgggcataagtaaaattgcatatattatgagggcagcgagctgagaaatccaccggtagcctaccctggaaaaatagaaagaacatcagggacatctatacagcaaagatgaaaatatattgtatatgcatttggattttttttttttggagattttggtgggaagataacgcaatgtatattaggcgttttgaagcatgacttcacaagataataaaattcagttcatcagtgctagagttagcttgccatccaagtgaattagttgaaaatgcaaggtgctttgatgcaacaatctgttttaacaatggggatttcctaatttcttataggtcattattggtatgtccgtgaggaggagtgagaccaaagacgacgagggcgtgttgccgaatggcgatcggtacagtatcagattacgttacccgaggtatcggaggaggatgaaggcgaggcgcgtgacgaggtacgtctcggcggcggcatggctgacgtcctcccggaacgtggacctcctctcgccgcccccgcggctgccgggggcgagcggagagtcgggggagaagggcacggaacgccggcgcacgaggacctggggggcaccgcgtggaggtaccgcctccgccacggggcccgcgtcaccggagaccggactcgcgggctgcattgcggggcggacgacgacgacgatgctagctcctggtggcgagggatttggggttgccgcattggtggggtgggtggagatggagggggcgtggaggccattggaggggaggggagcggagacgccggagaggtcgcccaaattaggaggaggcggagcgcgcgcggcgcgacggcgagcggaggaggtggaattggaggaggccatggggacgcgtgcgtggccggcgaactcgtcaattcaagcgggctgttgttgggctgagaggccacggcccatcacgagatggcctgacgaggccactgtaagtagtgggccgggcaacgcgcaatggctcgacaatgtttcagcttcgcaagtggtacagtgagccgaacgatagataagttaatatattttttttaagaaacactacaactacacgcgcgcgtaacatgggtactctcgtctcgttcctataaactataagcatcttaaaaaaactagatcgatatatcttaaaattaatagagtcatcatagacgtctcgctgtcgatgtgtacgtatggatacttagtcataaacataagcagctgtatcaagtttagaacttaaaattggttgggttatttccaccataagtaacataaccagttgagatacacaacttcacaaattaatcaaaaattgtattatctccgttctaaaatataacaatttttatatatgtatatggacatatgcttgtcttttttaagggaaaaccagcatgagagtgtgccttttaattaaatatagcgggagaaaaatacacccctaagagcaaagaaaaggcaagtgcccaaaaaaacaggggggctgctatataacggaatcccattttcgaacgggatgatcccgagtaggtatcaggtgtgatacctatcaggtatcagacgattctacacaacaggatgatcccgagtaggtatcaggtgtgatacctatcaggtatcaaacaattctacacacgtttcaggtgatacctacaagtatcatgtgatacttatcaggtatcatgcgattttctaccacgtatcgcgtgatactcgcaaggtatcatgtgaaacctgtcaggtatcaaatgatttcaaccacgtatcgtgtgatacttacgaggtatcatgcgatgtctgtcatgtatcagacgatttctaccacgtatcgtgtgatactcgcgaggtatcaaacgatttctaccatgtatcacgtgatacttgtgaggtatcggatgatacctaccaggtattaggtgattccctactagatatagctgggcatcccgtttggggaggagcaacccgacacgcgcggtcgccccctgcagccatcccttgtagacgaggacggcgacggcggcggcagaggacgggcgcggtgacggcggcggtagcgggggacgggcgcggcggcggtgggggatgggcgcggcggcgacgtgtcacgccccgaactagtcctgagcggaactagcccgtgacgctccaaattaacctgttaaccgataccagtcccaggaaacagtgctagtatcacaggaagacagaatatcacagcaacagaggtctctttattatagagtaggagtacagtcatgttgggctgcggacagatctcgagctcacaactgcattacaaaagggaacggaagccagacttggaccaaacatcacaagcgcgacttgggaactaggccgaaaccctaaaactcatcgtagccggcttgctcctggaagaactcctcgtcagcgggatccgcttcatctttttcagcaactgggggggattatttatatagagcaagggtgagtactttcgtactcagcaagccagggaaacttaggtggttaatgcaggcttcaagggaaggctgttgtttttgcaattgattttatttgagctcttttctgaaacaactaagggagtgcttctcaaacgacacgggtgagacagtgcgtctcgtccggtcggagtatgtgcaatgtatcagtcttttgaattgattaagattggctcccggccaacagcttttaaacggcctcccggacctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaacaacctctgcagagggggtacactttacccacacgacattactaacccggatcatccagttcgtgcagaatggccacgactagagaccttaaggctttcatgacaaggcatttcgaaagccgacacaggttcgccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagatgtttctcagattttaagtttgaaggcgaccatcgatacccgtgcagagtgcacgattaccgaggcgcgactaggtgggtacaagggagcatggtataacaattacaatgggagggtcaaatacaacaaattaggtaggtctgccaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccaaaactacacgcgaaacggaacaactcagcaaacggtgaaaataaagccctattattgacctctaagcgtgccattagatagatctcgagatttgaggaattttggaagttgaacggagtcaaacggacttacggttgggaagatattgaatttctaagattattggattttggtctaaaggaaaagggtttatttaaatcctttttgaaaaagaaaagaaaagaaaataaggagggagggaaattagactttcctcgggcggctagggcacggcccgagagaaaggggcggctcggccgagcttaatgggccggccggcccaagaaggtggcccaaagcgcgcgcgcgggcggggaggggagagagagggccggtgggccgtgtccatcccgcgtggtcccgagtgggacccgcttgtcggcgactcggctcaccgtgagcgaggtgcacgcggggcgtgctagggtttggggagggaggcgcggcgcatgcgcgcggttcgcggaggacgcggtgcggtgggcccacgcgcagcctcacggctcgcggtggaccgcgcgcgcgagggggcagagggaagcggcggaccggggtctgcttgacccggtcgcggccaaggtggcgccgacgtggcgcctacgtggctgccacgcgggtcggcgggaggtagacgacgacgccggccggaacggacggcggacgacagcggcgagcggcggagcgaaccacggcgatacaggcgaaagcgagcacaccgggaagttgcacaggacgaggggagacgagccaacggctcggattcgccgggggatgctcgacggcggtggattgcggtggcggcaaccggcggcgggagaagggggaaacggcgatggcgcgacgggagaccgattcgggtgagctagagcatctacgcgactccgggagtccgttgctagcgtcggattgggcggagctacgccgagcgaggccggcgacgagcgggtgctacggagcacgggcggcgacggcggcaacggtcggggcggcgccagctagctacggggaggctactcgtgctactacccgagtctaaggggaggagatggaacgaggagggagaacggagggaggcactaccgtgcgggggtgatggggcgcagtgacgagaggccgacggcgcgggagtgatctctccggcctcgggccggggaagaggaagaagacgagtgcccggagtccccttccgcgtccacgaatgcaccggctctcccggtgcttggcgatgaacggcggaggcgagacagaggggcggcaatggcgcggtggcggcaagcgaaacgggaggaggaatcgatgggagggcgccttggtttataggacgacgatgtcggtttggaaaccgaccttgggcggtcaaggcgcgagctggcgctcggagctcgcggccaaaacggcgacagaggcggaggatgacgccggcgggaggaaaaagggaaaaagagggagagaaaaggggggcttgcccccttgccactttggggaaaaggaggagggagagagggcgatgcggcagagggggggaagctctgcctccatcccttggaagcacgcgcgaggaggggcggggccaaggcgatgacgacgacgatgacggccgggcgatttggagcggggcgacgacacgggcggcaggcgcggcaggcgctgacggcggcggcgactggccggtcggccaccatggcgcgcgcgcgcgggaagcaacgggcggcgcggcggttctggcgacgtcggcgggaaacgacagcgagggcggagggcgctcggctcggcgcggctcacgcgcacgcgtgcgcagcgcacgggcagagcgagagagagagagagagccggggagggaggggaagatgggccgagagggattcggcccatcgaacccgagggaggcgaaatagacttttgcggagggatttgatttgggaaggatttggattcgggattgaactcaacgatagatcggggatttgagatctgagatggcacagacactagacaacaagcaaataaacggatttcgcaaatagggtttttaagagatagttttcccgctaggcgccacgacggaacgggcgctacatgacggcggcggcgtcgacgggggatgggcgcgacggcggcggcggcggaggcgacgggggacgggcgccgcagcggcgggggacggtggcggcggcgagtgagtgtttggataagaatcgcgttgcgaagaggagctatcccgttgggggacggtatcccgttgggggacggtatcccgtcccctagcattcccgaaaaaacaatacactatacaaggtgtggtataagctcacgcaggcctgccaaagcccacacactgccttcttcctttattttcacgagaagatacgacgttatggtctccttgtgctaaaaatatccatcggtttcactcctaccatattttccaaatgataaggaggatcaacgtatgcaattccttcttagggttgccagtcgttgtggctagtttcttccaccggttttaaacaactaaacggtctcttggtgtcgaggctcaagctactggtaacccacccaagcagttataaggctctaaattcttttagcgtactgcacttggtgataccgataaggtgtaaggccgcttcatcccctctctagtgaagagggtatcatctattgttctggcagttcctggtcgtaagtctatcagagatccatatcatacagtaagaaattattatattttgagaaagagcgagtacacatttaggtgtatggtcgtagctcgccacgctagaacaacatttatcctaaaaatgggagaagaatcatcagctagctaggtgacgcgaagtgtttatatttggtcgcggcaaggcaacggcatccgccgccgtgggcgggctggcttaatttgcgccgttgcgcgtgcgcgtacgtgtaatccgtcgtgagtgcgcccatctcgaacggttgacacctagcctggcgagtgcccccgcgcacggcacggcgcgacaaaaaccgaggtgatatgcatggcgacgaaggctgtcacgggctggaaattgcgatgcgcgcgcggcgcgtcggcgaggccggtgcgcgcatcgaccgagttgctagcatcagcagcacaaaaggcggatcgcgacttcgcgatcgagctagcatgcgtgtaccctatccatttctcgatgagatcgacaaaacataatgcaattaacctgcgcacgtacacgcaacaccagctgatcaaaatttgtttcagatttacaaatggtgaaacgtacgaacaagatggtgaagaaattaattcatcaaaatttgtacacatttaggcgttacacatggtcatagctacgctagaaaaacttagtcgttgtgtcctaaaaatggaagaagaatcaacagctaagctagagacgcgggcaaggttggttgcgtggttaggtcggtcaggcgacgccgaggaagtcaagcgcggacttggccatgacggcggcgaactccttgaagctgatgaccccgtcgccgtcggtgtcggcgtcgcgcatcatccgcgtgagctcctcgaaggtgagcggctggccgaggcgcgccatggagcgggcgagctcggcggcggagatgaagccgttgccgtcgcggtcgaacgcccggaacacctcgagcagctgcgcctggtccaccaggtgcgtctgcgtggtgagcaccggcgcgatcgccgccgccagctcgtcgaactccaccgacccgttgccgttggcgtccatcccggcgagcagcgcgtgcacctcgtcgcccgtggggcgcagccccagcgaccgcagcagcgccgccagctccagctgcgtcaggctgccgtcgccgttcatgtcgaaccgccggaacagctcccggagctgcttcagctggctcccccgcagctgctgcggagccggtgctgcttctgacctcctcgccgccattgttgtcatatctcgatgtacgtgtgttttcttttctcttgtggatctgtgacctctcgcggtggtggttgtggtggaggagacgagagggaggcgactttttatttatcgaggggaagacgcgttggagagttgggactgactgggtcggtgcgtgcatgcatggaaggaggcaaatgccggggtgggtgcgcataaaaaacggaggatttgtgggttttttccctttgtgttttcggttgcacctgtgaggttagctgcagccggtactgcgaggatttttaccgtacgtgttcagttacaagtgagatctatgcgcgttaaattggttacgtcttcacccgccctgcacactgtagaatctagtaatagttttgcatcaacacaccacatgtaccggtgttctcgttgtaaaaatcatccatgcatacagtacgcacctttgataaaatgttgcgtgatctgtatatgtggcattgaatttggactgaacccaatgcattgtttgtgttatggaatattatcttctggaatataagatctattttgttttttaccaatccaaatcgtaatagagacaaatctcctcctatgacccatatttatagaggcagggtaaaacatataagattgacctgtactgacatatcagatctatgataaagagagagtttgtaatgtccttgagatcaaagagaatgacgcatgtgttttatatctctcatgtcttaatactgcgggagggatagggaatggtgatctgctaatagacatgttagtttataacagtttgtacccatcatatcctgatatccatataccgcgtccgcgtgacaagttgacagccctgaacttgaagacttgtaacgccattcgtcttttgactacctttgtagtaggaaggatgatccacactccacaggaagtcaaagatttccggtcagttgttacactgtctaactatctgcaccagctccagctacaactaggctacattagctaggaagatgcgaggaatctatcactcccatgcccaaaggttgcttgtatgattgtgtccaaaatgataaagttagcagcagagcaagatgtactcatacagaatcttacagctgccctgtaacataaacaattgtgggtaatcactaatcagctatcacacaccgtaccaggagggtttggtgatgtataatgttggcagtatttcacaaaatgattgcatcaggctgtgatggcttgatgttcacaagcccctttctctcttttttttttttgattctgtcaggtcaacttactggtgggtgggttgcattctgtcaatggcaagacagtttcatgtacagtactgttttgaatactcttcacttcctacatgtcatagcaactatcatggggagcatatcagataccgaaaatagtttttttttctaaatgtagtttacttaaatcttttaagcctgcaggtggaaaaaaagccatagaaatacatgacaaacaaagaagaaaaaagagcgaagcaagccaaaacaggtcaatcatcatatctttttgggggtctcttcattgctactactcgtcgatactggtgaaatatttacatcagggaacatcaaacatggatgaacgagccgagctggttcttcattgataaacagaagggatgaacagggaatttacatcagagggctacacaaaccaaaggtcttaagcatgctagctccataaccagtttgcttacgtaccttaaaacaaatgtaatcgaattacacgagatgtagccgtcaatctgcagatacaactccagcgtgctccatccgtcacggacccctgtactgcctgaagcatgaaaggcatccttgtcgctgatctacagggatcatgcctccacccttcgaagtatcgatcgcctccaacatagacaccacctcggccatctcaggtcgcttgtcagggttcgcatcccagcagcgtttcatcacgtttgccagagaacttggacagcagcgtggcatctcaggccttaaattctaatcaaacaaggattgtagcacacattaaatcaaatcagcagctagacagaaagcagaaaataagccagctagaaaagagggttttacctgacgaacaacagcagacgtgacctctgagaagctcaaatctggatatggcatatcacagcagtatatctcccataaacaaatcccaaagctataaacatcgcatttcctgttgtatggactgccgttgagaacctgcatatcacatgccaatataaggcatataacatgcaaggtagtaacttacatacacaataaatatcaaatacccttcctaggcccgaggtacacacaactgtttgatgcaaaaaaaattgacattttttcttaattaattatgtgctgcaattagacaagtagtggcaaagaggaaatgaagaaactgaggaaaaaacaatgagcagtccatgtcaaagatcggatacctcaggagccatgtaaccaagggtgcctgtttcccctgtcatatcactgggatttgaagcctcaagccgagcaacaccaaaatcagcaattttcacagttcttgtcttgtcaagaagcatattttcagtctttacatcacggtgcacgatcttctttgagtgaagataacttaacctattgaatagttaaatgtcaaaactattccaatcaattagagcttttttttttgagggacaatcaattagagttttgaaggataaagagtgagtgaaatagttaaaagccccagaagaaaaactggcaaatgatcaaattgatgcttaccccctggcaaggtcaagagctatctgaaccacaactttaaaagctaacttctttctcctattctttatcagaaatccttttagtgaacccccagcaaggtactccacaacaacacagcagatattacttggcatggcaagatgtccgctttctgtttgaatatctagatccctggcgcccattatagcccctataaactgtatatagaatttcaacctgttgttagggtacatgacaaatagatagacaacagaagaaatatgaaaagacatatactttgacattataagctatgcttcaagcactgcgaatgctaggtcatttgattttggtgcaacaaatccaaacctcgatacatgtaaggacttcgtttttttgctgaacaatttaacagctgctatgaattatataccacaggtagcagagtagataagacgataaggctgttatccagttggtaatgccactacacagacatcactttcaatatttagttaaggacgctagtgttactcacattgacacatagacactgatcaaatatatgattctaatgcacttgatatggcatttaagcatttaggcatttagaaatttagtcagatataagtatgccagttatgtataaatctgttctgatttcatgcattttatggtcgagggaactgtaattaacccaaaataattgaaagaagcatgacttgttgaaataaatagtacctttgtaacatttggatggtccagcttatgccagacagagacctcttgtgaaaaagctgctcttagtgctgcgatgtcttgttcggacctatgcccatcctctccccagtcaagtaatttcactggagaataatatgaatcaatgaattattttgaaaagaggtgtttgtaatgagaacatacaatttcccattggaaactgtcaaataaaaacaagatttgagaattgatctaagcaaaggtgccaaggttgggagaggagcagggggtaccaccattacaccatcaaattgtcccttctcttttggtaagggcacacaaagacaatttcggtcttaggaagatccactttttgtaggggaattaaattgatgggcttttccaaaaaaaaaaatgcaaaatgatggaatccatgctgatatgggggaatggacgaaagatagctaacaatccctggggaatatgtttctcaaaaatagaatgtgaacatcctataaactatgcatgtacaacaactaatcatcaaccaattgcttatagacatgctcaggtccgatagatgaatcatcaaaagggattctttttgtgctgttgccgtgtcatgagtttgcatcgatggataatctcaatctggtgaaaaagtacacaaacttataggttgcacatccctccatactaaaaggtcgacattttcggctttctttggaaccgcaaagcaactttaccatgaaattcctagccagggatcacaagaaccatggccaagtgaactgctgatgagcgagggcacgtcaaaagccgcccaatccaaccgatgtcacggggaacaccatgaaaagccaaaaggggcagcggcatcaactcccgcaatttactaaaaggggtaaagaaaaggagcacccaagaggccaagacagtgaccggcggttccactcgccgtcagcgccgcattggcagcgcgatttcgtcgaacaccgtacgggcgcaagcgagtgcatggatatcgcggtggttggtatcaagtaaaaaaactgggagaaatggcgcgcgcgggcgggcgcacctgcgacgtcgtggccgtcgtagacgccgcggtggacggtgccgaaggtgccgcgggcgatgacccccctgacgacgagcttggcggggtcgatctcccactcctccctccgctgcctgcggttctgcgagtagtgcgcggcggcgagcgcgggcggcttgctgccacgctggtcggcggccgcctcctccttgcgcttctccatggtccacgcgcggctcaggtggcgctccagctgctcgtccaggctcttgaggtcgatctggtctgcccgcacgaaccctccatcgccgccgccctccttcatcccgccgtgtggtggtggtggtggtggtgagcaacagagcaagtgagcaagcgagcgagcagtggctaggctaggctaggagaggaggaggggggaagagagtggcgaggcggagtggcatgtgagcacatgggctgccgaggcaggcagcggccggggagggggagggggagggagacgggagggagacggggtgggctcgtgccgtcgtgtcgtgtcgtgtcgtgtcgcgtcgcgcgcgaggggcccagcccagcgcgcgcccagcggcgcgtggttttccgcggtttttccccctcgtcttcttcttcttcgacgttcgtttctcgctgctgctgcgtcgtgtggtggccggtgttgtttgggcgggggatcgatcgccgtctcggctcgcggtggtgtatttataccggcgtgagggcgggattgaggcgtatggatttcatttcgagggcagctctacttgcggttttaaatactttttgatccttaaaaaatactatataaattatggattgaggcgtatggaattgatttctgcacttaaaaaattaaaaccaattattatataaattatggtaaaatgtatacgaattataaaattgcggcttgattaaaagcaataaaactgcttagagtaccagcctgagggctaaggcaatttccaacataggacagctagagcacgggatactgtgatatgaatccagctaattaaatttctcccagtaaaataggtctttcccaccgtgcactaggctccctgtctgatacaagattcctccttggtatcgtgtatcccgcatcctagccgaagcaattgtggtagcttccacgcatatgtgacacgcagttgtgctcactgactcctctcgtggatcacatcaacagtaggaaaaggaggaagtgtgtcgaggggaggaacgggggacaagagaggagccagaggtaaatggctcacccaccggccaggcgggtgacaacctacgctctctcctcatggtatgacacctgatatatatgggtatcggatggtacctgggtaccaagcctgataccacgagatatcatggacgctctctcctcatggcatgacacctgatacatatgggtatcggatggtacctgggtaccaagcctgataccacgagatatcatggatgatacccgaggtattaggcttgatacttggtatcagttgcagatgtgtacctgcagacaacacagacgagcagtgaagagctagctaggagcacgacgcgacaacctcgagaccttgtcgctggtgccctgggcctcgtcccctcatctttgcatcttcccttttctccctccccagcgatcacaatgccgaccttgttgtcgtagttgccttcgtctttgctgacctcaccgattccgacggtctcatgatctcaccggtctccacactctcactgatgccctccaatctagtttaggaagggcgacaacgccgattagttctctggcaactggagatgggatcgcaggacgggagggaggacgacgacgacgactatggggcagaggagtcgaggaagggagggaggaggaggactgtgactggctcagagaaagtgggggagggggggagaaaatggatcttgaaaacaattgggttgtatatttgtcccgtagcctgcaagagacattgtttcgtagtttttcactttccaatactagtatattgttttctttgaagttgggtatcgatatgggttacaaggtcatgttctttatacacgactacagtttttgtccctagatttgctcgaggatctgaaccgtctattctaacctgaccgatcctatggctccgaaagaacagccatgttgggtcacctggacggctagatcctgagattgaacggacctcaatagcctgaactgaaacacaattaaccagagataaggggagtttctaaaaatattgatgaggtggcaagctaatctttcaccgatcctacggtgtttagggagatctatattataggcatttatatggatggtttaaacattagatagtataattatccacgatagtttagaataagatatccaagcaatatcgatgtaaaaagtttttaaagaagttatagttgaagaaccgtggtatacataattcataacttcgtaaactaaaaaaaaaagacatgatctaaatggtttttgactcttaaatacgggatatgcacgaacttgatacaagtactacgtactactatattagctttaatccgctgaagaattatgtttatataagggacctatatgtacatgtatgaggaccaagataattacatgtttgctcgaaggatgtttctcgtaaatgatcacgactgatgcaaagttcaacaaagaaaaagaaaagaaaaggagtattgaaaccaccaatcactagtgaggaggcaagtcaaagataagcactactgagcaattagaaacagctaggagtatgttggaaaacatgagccacattattatcatccttgacgacaaaaatgaacaaaaacaaaaaaaaaagagattaaataccactctccccgtccagcttgcttttgcctgatgggcagggagatcgtcgattttccagtagctcccatccatcctgctcacgggttggatttggctactgctgtggataacgtttcttgtgatccttagctttgctttgtcgtttgacatctacatcacttttcattaatatggtttattatatgctagtagtagctttcttgcctacgtaattgacgctctctctcggtccacggcacggtgcgtacgtgttttgtcgccattgagaaatcggcgacgtttgggccgtgcgcccgtggcgttttcaagcctaataatcagtgaggtgttgaagtttcgttcaaaaaaataagtgaagtgttgaagaaactggcaatggcaactctccgtatctcgtgcggctactacttgaccagtgctattttggctgtatgagatatcctggtactatgataccgtatgaatctaccaaacagtgagatctatcgagataaatctcttatattttaagatggataaagtatataccactggatctttcaaaaatcatatgctactgatataccctctccatctcaaaatacaacaaactttagaaaatagtatatactaagaagaaaggtaaaaggacatagtaaaaaagaaaacatttttaccttctcaaagatgagtaaggtgtatgccagtagtttattggcaaatattacctcccacgttattatatttaaaataaaatttaaactctataacttgctatattttttatatgttgagatgaaagtagtatgcatgtatgatctactccctccgttccaaaatataatattttttttggtatctaagtaaaatttgctatattttaggatgaagggtgtatactgtatcgttatcatcccaagactgcctcgcttacacgatgggctacgcttttgtctctttcgtcgtgcttctactaataaaagataaacaatttaagaagataaaagatcatgctactttcaaagatgtgacacgtgattggtttgtgattttgtacacgctcagcaattaaactgtttgtgcattgataaatctattttatttaaattaccttgttccggatggaggtactataggcttcctaggtgccatgctatggatctatggtcaccaactcacaaaggacttctcttttgccccctactgactgctgcataagattttttttcccaactgaaatgaaagtgacatcagacaacaaaatcatcaactggatggagaaactatcaatcccggcaaagtaacagttggagaccgatagtaagtaaacttttcaccgcaaaacatgtaataaaacaggcaacatgttgcagacaccattgtccaaaaaatgaaatgcaaattgattacgtacctcaaatagacttggatagttctggtccgtgtttgtgaagtgcagaagagtagaccgaaccatatggtctattaattaattcaacacgctcaataataacttcaacttgattgcccacattcttctataatctacggagttgatggctacacttccaaggtgagatatcactaagtttcaacctagacattcttcacgacaaaacttgtacatcataatggaccaactgtcttgcaaagttgaaacagacctacgtttgatgatgcctttcagatgtaccgggtgaagttcttttgagcaaaggattgaccaaaaacggccactgctagaatatcttgctgataggcttcaactctgtaggtaaatgatcatagttgcccgaatcaacctctgcctggaacatgggccgcttcccgtactctcgcaaaacacctggtgccaagtgctccttgcttggtgttagcattacatagtttggatcagccctttggtaactgcattttgttaagaacaacgaacaaagtgtactcgattaatagccaatgcaccgtttctaataactagaatagatgaacataaatctcgaacagacataatacaaatacaagaaacaaataatagaaccttggctgtctaagatcctcaacacgaattccaaatccatatgatcttgtccccttcaaatgatcgttcacagctgcaagcgcaaattgatgtcaatgcagtcagtgaacaactaaggctgagttatttccccaaggttccccaactcccctctctcgttttccacgcgcacgcttttcaaactgttaaacagtgcattttttgcaaaaagtttctatatgaaagttgctttaaaaaaatcaaattaatccatttttgaaaaaaaaaatgctaatactcaattaatcacgcgttaatggaccgccgttttccgtgcgtgagagaagtgttcccaaccggaactagcgaacacaccctaaatgtccttttaaaacaaattattgatagtttggagcaatctcactagtaactttctccatgttctatgggttcaattattctacttcaccagaatacaaatttaacaatggaccaagcactgcagaatcagttggtctcaataatcaatatttgacttttttttccatagggaaaaagtggatacatcctttttccagatataatagctggcctagttttgttatttgtatgcagaagtatttgcaaggtacacacctgtgacactaaatgtgaaggatggtctccaccatgacttgaatgccaaagctacagaagacttggaaggacctagctttccctattaagaagaagagagcaatcaatattaaaaacaagtaaagtaatgttgtatcctaaactctaaagatacgggcactgcatatgctcaatgtgttcccatcttttcttgcatcatattcatattcacaatgattgcttctacaaggcgcaaaataatccaacataaaatggcaaaattccatccatggagcaacgtacagaaaagggcaaaactattctgtaggttgggttgaattcttgcactaggtagaacccctcatggcctcatcgtcctatttaatacatctccatagtttcttaaatcattaagatgggatatgcaaattgtatggtacaaggtgtgcatgctatggttgtacatcctctctaaaagactagagacctaattgatgaaaatgaatggatctacttaaccttgaataggaagttcttattagcttgccaacttgctgcaaactgaaacaaggaattgttggcactctctgatggtttatctttatcaatcctatcaacggtgtgaaatggagttagttagctgatatgtgaataacatagtgatagttatttaaggattaccttgtagccaattcaagcccaaaatcaatgtagtttgtgattccaacaatctgatcatcttcaaaagggtttttaacctggtagatacaatcagcacaaagtctcaacaagcttcaagtttaaaaacttgtggcgtaccataaacgactcaacagtggatgagtggaagatatcatgactgtaagtattttttctgttaattggttaaagataggcttttctgcatattataaaaagctggagtagcagatatttatccaacctatcataaaattgatgccatgcaaccgataccaggaaactatgaaactgaggaatcaaggatccacataaattaatagattctgaactaatactagaaaattttgattaagctaaaaaattgatgttcttaatagttttcagcatcaagaagatttcatgaactatagtgaaagagaaccactcttacccttctttgaacaaccatgtgttgatagaacgatgcaatgaactgcacatcaaggaaaacaaaatgttgttacacacgagtctcgatgaaggtcacactagctagagatgtcaccaatcaatgattatttcatatgtgctagtgttgtacttcctccatctacttttgatagtcatatttcatcttggcacacagaccaaggataagtaattctacctatcattcatttaaacatgctactagtcattcctcgtaaacaagcgattcattaatatttacatttctcgatgcccatgtagccaacctttgtggaagaatggagagtcacacattaaatcagagaaagttattaagataataggttgttggattgaaatatgcccatcaaattttttttttttagatttggaaatatgcctatcaaaagtagatggagggagtacttccttattcttttatccactaataataaaataaaataaaataataataatacccaaaagaaagaaacacataagcatccagcttgtttcttgacacagttcatgtgattaattataaaattcttgaatatatgaaggatttcttttattacaagaaacacatactgtaagagctgcaacatttcaagtactccatttaaaattactagtccaactctaattataatatgcacctagatcaagggagaagtaattggataaagagaactttagagagaaaaatagcatggacgtatttataaagccacatttaaagtttgcctcaaagaccacatacaactatccatcactccatcagagatggtaaattgtctatactctgtaccattgttaagagatcatagcaaatacaagctaattaactgggtgaagcttcctaaatgagaaaagagaacaattgccacaaacctctgtacttctggcaagctctagagaaaaaatgaaggaaggactgagtgggcttgttaatcctacaccataactgattgcacaattccagttcttccaatctgtatatggcataagatgtttgtttccacctattgcagaattcgcataatgtagaattagtatagcaccataattaaaaaaaactcaaaaggtgcaaataaataactcaatattcatgttaattctctaaatgcatgaaaatgcagatgaacgccaagatagcagatacctattgcacaagtcataacaaaaacagcattccagtccagtaatattaaaaccaacatacaataaacttcagccttttagtatctttatctgaatttagaagaacattcatccatagttatttggatataagacaaagatgcagtccataggcctctatctgaatgaaaaatttcaggtttcccatgacatgcatgtatattcttctgatggtgaatagaatgattgaaatcctggtaaaaaaaaaaaagaatgattgaaatgaaaagcgccgaactgacattttaagggaaaactatgtccatatacattaaaaaacttttgttaaaaaaattactagaagagaaaaggaacaccaagtgctgcaactatttattgtgttcccaactttgcatgctccacacctccaacaaataggcccctcaaaaccagcataaaatttcaaagtccaactcagctaacataatacaaagatgctattcaaaattcacgattgaacttttttcatcttctgttgattaacttaggtgctggagttgaaattttaccagttgataaactaatcaacatctatttactgaagactaatgtgattggaagtaatttgggcttcagactagaaaaactttactaagtggcttgtattgcactcctgcacttaagctcccttttctcccgaccaaccatgctccagagggtagttcagcagatcctgtcaaaaaagagagagagagaaggtaatatcagcacatgtgaccttaggaaaaagtgaactgcatatagacattattaggggcctcttcgaggacattgtaaagattggatattgtggtatgtttataaacagtcacatatcatctttagtcataacaataaatcgcatgagaatcataaatgattacataccaggaaatggcacaaaggaagacccaaatgatagattctctgaaccgtatcttactcccatgacaccataatcctcagaacgcaccctgaaaaaacttatctctctgattctgatggtttataaattataagcatattgattgaaattattcagatgaacattatttgcaatcatttatctatgatgtcaacaaacatagttgtggaaagctctaacaactccatgcatgatttgcaactgcaaacaagatggggtaatctacctgtttcccattagtaaagggaatgtcccaaacgcaccaacacggtacttaggatggtaagcacatgacctaacctgcaacattctggataacaagttatgagccaaaccagcatcatccacataattttcataagtaaataataactgcattgatgatattatccacataacaagaaagtacttacgggtttgaagttgacacaagaaggtccacaaaggtatggggatcatctaaatctctaaaaaattagtaaagcatttttatgttaaattataaagtatagtacataaaaatcaaggactggtaatatatatggaatagtaagtacttctgccagcgaaatagagcatctccctttacttgtgttccgtctattttatcagcagctgcagacacctagtaatattaaggtaggcaattttttttctttcaaaaactagaattcaagtccataaaaagcatatttattgcaccaagaaaaagtcactgaatctgacttcccagaaagtatcatcttaaaataatttcttgtaccaaagatgaacaaatgcaaacgatgttaacaatctaagttaatttatcagtcatgagtcatgcaataacattgatcctatcaggcctcccagtagacataaatttgtgccaaaatttaacatataattggcaccagtagatcataatcaccagaacaagcaaaaatggtagagggcagaccttttcaacacagacttgcttttccagattttggttataaataacagcaacaatgtcattaagtggtataaaaaccatggcatggtaacgaaagggagagatgatctaaccttctttgagcaaagagttatgaacagaggcaatggtaattgctagcaaaatgaagcaacagaaaatgacaactataagaagggtaaaaaaaatggtgatccgcttatcctcatttcctcatttcctattaagcttagacagaaaccatagtaccagaagaacctgaaacaacaaaataaaataacatggtaatgtcatgtcatgtttggcaggatacagtggcaatcaaatcaacatgaggatcctccagtggcttcagcatgacccttgaggtcatattccccgcatgatcaaagtagtcctcaaacagattctgcagcgagagcttcccaaacattagctcatacgctggcaccgacatcctgcatatttaggaccggaaccatttcagtgaatcacaacagaaggatcataggctaactacatagagacctctcgtccttttaggagcattacaattaatcacaaggcacacagattatcagtatatcttatcaaaatgcttgcgtccgtccagtgtctcagccagagatgtgcattcccagcaaaaattatcagaatcggaactacaaccataagcagccggtgtgaatgccattgtacatttgcaccgacctacagcttcggttcagttcagaatgtagagaacggccaagcgcgagataccactaaacactaatcacgattattcagcctagcgagtgggggaacctgcaactacaaggctctagttactgaagcgaatcgcgcattcatgtagaagtagaacacgtttgaatcaaccgagagtgtaataaggcgagcactaccagtgacactagctcctgacgcaaacgagcgagttcgacggatttcgtttagggagggaaggtgagaagggagaagaggggggagaccggcggcggcgaaggcggaggcggcggacctggtgcgggcggcgatgggtgggtagtcgaagagcggcgggacgagcaccatcggcggcggcggctccgccttgctccagaagatccccatctctgacgaagccgagtgcgcacgctgcctcttcttctccctctccttccttcctgaaccctcctcctctcagtcggtcactttgaactctgaaatcgaaagagcggtggctgaaatatttctgctcccatgtcacacaactgcgcgctacggaatttcgtttcgttttagattggaatttaaaagctgcatatgcatatacttactccgttttttaatagatataaccatttattttatttatttatttttcaaatatataaaatataaatcatgcttaagtacattgactgataaaacaactcacaacaaaataaattataattacataattaagtaagatgaatgatcaaatgtgccataaattttttaataagataaatgatcaaatgtgtgaaaaagataacgacgtcatctatttataattacataattttttttaaagtaagatgaatgatcaaatgtgccataaatttttttaataagatgaatgtttaaatatgtgaaaaaaataacgacgtcatctatttaaaaaacaaatgtggtatagagctatgttcgttacgggaggttcacaaccggaacacagtgcgcatggaaaacagagcagtccattagcgcgtgattaattaagttctagctaattttttttcccaaaaatagattaatatgatttttttaagcaactttcgtatagaaactttttacaaaagctgcactctttagcaatttgaaaagcatgtgcgtgaaaaacgatagggggagttgggaaggggaaaggaacctcagtctctctacttgcgtgttgcttcaagacattataataatcaatctataatcaatcaactaaataagtgctgatgtttgttacttaccaaatcgcagatatggctaactttcccaccatatcgtagagaatgtctcattttgtatcattgtgtatacatactcatagaaaaatgccacaatattcactatgagaaaaaaatgcaggtattttttttaaaaaaaaagtaaaacgagacattaagctatattgaagttcctacaccaaagaatggaaattatatgattacaatatcttgtctattggaatatagttacaatatcttgtctattggcttcaaccctgtaggcaaattgtcataattgcctgaatcaatgtccggctgaaatatgtacttcttccctagcttctttaaaaaccggggttccacatcctctttgttttgtgtgacaatcacatagttcgaataagccatttgataactgcatcccaataagatagcaaatattattatcaatattgtaacatattagcaatattatcttgtggtagataaaaaaaaacctgggctctttaagatcctcaatggaaatcccaaatccatatgatcctgtccccttcaaatgatcatacatagctgcaaaaagaaatattatggagccattatgaacaatttaaacaacatcatttcctattataacgagccacatataatatatgagcatctcaaacccccaaatatgaggttttacttattgagaaaaaacttgaatactatagcacttgatgtaagagaaacaaaagggggggtatgtggggatatttagattacgaatcttcgattgttaatctttcaaatataaattgctaatattaaaagagaatttctatctccctattgggaaacataaaattctcattgaaaccaaaatagaggggaacaaaaagagatatttaagtgagggtaaaaaaaacacagaacttttaaagcgtaatttaatgttgaagtgtccatgaatcttgttgtgataactttccccttgcaaataaaattgttgctagctaaaattagaaggtctacaaacctgtgaagctaaatgtaaagaatggtctccaccaagatttcattgccaaagccatggaagatttggagggacctaactttccctgttgagaaaatagaaatagtgtcaccacaaataaatgaaaataccaacctaagcataagggttaatttcatctttactctcaatacaccttgtgagttgtgaaccattcaataatccttataaaatgagtagtgggggtaccaccaccacctaactatcaactctcaaatttttttaagaaaaagagatgacatatgggggttagaggacccatatgtcaactacttccaccaactctctactttttgtgagagagtgtgaagctaaaaagatccacacgtgagtaacaaatatgtacaataattaagagatggtaataacacattaatgataacttaataattaaaatctcattgcaacgcacgagtaatatgctagtttattataaatttaaaagaaaattttaaaatatgtttagcagagaagtcctacaaaactttgccaccaagtagcatgtgagccgcctcttttctttttaatagattttttgaaatttccttcatccattaaggtattctctaataaattttattttattaatgcataaatgatatgaaaaataactgacctttactagaaagttcttactagcctgccaacttgcagctacctggaatgagggattgctagcattttctttcgccttgtctttatccaagctaaggctcaaaaaaaagggattagttaatataattgatgcgtaattcagaaaattatcttaatttttatgtttaccttgtggctaactcaagcccaaagtcaacaaagttcgtggttccgataatgtgttcttcttcacggggattcattacctaatagacaattagacatacacaatgcagattgttgtcaagattcaatatgtcctagttacattaaaatgattaataaataaaataacttagcgtttcaactcatgaatcttcataacttagtgtcctatatcctataatatcagttttgtatagtttttagttgtatcataatggcacaatgcaattttttttttgaaaagagtgcacaatgcaatggcttcctagaggtgcaaagataatgaaagcaaaaaaaaaagggggggtactaaaacagtatgcacgagggaatatagtaagcaaaattatctattttgaaaacatgtaaagtggcattgctatctcagattcttctttctccattgaaatgcacctgcatgcacatcttataatctgaatatgcatcgaaccaaaaaaggatggaaattatttggtcaggtgcacacagtatacaacaatttacatttcatcctagaaagaatagtgctaaaacaaataagctaatccttaacatgctgctagaacctagagcacattgatgagcgcaacagaatgggtaatcctttaaataaattgagaaaacatgaagcatttttatggaacatagactaaattaaaaattccatacccttctctgaacaacgaagtgctgatagaacgatgcaactagctgcacatcaaggaaaagaaaatgacatcacacatgagattcaaaagataaatattgttgcaattgagattgagataagatcaaattacggcaggttatcaagtttttcttagcagcgaacaaatataattgttgttattttagataatagatcatgcttcctttccaacagagtcaaggttagaaagaaccaagacattatgcccatagtttcatgacattgttcggtgtttcgttattcaacatggaggtatagataatcgtgcggatatgaaattcttgtgtataaacacatgtgcatacatatactgagactgatgacatgaatagtcacatttttagtgcggcagaactaaaactaaaagatgccttaataacatgcacaaggtatccatcaaaaacatgctatttcgataatcttgtcaaaatatcctaacaactgcaatatagtacaaactatgtgaagctctgttatcaaataatgagaacaataatggcaaacctgtgtatttctgacaagctctagagaaaaattgaatgaagggctgagtgggctagttgagcccataccataactaattgcacaattccagttcttcaagtctgtcaaaggcacaggatgcatgctttcacctgctagagtatttatgaatgaaaaagagagaatcaaatacaacaacataatgccataaacttttaaaagtttataaaaggggaaatcaacatctaattatttgaaggccttatttgaatgcaaggaaaggacaactttttaacatataagcatatgtaatgcctcaaaactcatgagagataagggggaaaattcttaagtttcattaggctactcttcctatgatccgttaaggtttagtaactcgcactcacagagtggcttgtattgtatccctgcgcttatattccctttcctgccaactaaccatgcaccgtagggtacttgaccagatactgcaaagaaaatattatgttgtgacaatatgtaagaatatcattagagcttgacttaaacatattgatttaaaattgagacagctgatctacttggctgcatattattttcattctccaagtccaaataagttagaattagaactatgagtaattacatacaagcaaacggcagaaaggatgccccaatagacagattctctgaaccatatcttaaacccataataccataatctccttctgaacagtccctacaaataaataaataaataaatttaaccatgtcatttttatgggttcaatgcatattgatagaaatcaataatgagaatatcagaattattggtagcatatagtggaaaagtataacacctatgcatgatctgcgaccataaacaagatatggcctacctgtttgccttaagtaaagggaatgttccaaatgcaccaattcgatacttaggatagtaagcacacgacctcagctgcaccatgctggataaaaaagttataagcgaaatcaacattatctatgcaccatttaggatataagtttcaacataaatgtcaatccaacaagaaaatgcttacggttttggtgttgacaaatgaaggtccataaaggtatttggatcatccaaatatctgtaaagtaattcagttgagccattttttgtttagagtaaatgcttagaatagtaacaaagtggcatagaaatctggaaataatgaagctttagtaaactatgcaataataaccacctctgccagcgaaacagagcctcaccacccgttgtagtcatctagtaaagccgagttaagaaaaaaaaatacattgcaataacgtaggaggaaaaaaaaaccggtaaaaacatcataacaaacagagaagaaaaaaacgttattgataatccacgtttcgcacaaaatttcaccgaaataaaaaggaaccagatcaaagatcatcacaatgctaacaaaacgaaaaaaagtcaatgttcgaatggatactttggcggtcaaatcaacatgagaatcaaccagtggcctcaacataatcatccctgaggttatgctcccaacttgatcgaagtaatcgtcaaacaggctccgccgctggagcttcccgaacatgacctcgtacgccggcaccgccatcctgcccaaacaatgccaaccacacttcagctccataaaaaagacaaccaaattcgtcgatgaatgcaagcaatctgagtagtagaagatcgcggagatgttggtgacctggtgcgggcggcggcggcgggaaatgtgaagggcggcggcaccagcaccatcgccggcggcatctcgtcgtaccgccgcatcgtgctcctcctcccctgcaaatcgatctcgcttccaaactaaccaagcggccgccgctgctgataagtcctttttccttttccttttcgccttcgttttcgcgctcgcggttgatctctcccggccttgtacgccacccgcgtcctcccccatcctttcttgccaaacaagcctggcctgcaaccatgggcccggcccatgtaggcccacaaatgtgggcctgcggctatgggccaggcctgtctgagcccacataaatgggcccacatgtcaggctcctctcctcggttcgtctagtcgtcttcctactctcctccgatctccaattcttatccaacccatggtgcttggctccccggaagtcgggatggaggattcgtcggcgactcacctctccgacgaggtgcaggatccaggttcgatccataatcttacttgctttcgtcgccacttggtagtgaagctctagttagtctgtagttagggttgtgatttgtgaagggaagcaaaatcagtagctcgatacctaatcgatgaactccatgcttgccatggctctaggtcgaggaagctcagatgcttctgttcgtacttctttgcgagattcgacaggaaaggaggctgttgcggccgttgaaccggtgagggaggagctggttcagagcgcggtcggttttctgaaacacccaaaggtagtggcctcttctgatgtccagaggcgttctttccttgagaagaaagggctcaccgtggatgaaatcgatgaggcatttcgacgtttacttgtaagatttgttcttttcgctgccttgtcggctcttctttttttcagagcaggggtgaatcactggtggttctgacttgattaatttctctaacttagtttctgcaattttcagagcccatcttcaaactccatgagtccaaattattgcacatatcaaggtatgctgtggtcacctgtcaagattgttgattaggtgatggtgttgttctgtgtgattggtcactccaaatgaacttcccctctttaggtttatatatgcacaacggtgctctaaagtgtaaatggcttcatcaagacatgtctaatgacatcgccttgtgttttccttcatttttcaggggtatctgatcattcttcaaaaatcacacaggtcagctaaaaagtacagaaaaatgtttttttcagtccacacttggtatcgatcatgcattatgatgtttatgttgcaagctttaagttatccctttctctttgccacaggagaatccttcaacagttacaaaatgtatggatgatgattcaggtttgctcatgctgcctttccatgagtcatgttgactaatttatccatgttttctaattctgttgttccttcttgcttttatagggagacctgagcctgaaactgaatctgtggatcctgtggtgcctcgccacccaaaatcatatatggaggtcagctatattgagcatcaccttttttttttcctgtcactctagcatgagcgtagaatcgatgtgtttttctttactcctaagcatgctacttgaatatttaccaatgaagtttagagtgtacagttgttactgactgtatcgtgttgcacgatctatgattctagtagtctgtaagtgaacgcaagttacatttgcttgtgctggtgaaaggtcattcaagagtcaagactaccttgctaggaagtgcgctttcttaatagttttagatataaacttgagcactccttcatccactttaatcgctaagtgcagctcaatgctttgctggcatgcacagtagatttttcttccttcttttgatgtaccatatactggacattggagggcaactcatcaacatgttttatatattttggggattatctattgtatgatggtgcaagtaattttagtgtgctcttattaaagtattaggacaaaaacaacttatcagccagaaagttttattatttttttggatttaatgttgtgatgatgagtaaggaatattaaagtatgcagattctgttgctgaaccaaaaattagctcttaactgtcatactggatttgacacttgacagatcatggaaatgatacaaaggggagagcggccagatgatatacaggtatatctgagtttatgcttgtcaagttgactttgtgaccttatcgtttctgtttcaatataggacattaatgatgaccctccaaacccttatcaaccaatctcggaatcccgcatggcaccaaagcccaaggtttgtagttttacatttccagctaaacaaacctttagtagtataggatgtagttcttttgttagcatgatagaaagtatgtacatgtacgtagggactacaaccagcattttatgctgaaattagagtaacttcatgctaggctgttttcggacaacacagttcactcacgtttattttgtcggtaaacagccatgggaaaagcagggtcaagaaagttccatctgggagttgaaatctcagtcaatggacaccatcgaatcgagatcagaaattcaacttgacagcgccaaccaatttactgaaacggagaatagatcaaatcaaggggactcactattgctggaagaaacggttgcaggttctgaagctcacacagatgatgctgcctcgacaaagtcgtaaatgcaaaagcacgtgatgatggaattgaacatgctgggaaactatttcaacatatacttagccaaaaagctcgaatttctagtgcaacagttttctgaaattctctgaacctgctttctctgagctcactgatctgcgtacttccctattgttggaatcagatttagcaggcacaaaagacctcccaattttcgttagctggaacagttatacaatctgtataatgtaatcatgaaaaatatacaaacaacaacatgaaatgttgtgacttgtgaggctcatgtcatgtctgaagtctgaacccttgcatctgtaacagacaagcaaagattgcttgattggctagaaatagaattgttgaatctgaggaaaccattaggaacagagtaccgacactgatcccagtgtgaacccggctaggtgtgaaagtctccccaatagtgtgtaaccccatctgctctttttcgtggcgtcgaatatgcttcagcgtgcgtgtcgctagcaacgaacagcaaccggagaagaaatgaattcggccttgctttgatacgcatctgactgcctactatgccgatgggtcttgacgcgacgttgatacaccacacagtgacacacacaactcctcatcttttccaagttttccaacgccaactacctcgaccagcaatcaacctaacctagacgatgcaagagacgatcgagacacaaagctacatgcctaaccagtccaaaataccactgctcttacccggtcttgcttgcagaattaacgacatgtttggtgccttcttggttgggcaaaagcaagtgccattttgacttgactagtgagtagtattactacatagtaggagtacatactattctttgctcataatgcagagttgtgtttgactgggtactaatgctcgtcaatgcactcttactagctcaggagaatgttctttttaacgtctttgatacgtcaagatgacgttgtgaagttgcggtgcagaagagagttttgatggcaatgattcagattaggtgctgtaactggagatgacgtcagggaaataggagagggccaaaacttgaaagctagagcagcgtcagcaatgagcctaagtttaggtagtattaggcagctcaaattggtcatcatgtcaatgacaaccctggtcctaacaccttgtatgacaacacacgcaaacaaaagcatttccattttctgtaaacatttgcaatgatgcaaactaaaacagatgtcaatttgccattacatgtagaaataggactttgaacccatgacctttgcggtagtcaaccaattttctatgtgagtagtccaccctgtaccatcgaattacattttccatcatttcaatcgtcccctgttttttagcctttttagcctgtaattatatttgtaggaagagcgattttactgcctttgaggtaacaggagatatcaaatttgatacatctcggtacctttgatattgtcgagggaagaccctcaatagcggggagtcgtgagacccccctttcgtgagttcggctgggggcggaggcccgtctcttgaaagtcgcttgctcatccctaggactatcggtgagtttgcacgtagtcggattatacaggttcgggccactatagagcgtaacaccctacttctgtgtttgggattatggatgagttttacaagggtttcttcactccggagagtgcacttgctttctctcttctggagttcaggtattctgggcgtcatcccctttctcagtgggcagggtcctccttttatagcttaaggggataccacatgtgccgcctctacctaccctctatgggggggaaccccactccacttttttgggcttcaaactgtgtcttctcccggaagctaagcaatagccgtttcttgagcagaattcggcgtcgtcccccgtctgacacgggggacagccctgtcattccctcataaatgaacggtgacatgcaacagcccttcctcaagtgacgcccggatgtgacgggtcatacccacccccactccgccggggacaagggcgacgtgaggacacgactgccctatccatcggatgtgacggagacgggccgatcacagaccggtcacatccgatggacaggggttagctaggcgcgccgcacgtctgccctgaccgcattaaatgcggtgagggacagttggggcgttgcacatttatggctgttcagcctgcactccccttttgctctctccctctgccgcgtggcggccgggtgagggcctcggggcgaagccgtgagagagcccgagggggtgacgtcatgccctgagcccccgcccccc

SEQ ID NO: 66607 - DNA, 18748 bp, Oryza sativa
gagcttgacctgggccgtgtcctttatcatgcgtgccatgcctctcgctgactggcatgtgcactgcttgctgccttcttctctactctcacacagggtaaatacgaaagtacacgtgtcttttgcctaaaaaaaagtaaaaacaaattataattgttatatagaagtgaacaatgcaaagttttagtggtatagaagttaacggtgagatttctatagcataactctgagctggtgcggttttggtgatatgaaaccaattcttttggttaaatattttcaacttattctgttattaccgtaataaacaattgagttaatctgtaattcttacttggaataagtgaggattgttcacttttgaaaatataaatttgctactgttcgcagaagttagaagtatgtatatgtgttacagttccattatgtgaagcaatatgttgcataattatctcaagcatattttttttctattgtagttttcgaaccacaaaagaccaagaaatacgaccatatattggttgccctacacatgtggagcattgggcctctctgcatgttctttatggcttttgcgccacagtagcttgatgggaagttctgacattgacaactggattcaagatgcaaaagaatcgatggttggtttttgggatgtgcatgttgggcaaccagtaagatactttctggatatgtccttttattgtgtaccatatgcatgatgctagcattagttaactaaagtcgaattgagttactttagggctcattttgataggtgtagtttatgtccaatcccttcaagttggcaaggaatttgaactaaaatctccaccaagggatgaggtctaatccccctatatgcagtatgtgagggtagagatatcagataatcacattaaccagtatagataattatattggaagacatacaagatgttctatgaaatactgtatcccaatatttatctgttaaaaatgaaaagcagattactgcttaattagcaagtgtggtatgctgttttgtgtactattagctgtgcttttgtgtcaatgttaaaaaatcgacttgcctttaccggatgacttcacttattagttattaccatcaacaatcttaaggcaattagtatatccaggttaagaaacttgttaatatgcaccttcatcagcatgcacatttcatcagtgcactaaattctgctcattcaactcctatgtgtgtccataacattttttacagaactcctgcaattatgcttgatttggctgataacttataattgaccttactatgtcaacaaaaagaatgcatccctctgtgactgtgtccagctaaactcgatgttctttgtacttttcaaatttagaaatcatctatattactaagctctatcatgacctcattcttctctttgagaatcattagatcatttccatcagggatgaactttttgagacattcaaacaaagatctaaacatgaaatggaaaaacaagaggtccaacaaactgaagaatcattgcgcaggttattccaatgatgcccatgctcttttgtaaagcttacacatgcatgcttccttactcaaaacttagtaaagtattgttctgaattaggcttttctccttcaaacctacacgtgcctttctccttaccaaaactttttatagaagtgttctaagttaatatccatttgatatggcctaagtttcacctccttacccaaacaagatgacatgtatctgcagtttcaagattttacaatgactatatatggttcagtaatgtaccagacatccatgccatttgaattatatgcgcccttttactttcttggaagtgttcctgtatgaaattgtgggttaaaattaggttttgcttcttgtgccttttttatatatctcaggtaatatcgatctgttgactgttgagattgactaattttcgttagtaatcaacaaaaagggcttcatctcataacctacatcctgtttcttgcttgcttccttctttttttttctttttttctttttttgccttttctagtcccttgacaatattcatcaccctggagctatgtactttattcccacattttcttggaactatgtaaaatttcaggtttgcattgcatttattttctgaaacacattgagtattataaaatggtcttgcattatctcaccgtacatgttacatgttgcctttgtaggatgttgcttgacttttgtgggaacacttcaaatgaaaaaccgccacaagatatgtcagagctagcaatgatggagattgtcatgaagaggtaagagtgtttgaatatttatggtgtcttggctttgacagtcatagcttatttcaaggggaaaatttgcacgctcaaaagtcacctggaattattttgcttttgtatcggaatctattgacaagaaaaaatttgtgtttgtcaagtaccattttttaatttttgtttgtttcgaaactaaattaattcagttggtactggggacagaccttgtcttttttttttttggtggaatgaccaaaggaggtcattcaatgtaattaagataggaagaaaaagttacagaccttgtaatgaaaaactaaatattagtgattctcataaggctgtacataagtgcatcccttgatacctccgaggggtataagtttcgtttgaaaaaagtagaaacgaaccccacccaacactaacacgtaacaccccttactctatacttttctaacaaactacatatcttattccaaactaaactgataccttcctaactaatagatatgatagcaaataagtactctctattattgcaaactaccgaatttatttggccaataggcgttattattgtgtaaggtttaccctttcctagtcatactgctgcagtattgctgcttgaaaaactgacgcgcgttccagctgtggtcacaaaaagcttttgaacttccattttattttctctgcctggtttcacagtgtaggctggtagcaactggttacccatagttactggccagtaggtttttctctgctggttactagttaccactcggtggtacttgccagtaactaaagcctgtgagaccaaaaaaggcatagcacatctttggctttccaactgtaattttctcaaggatttctctcttttgtttcagtaaaggtttataacctgttggtgaaataatggtactatttagagttaaaacttcaagatgggtttgactcagttccaaagtgggctgaatcaatattttcttagtcaaaaataaattttaaaatgatttgatcttgatgtgcataacagttaagttcgtgttgtagaattctaatctatgtctcatcttgcattaaaaatgatgaatttttgttaacaatcctaagtttagtatctttgagtttctgccatgatcgatgaattaataactttctaaattctaatattagacacaagcttcaggaagttaagaatcatttgtatagttgcttctatgactccttggagtgacttgttgcatggcttatgtcaatagaatctgaacttctgcaggagactttttgtgtattacatgctttgtatgcacttatgttgcttacataacttaatgggcacttcacattttatccttatttatctgatacctaaatttctatgcttttgacgatcactcaatggactaaattgatggagcttcttttgttaaaaaatgaaaactaaactagctgtttacattttactgactcaagcaatgaacaatgacacttctctaatatgttgatacagatatgagaaggaagcaatgcatccatttaaaggtctttccagtggaaaattaacatgtgcattgtctattcaggttcttccccttctatctctatttaggatgcactcagttcaagttaacctgcattttttctaacattctgatcctaaaaattcagattgagaagcataaactggctcttctggagtaagttatactaatgtattctgacaatactgcttaaaatgcatgatgataaattttttatgtctaatattaaactgcaagagatgattgaattgtttttacacagggcaatgctggagctggaccagatccttagggcaaatgagataaactttgctattcttgcagcactacctgcatttggtgtttcacttctgctgctctttgcagttcgagcatgggctacacatgtatgtataaccatatagacccattgctgtcttattcaggggcatctagcacaaatagggaagattttcactactttctttttgaaaaaaaatacaaattgatccctagcaaaacatttttgcagaaatggaactttctgcactacaccgtgatattaagcactatatattcgtagcatgggatctcaggattcggggctgtgtaaactaccacataggatggtccctagatatgctagagttctacaaaacatcccatgtggtagtatacaccgtgtcatgtacgtaaacaactaatgtcatggctctgatctatttttagcaaagtttcatgaaaggtctatttgtaataatattttctaaaaggggacaaattgtgaaaacactatccgcaactagcaggagatataatcttgatatattatatcccagtggtttgcagttttcaccatggacaagtgtgcatgaaaaagataataggaatactaggttcagatatggttaattattgtcctcactatgaaatagggccgtggtgctgagggaagaggtaggactgcacggcgtcagcgaaggctgcttcttgctgatgtagagaaaaggcttatggagtttcagaattgcatggctaatggaatggtaaccttatcattatcttaaattagactacatgaccttatcttgatcttaaattagactacattgacatttatttggatgagggacaaaatacttgatctggtttcctgttggtggctattcccttctctaagaaatactaccttcgttttttaataaataacaccgttgactttcagaattacgtttgatcatttgtcttattaattaaaaaaactagtgtaaatatactaaagtacaagtcatatttaaagtttctttaatgataaaacatgtcacagcaaaacaaatgacatttgtataaatttttttaataggatgaatggttaaatgtcatgtcataagtcaacaacttgaaaaaacagagggagtatataacgctttcctattgtattttgtctgcaaaaaccttattccttcacctagtatgagaaaacaagaaactgccattttcaagattggacatccccaccttcgtcttgaaaatccaagattgaagtgctttcgtattgatgagaaagtcattttctttcgactttcgaattacaaacttgaaaaatattaggattacaatacgtactaataaatgtctggctgaatttcctaattttacaggaggaagaggcatgctgtaagttcgggttaacactgtacacccttgatagactatacaaagctgttgaatcgcaggcgagagaaacaggagagtggtcaaggtgagtctcaaactcatagctctttttgatacttcccttggctacctaggtttgattgcctgtgaaccaaaaaaatcgttttccgattgcagcttgagagaagacatgtttgatctggcaaagcctggtgtgggcatggaagacaagctggttctgctgtcccggctcaaagggatgtacgactgcttacttccatcaccgtcaggtgtcttgccccgtctgtagtcttctcatcttcctttcctttccttttcttcttttctttttggtcacgtgtgacgattagtgaaccccaatcttagacgacatgaatttgcttggcgttttaagagtcgtcaaattttgaattttttatgccccgggtactttgattgtagccctttcggctccatggagtgatgatggcttttgtgctgctgcaatgtttgcaccagagattactgactgtaaatccaaaatctcttctaactggatgcttaattcatgtgccacacccattttacatttgtttctcatcattgaagcacatcgaaatttagggtggggatcctctaccataatatcactatcattataagtcacttggtatgtgggtctcattctcctattgtcctacacataagtgtctataattggagtgccactatggtagaggatgtaaaccctgaaatttggccctggaaagcgtgaatgtgtccagatactccatgttactagtatttcgtagtatatgttagctgtgatctaaggttgtgttttttcctccaacttcaatgaacgatatgttttttcacaaattttctataggaaagttgtttaaaaaaatcacattaatctatttttcaaaaaaagttaatacttaattaatcatgtgctaataaatcgtttcgttttatgtgcgcgtgagatgggttctcaactcattgggaagaacatagcctaaatccacactgcaacttccatttttagttagtacgcttttcaaactatattaaaatagtatattttttcttaaaaaatgtttctaaaaagctcattttaaagtgagtaataattaatactccatccccaaaatatatgacactgttattttttattttttcataaaaaatatagtataaatatgtaaaagtataagttaagaaattgtagattacagtttcttttgatgataaaacaggtaaaaaaattattcagatggtttttgaaaaaaaagagactaacatccattttcattttccatgacggagataagaaaatactactaataacctttcatcaaaagattagtttatgaaaaaaaaatgctatctgtaaattagcccttaaagaaagaagcacctcgacattccttctatttactttatacttaaacaaagggaaagcattgcatacttacatttgcatgcgagtatatacatagatagcacggcaaaatcctagttaatccagatcaccctttcttaaatttgagaggagttattaattaatccacatcatctatgagcacacgcggaagaggaggaatcggatccgtgccgcgttgctccgggccctcgccgtcatcgtgggcccggcccatgaccagcacgctcagcaccacgcgcctccccctcatcaccaccctctccccatgcaccatcgccaccaccacctcctcctcctccgcctccgccgccgtcgccggcggcatctcgtgccggcacagcgggcagctgccgtggatccccagccaccgctccacgcactcgccgtggaaccggtgcccgcacggcatctccttcctcctcccgctcccgcacgtctccctggactcctccccgtcgtcgaggcagatcgcgcagtcggacgcctcctcgccgtcgtcatcctcctcctcgacctccctcagcgccgcgatcgatgccctggacgccggggccacgccgccgccaccgtcggcgctggcgctgccgtcctcgtagaagacgtggtgcaccaggtacgcccgcccccgcagctccggcgccgacgagacggacgccccgacgagcaccggcggcacgcccgccaccgtccgcccgctgtccctgtccgtcaccggcgtcacgatcgacaccatcgacgagggagcattggtgagcgacattacccgatctcttcaatttcctcttaataattcttcgcgatgcttttgctaccatctgcctcgctctcgctatcgttctcgctcgatttgatatagaggaggaaaagacgccttctcgatgatcggtggattgggttgatgatgcgcatggcgccaaagggttcgaggtaggtgagccttttttttcttttttgtctcacaattttgcagctccgacaaagcggtggcgatcgattgggatttgggctccacatgtgcacttcgtcttcttgcagcaacacaaggtccatcacttcaattttggatgcatgctgattttgcttggattcaggctgaatttggtttgtttggacaccagaaatgtccttttttgactaggaaggttgttgctgttcttgacatcccagtgcaaaaggggtttgatgattcacaattttggaatgttcttggaagatctctttgatgattgacaattttggggtgttcttggaagatttctcatggtggagccatgtgcgcagaaactcagcaaaaaggcagacctgtgaatttgttgatatatactggattgttattgacatttttgaccttttgtaactatgcaaaatactacaggtcaacataaactgtgacgtactctacaatttaaaaatgctttctggagaaatttaaacacagaaaagaatcacatatcagattgatgaaacggcagcagatttgacttgatttgtcagaagcagcaatgatcaggtagagtgccaacgcaattcagccccagaagaaagaaggctaatccttggagatagagatttatgtagaagctgttctttccatggaagacaaggttgtaggatgcacaaaagatgaggaacaccgataatccgatctcaggtagattcactctgcagcaaatgacaatgtcaggttaagcatgcatgcagaactccagcacctaccactaccagcttatctaaagattgcagtagcaaattggagaaataaattttacctgtttattaaccttttcctggatttttgaagcaatggagtctcattattctcgtcgaaggcattgttccccactttcttcgtcacaatccattggttgaattcttgcagttgcagcagaccagctacagcagctctcaaccgatgcatggacatgacgctctcgaataaaatccacagtggcactgtgtgcagatttctggagtgaaaagacagttatggcaaatcaaattcatccaaaagggtaaagcgatgaacaaactgtttgagaattgtaacaaagattgtaagagagaactgactctggatttcttatggcagtgacaatcaggagtgctgtaggaatgtaggcaacgccccagattggcaggaagagctctgggatcatgaccgacacagggatgataacattgtagagaataaaggcaacagcaggggcaacaactctcctcaccaggaagaagctatacagtatgtagatcttcttcaaggatgacactttctgacggagcaacagtggcaggttatgttttatgcagatttacttgttctggttcatcaaaaaaggagaagaaatggtaccttggcaaccaagacatcccatatcatctttcggaacaagtttgcaccgccacaagaccaccggaactgttgtcggcagtatgctttataagtggatggaagctcactctttacctgtgacgtatttgctttatcagatgctatcgtcgagtgattgaacagaacaaattaaggattcggtcttcttactctgaggtcccctaaatagatgaatttccatccctttaaggttgctcggacagccaagtccatgtcttcaactgtagttcgatccttccaacctcctgcgtcattgatagcttctgtgcgccatacaccagcggtccctaacaaggtaccagtgtttaggagactatcaccatgttccttttgtgatctacataaaacatgaacagtcgaggtgtgcaccattgaaactgaagaaagcaaatgtagccgatcctgcctcctgctcagctttgaagtggtaatcaaggaatgtcttctgtatccttgtcagtaggcttactctgtcattcactgtaaaattcggtcaactaaaaattggacagatcagaataaataaaattgctatatcagagttcaatgatgtgatattatctacagaaccatttgtttcgatctttgtcttttgtaacaccacaagaatcaagagctaacagaaggccacttcaaatgcaaaattttggtcaccttaccaatatatactgaatacttcccgctagcaagaactgcaaaaggtagtctcaatgacatatcaaaagatgaggtcttaccaaaaacccaccgagcttgtacaagcgcaacattctgattgtgcatgaggaacgggacagttctgagaaggaaatccggttctggctggaaatcagcatcaaatatggcaacatattcgcattgcttggcatagtcccactccattcccttcttcaaggctcctgctttgaaccctttgcggccacttctggtggcatacttaatgtttagacctttgcttgcccaatcctcacattccagctcaaccaaattctgcaaattaagtaaattcttgttcattttcattacattttcacaaggtagatgattaatttattgcccttctgtgttaacaaagtgctagggactgcaaatatatgcacactaaaatgacatgtacagatgtactaaggacgactagaggttgagttgggtaatttataacttttcagcttggataagaaaatatttacacatgccagtcaaaggtgacatcattcagttcaccagatgccaaatgctgagatatcccgaccgcaactgccttttatccaactacaactgcctttttacacaaaaagtaagccacaaaggtaattgatgtaaatagtagtttgtcaaataggatgtctcatgcaagtaaattactatttaagattaagtacttattgtctagacaaggatacttgaatcagctaatacttctttacatgaaactaaccatttatgacagtgatcatgttttttacagctacagggtatgtcgtcatccttttctttaaaaggtaatgatcaatgacgtgcatttcatttttcttagagaagggtttttttttttacctggcctctacatccaaccagatatatgcaaccttacaaattgagaacttagcccctcgaataacccaatctgaaattcgctcttatggagatttaaactcaggactttaggatgctacttaggtcactgtaaccactagactacatgctcttttactgtaatcacgtgcatttcatatggtccaggcacatgacttagctttcagtcctaggacctaagacagttaactacttaaggttaggttcctatgacgaaacttagttgcttttgctcctttttatactgatagtgatatatgaaagtgaaaagcaatgtcatccttatgtacaactaatccaactcattactcttcagtcttcacacaggaacaatgctaactcgttaagctaacatacagaaaaagtgataatctacactaattacagattttcagaggtctaagctcctgacgaaaaaaaaacccggagtttggacatctcaatcatatcattcagccagaaacttgcctaacaataagaaaaaggagagataccttgataaatgcgtccgtggaatcatccaaaacttggattatcaacctctcctttggccacttgagcccacaaactgctccgattgacaacttgtacacctacacccaagaatccaaaacatttgaattcggccgtatttgtgtctaatttgaatcttgttgaattgattggttattacctcgagctcattatacatgggtatctggaccatgaccatgggataagcagcagcagcagcctcccccttctcctcgtcgccggcgccggcgccgccgccgaggggctcccacttgaaccaccgctccggcctccagccgacgagcctggcggcgacgctgacggcggagttgtaggtggcctccaccaccagcatcaccgacatcaccatgcacgcccacaccccgacctgcagcgccggcgccaccgcgcgcgaccgcgcccccacccacgcctcgcgccaccacgcgccgccgccgctccccggcgacgtcgacgatccctcgccgacgactgggaacgtaccacgacaagagctcagctcactgaaagcaagaagctaattaacttggatgggaaaataaaaatggaaagaaaatcttggaacctgtgacgaggtaggtgaagtcgagggcgccggtggagacggcggcgaggagggagacggcggcggcgaggaggaagaggacggcgccggctgcctcgccggcctccattgtttctccgggcggtggcggctgccgtggcctctggagagagagaggagaggagagtgatgtacaacggaggctgagctgagctgagctgagcagttggatttttatcgctcagctctcggggggcacgtggacgggacagcgacacggcggggccattatattgggtctcaatgccaatattttgcgcttaatagtttagggatatttaccattttcgttaattgcttattaaatcaaaaaccgtcctaaaaaaacgagagaggatgataatagtgatatggtgatggactggtggattcatttgatttgttgcattctgggtaaggacaaggaaagattcatattcagcttaatttgtcaaaatgttgagaattaaagcactatagtttaaattatatctatgagtatattatacacttatgagtgtcctttcaaggattcaaatcgatttccataagattaaacacacaaaattgcgttcccaatagtttagtgcacaatatgttggagatggatttttatccctcgaggaaatatcctcttgttttgtgtctgttatttaaaaaatcatcaaaaatttgaaaataaattatgaagataaatcaatatatgaaatacctttccacaaacatacatgttaaaatttgaaatataagattcgaaacaaaaataataaatttgactgcggttacgcgttctattcatagtcaaatttgttattttgttttttcttgtataagttgaatttgaacgtgcatgtttgtgaagtgacatatcacatattgatctatcttactatttttttctattttttatgacttttaagttacataaaaaaaataaggggatattcccttaagaaatgaatagagtttccccaattgttactagttgtgagtagagcagggtcgcggctctaggctaaggccggttgtgggatcgcctaaggcacaaaccaaagggaacctcagccctcaaatcaaatcgatatcgtgccaaaaaaggcgtgcggacagccatgtttagaagggcaatttaatttgatgatctagggtgtcaagcgtgttgagtattttagatctttcagttgaggcattgagccattgaatatctcgggcatcatgtccgtcggtttgtcctcgatctggcggttgtgacacatgtgtagtttatgttacagttaaaaagaaaagccttacgagcctatagtgtcgaactatcaaatttacctaggccctcgaaattgtagagccgatccgatagtaaatgtgatggttaatataactgtgtgagtgtgggttggttatgtataatattttatccatgctttttttttagggaatccatgctcttttttttttggcattgcacaggtgcaaatatcataataaaaaggaaaataaatcagttcgggtggtatggtgatttggagagagagagcaatgtgctggaaagatggtgagtcaccagtcaaatgtcatatgtggctgtgtcatatgagattgaagcttgcccattgcatgatgagctaagaattaaaatttcctgcgagaaacatcctgagagagaacacctgtcacccggaaagattagtttagatcgcccccatttgcatagtactagtatatagtactatgagccaaaattagtaggtcacgatggaaaacgttacaatatttcagagaaacaacctaactaaagttttacttgtttctcttgccttcttctcagatcgatcaatctattatatctatttaccagagtgttgcacaccggctgaccgatttgctgtgtaattatctatggtactatgcgccacgtggataaattaaatgctgtcgaatttaagctgcaaatcctaacaagttagtggtggcagttgagctctcatccatgcctagaaaatccaggtgtacaactttagcggacagagatttgatagcaggggacgaaagaagaagaagaagaagaacaagttgcaatttgcatcatgcatgtaatcatcatacgtgtgcctgaattttgaacgagatgatgatcgagcttgaagaaccagcctaaaattaaatgaaacctatgcaggattaaccaaataatccaagtggcgagagctagctagcttagggcggaggtggagtggagtatgggagggccgatcgaggggctgcccacgaatccggtcaaacaaaattttgtagccatatcttacttattttcaccatatatacaccctctcaatacaaacttatacatccacatctgcttaaatttgatctaaagtaaattaagcaagtgttactctctatttcgttctagctccgcccttaaatttacagcgcgccaaatctaatggtccaacaataattaactaattaagctggctgatctcggccgtatcatatgtgtgttttgctgggtaaatcatcgatgcatgcgcgcgactgcatatatatgcagggatttggagaaaacaaaaaggaaatgtccagctcgatataaagtgtgcaatttaattgtcctgctctattctatcataaatatttgacaatcagaataaattttgataaatagtttctcaaatgcttagtgtaaaacacaaacaaaatagtatacctacatttgcattgaaaaataatattatatatcatgaacttattggattttataaacttatactgatatataaaattaatggtcaaaaatttgaaaaaaatggatcagacattgcttaaatatttataactgggtaaagtatctgttttcctataaagcgatgacatgtatgatatgtaccgtttcttccttggactcctcgatctattctactacttcacttacatataaatcatcttatcaatcaagttgaatgaaaatatgtcaagttcattttttttggctaaggttaaaatggctgaaatgcatctttataggtggaagtagcaactccttgcgctaggtgtatgtaaaaattgaggttttcctaggcgatcaacacaactgcaagtgaaaaataggatttttgcatgtggcacatcacgatgcttgcctgtaaaaagaatttttagccaaaaagaaaatttttgaaaccctagcttggtagcggtcgtcgttcccatgcccagggtcgttgtcaccgctgcccctaaggtcaccacaatctttagtcaccactcaccgctcctgaggcaggcagcattcgatccgcactcctaaggctaccgtagtcgttagtcgatcctcccatgcatggcggatccaccactcccaaggccagcggcggtaggtccgcactcccgaggccattgcggtcgtcgttgccactcccatgcctggtggcagtaaatctgctattgaggtcggcggcggtagatccgttctcttgaggccgttgcagtcatcattgctgctcccatgccgcccggtggcgacaaatccattctcctaaggcttctacagtcgtcgttgctgctcccatatgcccggtggcggcgacaaatccattctcctgaggctgctacagtcgtcattgctgctcccatatgcccggcgatggcggatccatgcgctaagtatggggagaagcgatggaagggagaggtcaccggtggatccgcttctcctgttgctaccgacggatccacatacctcgagtctaccgtcattgtcgtggtcccacttagccgatgtttcgcccctccccaccgtcgtcgtggtcaccctagcaaccatcacggcatcgccccttcccgcacgaggcaaatctgacgcctccaccaccactcatcccaccccttcgccgctatcggatccggttaccaaccgtcgaggagaggagataaagggaggagaggccgaaaggaggataggtgaagtaatagggaggatggaaaaggaattaacgcatgggaggagagaaaaggagagggagcgggactacgaaaataaaccatgtaggtaggttttttattgggccccctcctattttttctacattttacatactagtaagcatgcacgtgaaatccacgtgactaaatatttaataaattatcataactcaaagattgacaacaattgcatgtacaggttcagaagcaacaaatatcccctttactgatcaatacatatcctcaaatttgacaagcaaaatatgattgttaaagatcatattatgaaattcacatagcacatgccaaaatcaggagataatatagcaaatcttgagactttggatgctcaaacacagccaatgtaagatgcttgtttggttcagaaaattagactacaaacactaatgtgcagaatgacaggactaggccatcttgtaaacaactcttctaactcgaacacctcaacataattcaggaagaacacaagaaatagggcaaccaatttagattacaatgctccaatccaacaggattgagccgccgccgccatcgccaccaagttgcccgttctgagttttaattcagttcattacattgcttatgtctgaatctcacccactcactcgttctttcccctcacacacgccaattcacacagctttcaacagcacacttacatggcccaatcaggcccataattacgaggattcgccttggcctgtctagccggacgccgagtctgaattgggtccttcaggctggacggcctcccctgtagcccatccgatacgcctccttgttcagcagtatcatccccttctggtacatcatcagtgctcctggcacatctgcagtttggtaataagctcataaacatcccactacttgaactcacattatgttcatatcaatttgaaacatctttggggatacaataactgacgggtctgcactttaaagttctgaaagaaaacttgatccaagacagaagacatggagatatgtcagtgttaacctgttggtaagatctgtgtagggaagagacctgaaagatggaaaaagacctgaaaggaagtgaattgaagtggcctgtatacaattcgctggtgttttttgcagggataatgcttaccaggctgtgcaaaggcagacgatggtgcaggtccaatggaaggcatgagcgtgggtcagtcggcggcaggagcgcggttgccagcctaggaaaaggcaaggggtcagtcggcggcagcgttcaggcagggcaatggcgaggagaggcgacgccggcgggagcgcgcgcggttgccggtggagagaaggcgaggggtcagtcgatggcagcggtgttcaggcgaagtgatcgcgatggcgagataggctgggtgcaggcggagtgcggttaccggtcgaggtcaagggaaggcggaggcacggagggcaggcgtgttatcgatcgagaggtgaggcggaggcggagcacgtgggctaggggtcgtgggactgaaggaggattgcgtgtttccttcggaaaatccaagacttaatcccgtgcgttaattcgagtggatcggacggataggaaagacctgtggggggtagtccaagttgctccattgtagtatagacggttctttttaaccttgccaaaaaactgagggtgtatgaaaaatcatttctttacattgtgctaactctctactcatgccaacgtaaatcaaatacagcctctacagttcatgagccaacgttgttatcctcataaaaaaaactgataaatggggacaaattaatgctataatctgaaaatctccacaacgcataaattaaactctatcctgtttaggagtccatctgacaacaaaaccgccaccaaattcacaacctatgcatgcaatgctccaaaaatacatccaaacctatggggatgctctactagctaaattaattaattatgaatctcggctcttaattcgctatagctagcacacagatagctagagagatcacgaacataatcacatgccaacaaacccaagtgaaaaagatctcacgaacataaaaactgcattgccaacccagagatcgagagaattaatttgccccccggaatataatcgacacgggattttgtttccttactatagccgcatgcatatctcgacagtatccatggcggcgcccccccctgccgaatttgggatcccgttcgttcgttcgcaggagacaacaagaagttaatgacggaaatgcaagctcaccacacgcgtatctgatcattcatgtttgccgatcaatgccgagatcgatacagctcggttaattagtttccccatcgagcagatcgatcgctctccctcttcttttttaaccgcgcagtgaagtagccgatcgatcggttgacgatcgacgcgcgcgtgctcggcggcgtttggtttgtgtgatcgatcgatgtggcgatccatggagaacggcggcggcggaggtggaggtggagggatcgccgggaagaagaggaaggcggttggtggcggcggcggcggcggaggaggaggcgggtccggctacggcgagagggcggcggcggcggcggtgatgaggagggagccgcggcgagggctcggggtggcggagctggagaggatcagagtgcagctcgaggcggcgcagagcctcttcatgatcccgccgtcgctgctgccctcgtcgtcgtcgtcatcgtcgg

SEQ ID NO: 66608 - DNA, 14794 bp, Oryza sativa
  unsure (1)..(14794): unsure at all n locations
ttcacattcagtttcagcaaaacaatacacataaaaaggcaatattcagatattactgattcagtctcagcagaatgaacaaccagaaaatttgtacaggtcccaaaaatcgattcaatcacaagcaatactgaatagacaacataacaacaaagtttcatcgaatttggttgtgcatttcacaagcagtattgaataggcctgaacgacattgtttaatgaattttctcatgtaattcacaagaaatgttatattattctaaggtcaaaacacaataccaccaatattaatcgatggttcgttctcgggtggttcaattggagaagtttgtcattgtagatcttcattgttttctcgatggaagataccagcgaggatcatacccttcgcccactttccttttctcaccttgtcctttttctaccttcttggacttgtattcttccatggaactttcaacacgctggtagccatcacatatgaactgaaacatcatcatgatggcattcacgtggccatgtaataattccccttgtttgctgtttgccttgatgaaggttgcaccttcacatcatccttagagttcattgactccttagttgtggcttgatgtggtgaaaaatcctcatcatccacatcatccatggatgccatgccttactacaatacagaagaagtaggagatcaataggtgcaaactaaagtataataatttccaacacaaaagagatagattggagaacaataccaagatgacgagttgaagttccagcagtcctatgcagccgacaatcagtggtgagtattttttcttggttcatacttgttcacccactcatatataggctaaggaggataatgttacctttgttgctatcatgatatttatggaaagatatagcaatattgccttgtatgtcttgtgagttgacatgattgagcatgtaatacatggaaatattgccaaaatagcacctgacagagatttggatatgatttgctaacctttaaactggttcacccacatatatataggcaatcagtgatcaacaatttttggacacgaaatccatctcagaaacaaccataaaattatccaaataatatggtcaatggtaaccttgctcgaattcagaattcgccaaaatcaatagacttcaaagttcaaatgatcttcaacaatacaaattttgtgaacacaaaggataaaacaacagatattagtataacttatgccaatggataaaatctgcacatgataaataataagtgcctacatgcatatacaacaaactaatgatgtgactataccaagaaggaaaaaaaattatcaacggcagttgcacaactgcaaatggctagatcaggttttaactgaataaagttggcacaatcgctgatcgtcaatgtcaacctagatgaatctatatatgttgaaaattaaccgaaaacaatagctaaaaatgttatcctgcaataaaaggaaatggtgaagtgtatctattcagaacctttgacatgcacaggaaatgtcaaaattctgatagggctttgttgaagctcaaatagatccatacctacaagcattaatcagttataggatatacaatgggctcaactctgtttgtcgaggtactcaaaaggaaatagcaatgcttagaaatatcagtcaaaggtgcaatgcaaaaaatgatggtaaaaattgctcccagaaaataaaaaggatgaatggcaattgattggcagatacttaatcaaccaaatgtggaaataatcgtagtgcaaatcattcatgattaaaatacaacaaagtaagtaatacattatgagctagattattacatgatatagtgcaaatcattcatatttttagagaatggatcatatttcaatatgtttataaaaatctgtagaaatttcattgggagtaatatctcaatgttgtacacaaaataaaccactactagatagaacatggagatgctgcataaatgtttggcaaacttgtgttacagcaacatagcagcataaaatccatgtgcttctatgctgttacaccatcaaatttacaacacccaagatcactcatattaactttgatttttctttaataaagcaattctcagttgtaaagacggtaagcttagtaactggcaaagaaatgaattttgttttgagagagcctgttttaataactttttcatgcaagcattactgaagctgtgagggggagtatgcagtacctgattatgcagtccctcctcttttctgaattttgtgggggagattccttgccaagcgagcctatcaaggagcaaaagaaggaaaaaaattagcaagattaagagttggaaatgaccaacatctccgtaacgatcagcagactaattagatcagcatcaaaagcaaaacatttgatatagttcactccataaagaagtccactagggcgagaagatataatttgcagtagtttatcccttgatccggtttgatcactccgtaaaaaagaaaaatacctgtagcctttaaatgcgatgaaacaatgtaattttctggtgtcatagaattaataactgatatacttgaccaaacaagttccaattctgttatttcatctacatggtttagaaacaaacttaataaaactctcaaaaaaaagctactaatcactgataccaccaagctagtagctgaactactcaataaaacactctataatcgttaacaacctgttgacgcgaaaaacacacactggcctgggagatctgcttagctccagtgcaggtccaaagtttggtgagatgtgggcgtgccagtcagtttgatcctgcaactgacaagatatgcaaatagcagatcaatgagccgatcagttgacaagcccatggagtaattccagccgatgccgataccagccgatggcgatagggttttgagcaatcggctatatgtccaatgtatataatgatatgaaggcaatcagctgatgataatatagtatagcaatataatccaatagaaaccaatcggctagcaagtcccaatctctgatcaacaggcagcttcttctgcaccgaccgattttcctttccgggacgaaattggcttgaactaccgacgtggttttcgtcggcatcactgcatcacgggcaaccttccttcgagggtaacctcatcccttcgttttagtagaatctaaagaatttgtagtcccaatgaggatcgaaattgttgttgtctttgtaacactcctctttctgcctctcaagcttcccttgatatttgctgatgatcatagcggcattgggccgatagcttcttctattggctatcccctcgcttgtgtggaccatgttgacaggaaaaggattgccgtcgatctccatggatttctttgggtcgtcgaacttgattcttccctgctcaatggcggattggatctgctgcctgaagactgtgcactcattggtgttgtgagaccttgtgttatgccacttgcagtattttctcttccctagctctgtagcagatggaattacatgaccagcaggaaggtggatttgtttctcccgaagcaataaatcgaagatcctatcgtctttggtgatgtcgaaatcaattttttcctcctttccagagtccttgacccattggcacgtgaccactcatttgttccttgcccattcagctattgctacctcagggtcctcatcctcttcggtttcagagacatatgtgctaacattgttcacctttttatatgcctttctagcctcaagaaacctttgctcgtgtgccgtcaccttctgagctaggtgagctagactctcgaattcctgggctgagaacttctccttgattggcaccagtaggccttggaaagcgagatcggcaagctgggaatctgttaaagccaaactaaagcacctgttcctcatatctctgaatctctggatataatcttgaaccgatttgtcatgcttctgtttgattgacgttaaatcggacaacttcatctaatgaatcccgctataaaagtacttatggaactgctataaaagtacttatggaactgtttctccagatcggcccaactttgtacaaaattatatggcaatgatgaaaaccacgtgaaggccaatcttgacagagacagaggaaacaatctgacccttaaagcatcggtagctgatgactccctgcactggactaagaatcagctgacatgttcatatgttgtcacattgtcctgtcctgagaacttcgagaaatctgggaccttatacctgttcgataatggtactctctcaaaatattctgggtatggatgccgatacaagttctcactatccttaggcttgtgcccgaattgttccctcatcacattggctatcatatctgcccaaggcttctgctgaggtgctccctggatctactgcggcacctgatccagttggttgtattgaggcaggtactggggctgaggcgctcctcctagccgatactgtatctgaggtgagtggggctggtactgaaaattaaggttgccccttaggtgaggttgaggagtttggtgtacgatgtgttgatcagggttaaactaggtgccgatagttggctgttgttgtgggataggcgaaagttgtcccatggttatttgcggaatcgtctcaactatcggctgtcttggtctgaacatagatgcgacttgttctggagagatccgagggatgttatgccctgcatgttgcggttgtggcctgatcagaacgtaaggattgaatcctggctgcccttgtgccgatgttgatggaccttgcccccagggggcacaactgaagccatcggctgttctggggcggcactcgagatgggttgatgcctgtccatgctgacagttttgtagtttggaaaaaccctccaggcagaaaaactggacctttggcttgatgctcagctatcgtgccgtcaaccacatatttgatcatgttggtcaacatgttgacaagtactcctgattggttgaccaaagcatgatgaacggcataatcaacctggtcttgcatacatctgagcgcctcgagatcttcctcctgattgttgcccttggctttgtcgtctttgccagaacttgtttccgcgtcatcgttgttcgacagaactaccttatatttctggaccatggtgtcggaacgagtctgtgcgaatgaatgcaggaatcgttttgcaagtcatctctcatcttttcaaattctgccttctgctccagggtcagcttgtccattgttattgggatgacattttctggatcaacttctctctacttgaggcttgccatgaagaaaattttacgaaagtcggtcccaccgggcatgccaaaaagtgtgttgatgcggaaaacacacgtactggcctgagagatctgcttaactctagcgcaggtccaaaattgctttcgggttccgagcgcgctagttggtttgatcctgcaaccagcaagaaagaaaaaggaacaaagttaaatccatcaacgatagccgatcggctggattgccgataacgtattgttcggagccaagccgatgttacttgcatcagatcagcaagggaatataaggcatagaaattattagatctacccaatcggctgtagacgtcagcagtacgcaatctatccaatgaaagcacatttggatcaagtgattgggatagatcgggcgatatgccgagacagtataaatcacttaatatctaaatgtgcttcaaagtagggattatgtatgctcacagcatagccgattgagcaaacctaacgtgtatcgactattactccgataccactttatactacaatattagcacagatgaaatatacgaaacgtagaccaatctaacaagcaaggtgtcatgtcccaaaacgactctaaaatatatcctttaaattatgcctagaataattaaaatccgtgtgaaagcctccaacaattaaaatgtgcaaagttaaaagtcaaataaggcttaggggatttttgtatttttcctaaaagcctaaaaggtgtaaataaattttagtggaattttcagagcacaaataataattactaagaaataaacaaagttgaaaaagttttataaaaagaaaaaccttaaaagtcccccttccctcccttgggccgggccggcccatctctcctccccccctctctctctctcctctccccgcggcccactcagcctctccccgcgcgcgcgccgctgacgggcgggcccgcccgccaccctcgctgacgggtggggcccacccgtcatccccatcctcccgccgctccgcctgcgccaagcgccgccgccgccgccaaatccgccgcatcccgccgtccccgcgtgcaataaagtgggggaaatcactccccgtgatcccctctccctttccccccatttttccctctctctcttgtgttcaaacgggcggatttgcccccgcaaatctcggcagcgccattgatggcggccgacctcccgcgccggtttccttcccctccggccgctctctcccccttccaaccctatttaaaccctccccgcacctcctctgtccgtttccgcctctcgccgcccttcctcctcgccggaatcgagctcgcgccgtcgctctctctctcctctattgccaacgaccttcggccggccttctccgctcgccgggaccgtctcccgccccggcgtcgcctcctccggtttcgccgcaccgccgtcgaccccgtccacccccttgccgagttcgccgaccgccggaacgtcgtcgaccccgtcgacccgagccgcgccgccgccttcctccgctccggccgcctttttcgtcgtcgccgtcgacctagggtgagccgtggaccgccgcctcttttcccccttcccttcccctctctcggccgccgctccgccgtgcctatggccgccgtcggtgacaataggggcgcgggcaccgcctcccgccggccgcgccgagtggccgccttcgggcgggccgagtggctgccgcgtggggcccggtcatcagccgcccgcgccctcgggtgcggctgatgcgtgttacccacgacgccggccggtgtgagcccgggtgcacctggtccaccgtggaccgtgaggctgccgcatgggccccactcctgtggacccggtccgcgtgccccttcccctcggctgacgcaataaacccctttttaaattaaattttaaatgaagaaattcgcaaatattcatttaaagagcatataaactttaaatggccataacttggccatttgaactcggaattggaccgttcaagtctctaatttttccttaagaagtcaagaacccatttttgtgctttgttcctacttgttatatggagtttattagagtaaaaacccttttcatttctgttggtcgtatagacgctgcagcttcggaagatccgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcactgttttatttagccatgcctatttacctttgttatgaccttattattattgttattgttattattaccttgttcaccctagaataaacaaaaccccaactagtggacactctactcatggtaccactagtatgaatttaggtagatgcttcgctggttaattaggcaacattaggtggttttacaactctagactttgggaatattctcatcacctggacactatggaatggatggattattgggaattggattcacacctccccctctattcaaaaccctcaaaatggttttaggctgggctcggggtgcatggttttgatagtagcacctcggccataaaaggaccagtcttcgggcctctgttgcaaagcactaccgtacttccacatgtctagtggctaaggcttagtttgtggctcagtctggttataaacaaaagtacacggatggagatggacgaagtcgggggtcaatggacatctctagggcaaatgaaggctacacgagctgcggctcggtagtcgagatgtcatggcacagggccggtgtcctgctgctaggggctcggtcctgcctacctgtcccgaaggttccggccgtaggtggggttgggtcagtactcttgtctatggctaggatgggttggaaactatgtcacgtcttccgtccgtataccgtggtggtatgtggcacgtggttacacgtgagaaagatgtgtcttgtgggtaaagatgtacacctctgatcagagtataatctattcgaatagccgcgccctcagttatgggcaagccgagcaatgtacccaagttagtgttttaattcttaaaacctgcttaacaactaaaatgtggaatggatggcctgggttggcttgggacgagctgggacccagggtcgggttgccagttcggtctgaatcatcgtaggccttgggttaaggcaggttcgtgtgggttcacggcctttattaataatattgtatagttctagaatcgtgtttacaaaatagctttgagcaactaagtgtcttttaatgccgtttactgcaaaccctaaccctttatattataacccccttgtactcccttgcatttattctgcacttgtgggtgtgtcttgttgagtacggtggttgtactcagtcttgctcaatttttcccaaacccagaagaggagcccctggaagatgaaggctttggtgtctagctcatgcctgccgtcaagcgcctgtggtcgtcgccctagtcttccgctgtttcccgtttgtctttgtgtgtgctgggccttcgccgccctgtaataaattaactatttacgcttccgcttgttgaactctgaactgtatcaacttttggtgtaccttgcctcctaggacaaggaataatgcacgcacgtaaggaacgcccgttagattatttccggtcgtgacaagcccccagcgttagatcgtagtcgatttaacatcggggacactcgcgcaatatatattgtataaaaacatgctctaggtaaacataataaattatagatccgacaatgctgtatgatcttgaaaagtaggtacagtaaattgtatataaaatattgcgtacctttgtagatatatgccggatatatctacagaattagtagatcaatttaaaaaatcaatctactaaatacctgatcatgggtggctggacacgtactgactccatacatatgcatgtgtactgtgtacgtgtaaggagcaggcatatttgttgaattcgcgtcatcaggacgagtagtcagatttgtcaactagaaatttgattctagcgcaaactacagaactcctcgaatccgattaggatattagccactgaacagatcaatgtggtgcttgtatttcagctcctcgacgtgcttgttttgttgatggagatcgatgccgagtctggcttggacccggccagctgatgccgcccaccggttggcgtcctgcacgtcgatgggttagtgtcggatcagttttggattccgccaacactatggtcctctgccgctgcgacatcttgaagcttgattggtctcgccggatcgaatagttgatggcgatgattccaatctcgttgggagacgtactttggccaggttggatctccctgatccgaagtcgtcgagtagcttattgttggagaatccatctcttaaacccatctcgtctaaatcctgaagcaccaaaaaatccccctacctggcgcgccactgtcgacgtttgatgtcgcgattccggtatttgcatagtatggggatcgtcggtactaggacatacgcgagactgaggtaaaagagacagaggcgacgatttttatacaggttcgggcccctgaattgtcaggtaataaccctatatcctgttggccgaagccggtattgctcttattcaccataatcacacgagtacaatatttggggtagcctatctaactgttgtcgacatggcggtctgtatgtctgactcgtagtcgacaacagggtagtcttcctcctttagttcctgcccggcaagatcagagatagcacttttgtctctcctgacagtatccagagacagcgtaggggactagccgtgcttatccctgaagtcgatatccaacgtgttgtcttggcgtatgttggtttgtatgttgtggcttctgttgttccgtgtatgttgattatggtcggtgttgattgaggtggtcgtgtcccctctcctcctaaggggtcttgtatttatacccataagtgtccccttgtccaagtaaaactagggaaaccaatatggatacaatccgagtagtacttgtcgtttccatacagaactctggttgtctttccttatccataactcctcctatatccgcaggttgtttccgtataggacatggtatgtggtgggtcctgctaagatttagtcaactactattaggtatgtggtatccataaccctgacagtagcccccgacttcaatgcaaatgaacgagttcctattctccacagcagaccttggaggaactgttatcgagctcatgtgaccgttttcggtgagttcagagataacgttagatttcctttatcagcctcgtgcaggcacctaaagggtttgtctgagtcaatctccaacgtcaaccaagaaagtacagagcatacgactaagtctcccgtcttgctgtaatcgagaatttggattgaagtcatgaaattttatcttggcgggtacaccatctcttcattccgtattccttgttgagatccaccaaccattcttgagtgatcgagaaggcgcagagtctacgacggagccttgtcaacatttgtcgtactcgccttagtcgatcttggtgtagaaccacagagacatgaagtcttcgacaatgttgaatagaattttcctgaaatcaacactcagaaaagaacattagataaaaatatcccccgagcgagtgctcaaagggtaacgtgttatagaatatatgaaaaactgaaaatgaattaggtttacaaactaatgttttgtgtatgagcgtctactcttttaccgacttcgaccagtcagtttgttgagttatacactctccctagcccccagccttatcgtcggagaatcgttctcggatgataaggctcttggacctttgacctggcttagttgaacaagcactgatcctagcccccagctgtgaagttagaaaattcatttccgattacacggcttggttaatacgcacggcgagaactcttaaacgaccagatcttagatggtctttcgtctctaaaggatccgacaaagccttatccgctctgggcgtccccagccgaagttcccttaggttcctcagagactttgtcaagacggcgtaaagggacattaggttaggtttcaacgctaggtgtctttcgtggtaagggatctctgggtaaaacacttggcgatattgtgcacctgatatcaacattgttgaagtagaggtaatgggagaatcgctacacctctggtcaagaaccaggtagtagtcgtaactcaaccactagaagtgaatgtacgagagatcggtacgattgactggttgagaaccagtgagtaggtgtctctcgatcatttgaagttgtggtgcatggactgctgcgttattgctgtagccgtacctcgaccatctgaggttgcggtgcgagagattgctacgcactggttcgaggaccagcggacaagtagaattatctcttggacaccaatagaggttgcggtttgagagattgctacgcactagttcgaggaccagcgaacgtgtagaattatctctcaaacaccaatgaaggttgaggtgtgggagattgctacgtactggttcgagaaccagcgagcgagtagaatcatctctcgaacaccaatggaagtggcgggagattgctacgtactggttcgagaaccagcgagcaagtagaatcatctctcgaacaccaatggaagtttgcggtgcgggagattgctacgtactggttcgaggaccagtgagcgagtagaatcatctctcgaacaccaatggaagttgcggtgcgggagattgctacgtactggttcgagaaccagcgagcgagtagaatcatctctcgaacaccaatggaggttgcggtgcgggagattgctacgtactggttcgagaaccagcgagcgagtagaatcatctctcgaacaccaatggaagcactagagttggtttattacatgtgtatctcatgtggccagcatgactcacacacccaacttgtagcatatccggatgtccgttcgcaatcatgtcgggtgatcaagccgacaacgttcacgaggaattatccgttaacaacatttttctcaaatagtccagccacggccggcgctatgagataggtcgtcggtctttgttggtaggttgggcgcgacgactctgcatttgtcgagattgttctcaataatgcggtgtacttgatcacaacctacttgagtgctcaattattcctgaaaaatattttctagaagacaagatatatagcagataatatcaagtgtgtactcaaaaaactacatggattttctagcattatcaggatataacgagcatatataaatatcaggcattatgtaaaccgtaaacaagcatgatttatatggaagaaaatagagtgaaccctgtcacgtcccaaaacgactctaaaatatatccttaaaattatgcctagaataattaaaatctgtgtgcaagccttcaacaattaaaatgtgcaaagttaaaagtcaaataaggcttggaggatttttgtatatttcctaaaagcctaaaatgcataaataaattttagtggaattttcagagcacaaattataattgttaacaaataaacaaaagttaaatgattttataaaaagaaaaactgtagagagccccctatccctacctctccctattgggccggctcggaccatctctctccccctctctcctctcccccgcggaccatacggcctctccccgcgcgcgccgatgacgggcgggaccgtccgccaccctcgctgacgggtggggcccacccgtcatccccttcctaccgccgatcccgccgcctagcccgcgccctagcgccgccgccgtcgtgaatcccgccgcccccgtcctccccgcatgcaatcaatacgggggaattattccccgggatcccctccccctttccccccatttttccctctctctctccctcggattcatttggaaacccctcccctaacctcgacggcgccattaatggaggccgggtcttccgcgcccgttttcccctcctccggccggcccttttcactcccaaccttatattaaccctccccgaggctcccaccaccggtttcgccaatcaccgccctctctcaaccgccgaatcgagctcgcgccgtcgctccctttttccgccgtcgccgtcgagctccggtccgccgccgtcgtcgcccccgaccaccttccacctcggcgccggcttcttcggctttgccgcatcctggccgacctggtccccccctccgtttcgctcgtcgaccgccggagcaccgtcgaccccgtccacccgaaccgcgccgccggctttcttcggtccggtcgcggtttccgtcgtcgccgtcgacccggggtgagccgtggacccccgtttcgtttcccccttttccctcccctctatcgcccgccgttccgccgtgcctatggccgccgccggcgcccataggggcgcaggcgcgcttcctcccgccggccgcaccgacgtggccgcctccgggcgcgcctagcggctcccgcgtgggggcccggccgtcagccgcccgcgcctttaggtgcggctgacgcgtggggcccacggcgccgccggtgcgagcccgggtacgcccggtccaccgtggaccgtgaggctgccgcgtgggccccactcccgtggacccggtccgcgcgcccctcctctcggctgacgcaataaacctttttttttttaaattaaaatttaaatgaagaaattcgcaaatattcatttaaagagcatataaacttcaaatgaccataacttggccatttgaacacggaattggaccgttcaagtctctaatttttccttaagaagtcaagaacccatttttgtgctttgtttctgcttgttatatggagtttattagagtaaaagccttttctttttcgttggtcgtgtagacgctgcagcttcggaagatccgctcttcgtggaagttgaagtcgacgtttgggaaagcgagcaaggcaagtcacatcatccttgaacacattgaatcccagtttataaaattatattgatttaaattattgcattatcgctttatttaaattccggcgttatcactgttttgataaaccatgcctattagcctttgtataaccttataattgtaattgtaaaaaaaaacttgttcnccttaggtttttcgggcccccggctagtgggcgctctactcatggtnccagggtcccgagctcgnttncgcccttggtgagccgagatgcattcaacccaggngnggggggtgggagagagaatagaaaaataatacgtaacagcanagattaaaaaaatgattantagtacgaaaagaatatttaacagaaataaaaaaaattagaatgagagggt

SEQ ID NO: 66609 - DNA, 3405 bp, Oryza sativa
  unsure (1)..(3405): unsure at all n locations
accccaacaaccataaaggcagaaagggccctccttcccacacggataagaggacggtggtatattctttttttaagccggaaacctagtgaccccatcggttccaaaaatccctttctagggaataccctgacaagttaagggtttagatatattggaaaaatatttgccaggtcactaaaaaaattggtttctccttccggatgaagaaggtatatgtatggacccaaagtccctttgtaataaatcaaaggggatttgtggggcaccatataaaacaatgtgnccaagtacatgactcacttgattcttaatggaccatgaaagcaaanctacacttccaaagcancggataaggattgaaagaaaatcagtgccattgcatctataaatagacaagcgcaatgaaaaccctccccatcgttcacacagttcaagcattatacagcaaaaaaagaaagatctagtgtcccgtagcaatgaagatcattttcgtctttgctcttcttgctattgctgcatgcagcgcctctgcgcagtttgatgttttaggtcaaagttataggcaatatcagctgcagtcgcctctcctactacagcaacatgtgcttagcccatataatgagttcgtaaggcagcagtatggcatagcggcaagccccttattgcaatcagctgcatttcaactgagaaacaaccaagtctggcaacagctcaggctggtggcgcaacagtctcactatcaggatattaacattgttcaggccatagcgcagcagctacaactccagcagtttgatgatctctactttgatcggaatctggctcaagctcaagctcaagctctgttggctttgaacttgccatctagatatggtatctaccctaggtactatagtgcacctagtagcattaccacccttggcggtgtattgtactgagttttaacaatatagtggttcggaagttaaaaataagctcatatatcatcatatatttcacctgagaaactcggggtgatatatcctcgtacatcgtcataactaattaccatcattggtactctacaatattactatgtgcttacattcgatccaaagctactttgtctttaagatataaatggagcgtataaaggatgtccatcctttaattctagtaagaacaaacacgaagcacatatgtcaaatactaaatccactacaacaaaattatagaccatacaaagcacgtaaagatgtagcaatccacattgattcttcatccactactaaaataagcgcatgtgaaaggccgcatatgcatgatcattgtgaatatgacatgcccttatcgagcaaacgtgtcacttcatgcaaatatgttgtttgtttcaagcgacatcaagatatgatttcaaagttttaaacattggtatattaatgactttcatatctgcatattaatttcaattgaaagccatcttgttgcccatccttcctgacaagatgtagtgtacaaggcactctttagttgaggctcgctcactttgtattacagaagtataacctagacgtaactaattcagtataaaagcaaaaagtgcatcagcaacgatgagggtggaaactagaaagaaggatttatgatgttccttagtttattcagtcacgaaagaatgactttaaaaaaatgtacacttctttcaaagtgaaaatgatgagatgtcttacttatgtaatgctcctacacgctgaggttgttcttgctgacaccctcgtttctatgagaagtttattctaacatagtaagttgatatttacagcaaacaaaatggataataatcctgatgtttcaacaaaactagaggaactcactgttaacgaccaaatttggtaaagccatgggctgggttcaaagctagagtcgaagccggatttggaggaattctttttaagaaagccagagtgtgtatcggctacgggcggcatcagctgccgtacgtatcggctacaagcggaatcggctgtcgtatgtatcggctaacgccaaatccaatgaagacaagccgatgtagccagtcttgaaaagacaggtccacaactatcatcgggatcaatcgaagtgcttcatagccattgccacacaagaatcggtccagcaaagggcaattgtatctattaattaggtttagtttccttaagagatattttggtaagagtccgcctaagggacttgttcgtattttacattgtaataaagatagagtcatgtccaacaaggagatgttatgtactttgggtataaatatgacccgagaccttataatcaggggacgacagctcaataatacttcggcgcatcgccaccctttttctctttcattgtttcgacgagtttttgctttcgagttgggctgcatcaggttcgatctccgacgaagaggtaaagcttgttatagcggattgcgttctcaggattagtgcttacatctttatgacactctaatcctatctatgtgaatcaccgagttatcatatatgctgcataatctagattgatctcgtcatctaatctcatcggctagcctctatcatcgaaaacggccgacagatttagatatcaacattaagctagattatgcggtatatctaccatatcaaatgagtcttcatcgttcttgcttagatcttatgtttcttttcacacttaatgctgcattggttaggttcgatctactaagtactgtcttgaaacattttatctagctctttctatgaatgctaatagagttagtatcggagtttcagccgatcttacctgatttagccatcgtgtttccactacttgggtcttgatcgtctaaatttgccctttatattaaaatatcatctatttgaagtgtattaagctctctatcaatctactagttcaccttatgtcacgaccggaactaacccaacgggcgttccttacgtgcgtgtattattccttgtcccaggaggcaaggtacaccaaaagttgatacatttcagagtttatcaagaggaagcgtaaataattaatttattacatgggcggcgaaggcccagcacacacaaagacaaacgggaaacagcggaagactagggcgactaccacaggtgcttgacggcaggcacgagctagacaccaaaaccttcatcttctaggaactcctcttctgggtttgggaaaaattgagcaagactgagtacaaccaccgtactcagcaagacatacccacaagtgcagaataaatgcaagggagtacaagggagccataatatagggggttagggattgcagtaaaacaacattaaaagtcacttaagtgctccaaccctactttgtaacacaagtctagagctatacatattattaatcaaggccgtgaacccacacgaa

SEQ ID NO: 66610 - DNA, 2097 bp, Oryza sativa
cactgcgattagaggatctcatcgttatcatggactgctacactactatttactagatcaacgacatggttatcttatcaacatccccccctttgggttcccaaaaagtttcctttctttttccaaaaccaaataaggcccctaactctctgctgtcgttgatgggcaacttcgtcatcatagccggctatctctgttgccgctaatcatcattaccgtcggatgcgtttgccattgccgactattttcttcatcttcataattggtggatttcgccatcaccgttgatgcgcgtctacgtcttcatcgttgggtttgcttttgtcaccaccgactgttctttcgttgttgttgggcgcctacatcttcactgctagctgacctgactgttgccgactggtttcttcacctccatggttatgcaacttcattacatttgattggtggcatctttactaccactgacatcttccgttacttctgatgagcaatttcgtcttcatgttggtcatttcatctccatgccgactgcgtcagttattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaatggtgtcgaaggcatattttttggcctaggcctaatatgtctgcagcccatattttcaggtgtggcctgtcacgttcttttagggacttaggcacttttcgcttaggccaaagtgcgcgtaatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtgggaccatgtgtcttctagggacttaagcacatctgttaaagcagtgtgcgcatggcgtatgcccaatactttggaaatttctttattcacaacatacaagcttctttatagctattttgctatgtgaattttcaatgatgtagtcagctttaggttgcacgcatcatattttacaaagcagtcggtatatcactcggatcatgttattcagggattcacaccgcatatgctatatattaatattaagtcacttgtttgactacgattatcaaaaccactcagttggtgcatctattaggtacatctactcgatgcacctgactttatttttcagccctccacagtcttcatatttggtaaaagtactcgggagatcatggcgaggatgattgaagcactcggctttggagtaatctagttcgagagaagattatctttccgactgtgaaggtctcaggggctactgtggagattatgggtaccccatacccacacggcatggttatccgactagtcataggggatagcttatatctatggaatatgtaaccgatcatgacttgggtattacgtttccttttatattatgaagccgcctaaagtcctgatttgataatattgtaaaatagatttaggaaaccgataccgtatgggttaaggtttctatcttgtaatcctgccccccatcctatataaggtgggcaggaggccctctagggggcatgagacaacctgatcgtcagatcaatca

SEQ ID NO: 66611 - DNA, 8812 bp, Oryza sativa
  unsure (1)..(8812): unsure at all n locations
gcgggccagacggcggtgggnccgcgcgcgcgggggccatctccccgtcgcttttgccgtaaaatccaccgtcccgtccccgtcccgcagagctgggccaccggtcgactactcatacatgtcgctgtgtcgactgctcgtttgctacttacgccgagcggcgcgtgcccccgccatgtgacggttttggagcatgtactgtacaaactagtagcacaagccagcggcagtggagttctcccgtggccagacagcgcgcaccgcagagtattacaagtggcgcgctagatgctgcatgctgtctgctgctcggccgtttcctccttcctgcaacgatcgatccagatccggtccacgggtagcaccgtgcggtgtctcgctgcttgttctggggcttgcacaccaacgttacaccgcacttgtacctttgggttacgtggcaattaattatctgtcattcgttgtctatgatatatgggtccagtggtaaataatttaattattctttgggttaattattctttgagttcggggtatctcacagcttgtagcttctggggcttgcacatgcgcttggtttctttcttttttcgtcgatttgtaatatacgtttgttgagcctatagatgttctgggatattgtttgatttcgtcgattttactgcaccgattggttttccactcaaactggtttgccatctttgttctcacgttttcatcggtttccaaatttctgctcaaacaggttttcattggaaacagatcaaaattctgttgcttttttgctcaaaaccggatgttgggattcttttttctttttttttggacgaggattaggattcaaatttcgatttgggaatatttattggttcaagaatttcattattttgctgatgcacgtatccttcaaatggtactgatgtacgttcactttatcaggaaattggaatggatgagaaaggcggaactaggctctgttctgcttttattatctccatcagcaacaattcaagaagataattaacggtaatcttcctaaacaactaaaggaaggcctccacagggaattgaatctgtggttagcgtcatctcgctagaagagaaggacgaggtaaaaaaaacacataacatcaacatttaaattactaggatactgaactgtattataaagtactgatgtataaatcatttaacctccattgtgtcatagaaatatcggcaagatcaaaaattggtgacaaaaccttgctacgctacagaaacctgagcttgtgaaaatagccgaacaaatataacgatgctctctctctctaaaaaaaatgatgctgtatgcaaaaatagttgtttccgaaggtatgcaaaaattgtattatccaagtctaatagagcttcagttggcaaaatgcagggcggtgaacaacaccatcctagttcaatttataggctgcttgagtcccttccatagatgaaccgcctgccccaatcagatactaccagcatcctggtgcgccagctgaattgcttactgcattccataagagcaaaacgccattaaaaactctacacgacacgtccatacatgcgagggaagatgaagtgcagaaaggaagacaagcatgttcagtagggtggcattattaatacctggcatagacagaataccatagccattgggtgctgtgaccaacatgtatccaatcacccggcaattgagcggctgtttgctctccacccagtggagcaaactggccaaggtgcctgtacctgtaaatcataaagggcgaccattagggactgctgtattctggatgccatgcaaaagaaatctcgtgtatcagcaatatgtgacaagattggtaggcttttgtttggtttgctccaccaactttggtttggcaatgccaattgtttttagctaccaaccagttagatgactaatttattggtgttgtcgatttcttggcatagttgattggagtcataaacaaaaaaagttcatccgtaaatccatatcaacatggtcagcagtgtttaagtgcctaatgtatgtatgctaagagagcaagggaaaacaaacctgaaaggtttgaaccgatgacgccctgtgcctctgatcctcaacggaccttcagggttctcttcacagtatttcatcttgttgaagcagtttgccagataggctccctcttgtgaagcaacctgaagtgccaaacgaaaattcagaatacatgaaacggtttgtagatattcaaggacacatcaatttgacatataaaatgccaaacaaaaatttactccctccattcaaaagtctaagccactttttttgtcactaagatcaagaaattacctcatccaccatgtgacaaaaccacaaaaatttactccctccattcagaagtctaaggcactttttttgtcactaagatcaagaaattacctcatccaccatatgtgacaaaaccaaggaactatatacatccatacaaccaattagtaagatggttctttgtgtttgggtcaacaatttaatttggcacataaagactacaaatatacccaatctcatttggaaaacatataatggtttgtagatatttaaggacacatcaatttgacatatattgcaacagatttctttccctatgtgcaaagtgcaaactctctaatggtagacatgaataattacctgagctgttgctgggagcatcttaacttgcgagtccactcgagcaagggctttcttgaattcctctatgttcagctcttttgactccttaatagcattcccgtctgaatctttgagtaggtcatggaagtccttcatttggttagttttaaggtacaactcaacctgtgggtacctttcatagatgtcgccaagaacatttttaattttcttgacagtcaaagagccagaattgtccttgtctgctacccggaaaattgaagcaatatcttcctgaatatacatatcaacacaatccattaagaatgtcagaaattcataaacaaaagtagttgacaatacatgaaatttgtttgctaaacaattactagcatttatgttaagatggcattaacactacaacaggtagatgctagatcatgtcaatcttgcctttctcacaaaaagaatttgaagtaggaactgaaaacatcctccaaaaattttgaagttggttcagaaaggaacaccacggtgtaaatctttataactataatagtgatatgtttgagatggctaaacagcttcacacaaagttgcagtctttaaaccataataatttcagcatttgtaattttttatatttaatcatatgaacttattatcaaaacaaagacttagatataattaactggcaacttaacactgaaaagggctaattgctgtacataggccactatttgaaattcaattatgctagcttagtattctagagagcaggcgatgaaacatgttaaattataattataccataacatatcgagatgttcttgccaatgacaaaatatggtgcattctttacttgaacaaaaaatatggtatctttgcattgagaagtacacacataccataacttttctttgagttattgtcgcgcaatcaccgagagcatatacatcatcacatccatgaaccctgagccattcatcagtagctagcactcgtcggtttgcctataaattaaataagtgttttaaaaacataatttagtgtaatatgttgaaatgtattctcttatgagttctgtacgagatatacctgaccaacttgcttcatgaaatccattatgaggggacgggttccaataccagtggaccaaacagccatgccataaggcacagcaatctctccagttgcagaattagtcatagtgatagccttatcagacaccttcacaaccttaaaattcgtcttcaaatctatgcctgtcctcttgaatttatcttcagcaaattgggtaattctcttgtcaaacctgcatatatagaacattaaaacttttttttgcaaagaatatcataaaactgcatcaagaaacagaattttctgaaatttgaaggcctcctacatatgtaattatcaactaaaatgcttctgatcggtaaaactaaaagggtgaaggttcaaaattactaacataaaactaaaaatgtgaatattttgcaatggttcaacaagtacaacagatctcaaggtcttacattgtaaggatatgatctccagcttcaattactgaaatattcgcatacttcttcacatcaggatacaactttgccaagtcctcattgacaaagtcatgaagctctgcagcaaattctacacctgttgggccaccaccaataacaacaaaatgaagattcttcttcctctcttcctcagttaggtttggaagggacgctctttcgaaacatttcaggacactcttcctaattttttgagcatcttctacttcctgacagaatgcacatgacgattcaattcaccatgcaaaatatgttgcaaaattgaacaacataatggatataacatactaaagaaaaagaagttatgacgaaagatggaacaaggatattctttgtttgacaaagaacaagtatatgtaaagatgtaaaagcaagtttgctgaaggtaattcagacattgaccaagagataagctgaaagagtcgtaactgataagatgataaaataaaaccgagttttgttacaacagttaatttctttcattaacctactgccttattagtactgacctttagaaaatggcagttttcaacaacaccaggggtattgaatgtattaggtctagctccaacactgacgaccaggtaatcataatctacaacaaattcactatttccatctgagtctgatctgcagtggatctttttgttagttggatcaatcttgtagcactctgcttcccaaaatctaaatgcgccgcctctctggaaataatgtacatgtaatatttgtgagaattcttgcattacaaaatgatgcaatatatcaataatatagctaattgattattaattcagtaaggtcttacctttctcacaatattacggataggctctacaatactacgtgcttcaactgtgccacatgtcacactaggcaacaaaggtgtgaaggtaaaatagttgcgaggtgatacgacatgaacatcgtacaaggaagtgtcaatatttctcaagaaacttgcgcctgcccaaccagttccaacgataaccaccctcttcttgccagttccatcatttatttgaagtacttgattatcctggcaagcataagtcaaagaaccaacactgcaaagatatttgaataaaaggtgtgtgagaggagagactcagagtcctgaaatatatacaatataaaatattatgaaaactaatattaagagtgcatttgccatctcagtgagttttaagttgcatttactagtttttgatttgccaatgaataccaactaatgaacttatcagagccataacagaacatgtaaataaaaatttcttccagctataatgaatagcacacctctgctgctagtcttcttcactttcaaaacagaaagaaccacaagagaagtattcactaaaattgcttgagacgcttacaagattttgctacatggcccaaaaacagaaatctggcaatacaaatgttatttcacttttgtgatcaaacaatatcatgaacagtatctgctgtgcacaattccaatatgatcccgggttacaataagaaatatgaaggacaaaccatcaccatgaatctatctgggacaaacatgtctagcatcatggattaatagctatagcacattctcttaagcaaaagggtgagaatacaatctgcttaaatgcccactcctctgtcccacaaaaccccaatatatctgaagatgtaccaggacaacgtgcgtgtctaaatacatcttcaggattggactttttattggacgaatatattattatttattatttatgacgttaaataaacaagtaggacatgttttggacttttggtgacacaatacatactcgtctccctagaatcgtgaggcggtgatttcaatattacaatgtcaatgaacaagaataatacaatccgatttagacgattggccaagtaggcaccatggttccagcacacttcaaataatttgttgtttcactttcacatcacaatcacattctttttcaagtgtcaagatgacatagataatattttttagatttcaccataaccaattatgaatataaacgtgaaccagatttgttagatctatgagtaattttaccaataaatgatcgaacttctgaacaactttttcacccaaatcttaataaacaacgtagtgcggtgtttaagtgttgggctaggtgtaaagtaagcgtcgggctacggacttcaggggcaaaagaaaagttgcaggttgacagatcaccaccgacttaattcttaaaccgaaaaaaaaaatccattgaaaagaacatccccgattaaactaatctcatgttttggaggaaaggctttaactactctcatgtttatacagccgccttgatagaactagcgcaaaatcgcgacgaaaacatttacacggtgtatcaaagttcggcaatcaaaccaaagcgcggacgcgcgcacgtacggcggcccaacgcaccatatccagcgcaaggacacggttgcgcacgcgtataactagatcgatcaacgggggtgaggtgtatatcaggggcgcgcggagcatgagggggagaggcggaaacgtacccggcggtgaggacgaggagcctcttctgccaccgcggcgtgcggcgcgcggcctcgacggcgcggcgcaccaagctcaatccccccgacgccgacattgcgatccggccacggcccctactacgggtggtgtgggacggagcagggaggaggaggaggaggagacgaggcgaggcgcggaggcggcggcggagaaggagcggtttgctcgcttgcgaacacgcggcggcggacgagggcgacgtgcctcctggcctcccggagaaaagcctaattataaacaaaaccacaggagaggagagagagaattttgtctgcgtgggccgtggagcttttccactttaacccctcataggttgaccgatttgcttttaaaccccggagatttgactctggaatgttgggtagggatacgattaacaattaaatgttttacagggggagatcagcaagacagacaaatgacagtttcgtactgcgtaataactgcgtttcatttccttccttgttcagtcgcggcgaacgcgttcacaccttggacacgatcgagcggtgcaccttgtccgaggctgtccacgtggacggcgcgatgttcgcgagacgggtcttttggcttgtgagacaagaaagaaagcgagatctttttttggtcgtacctgaaggttggggttgaggagatgggaggggagtggggccagctttgctgcggcggcggcccagctgtaccagcactactgtggctgcgttcttttcagggtagtcctcctcgttttccgttagcacgcttttcaaactactaaacggtgcatttttctgtaaaaagtttctatacgaaagttacttaaaaaaatcatattagtccatttttttaaaaaagaatagcagatacttaattaatcatgtgctaatggatcgctccgttttccgtaatcactgttgagaagaagaaagaacgcagcctgtgtaacaatggcgctatagggtttttttatgttgttttggaaacgtgtgatgcttttcttttcaagcacgattacccagttttttttttttgagaattgattacccagttttttatggcaacgtttcattggagattataataatgggtaccttaaataaatcagaattgctatatttcttgtgacaaaaattcttgtgaaagaatctgtcagataatgtacccttatatttgctcttatacgctatctttctttcgacatattttcttggaaaaatccgtcagattttgctcttacatttgtgcaagtggcatgctatatttatttcgatataaattctaggaaaaacatttttgttagattttctatcaaaatgttgtatagctctctgtaaataaatttgttgaaagacgtgcgactttcggtatataaaagtgcaacttcagtactagtaatatgcccgtgctaaacgctacggtgcaattctatatgtctttaattattttttaaaatttcatgttaccaaaataatatttttatatgatttgtgcatttaaactttaattaaattcatatcgtgtataaaatatattttatataaagtgcaatattatgatattacgtgggcacaataaaactttgcaagacttaattatatataagcaattaagtatacaatataaaaggaaaatatacgcatgaaaatatgttaaagaagtatagagtcattctattatttgttattttgttaagaaatgcacctatgggagggactgagaagaaaaagaaaataattctataatttttttcttatcttttaagatcactattggtagatagtattttttttatacgtctatattgtatttagagacgtgtagttatataaattatcgtgcacctatattttttttatggaaggaactgtcgttttttatttcactatgacacacataacatttcacaacggttttgatataaaatatttattcatctcatgcgcatcttttttctttgtgagtgacataataccactggtggagaaaccgtctttg

SEQ ID NO: 66612 - DNA, 73539 bp, Oryza sativa
  unsure (1)..(73539): unsure at all n locations
tatcatgcttaaaaaaaatttgatgataaatcaagtcgcaataaaataaattataattacataatttttttaataagacgaaaggtcaaacgtttgtcaaaaagttaacggcgtcatacattaaaatacggagggaatattaaaatacggaggaatcattaggttggttttttataggacggatggagtagtctacactgtaaagtagtactagtaccatatgcctctggctgccggatgtactgcagcaacgcggtgtacgtgtcgaagaaggcgtagctcatgcccgggtgcatcgcgctcatgtcgcggaggagcatggtgacggcgttgttgtaccgagctgataggtaattggcctccgcgtggcattccttggtggggctctgctcccgcagcatcaggcaacaccccagtggcgccgcgcccacaaataaaagccttcgcgtcccgaggtcatacatcctctgaaatttatggcacatcacatatttaaaggtcagtatcaaaaacttatttaaaggttgaactgacccaaaaacttactaaaaataaactatttgatcagccatgagagctataatgtctgagcaccgagatcttatgcgatacgatgccatcggacttttggtactgagtgaatggtatatttttagaattagtttttagcacggtttcttattcaaacaagttctctaaaatggttagtttgtcaaaatttctggtttgttcgatatacattcagctggacggattgtatatttgtcatttgtgtgtacatgcatacctgcagctggcgtttcagggagttggccagtgagctgatgaattggtcttgggtgcccacgagctggctcagcaggacgcgattgattatatcgttgccgccgatggcgacgctgaagagcgattcggcaaggtgggtcgaggcctgacgcgggccgagctgctccaccagtgttgcatgaacagtggagtagtgctgatctatctgctcgtcgaagctgatgcactgaccctgcatgcatggcgcaaaagtatacaaaattaattactacttgcgcgtaatcatggaccagagtactacgtattcgaaagacattaatctcgatcgtacagtttcaagttctagctaatattaccatgtttgtgagattagacacccctgatcctcctgaagaaaagttgacacccctcaggtataccgaggtgttgcttatagagaggtatggaggagggctggccaccccgagactgtcagctgcaattaatggaacaacaagagaagtatttgccgtgaaaaaaatattttcccttaaggccatcttcggttaatcccaaagagaaagagatcagcggaaatttattacatatttattgtggtgtgaaattattccccctcaaacccctccaatccccttcaaccctctccaacccgaacgagccttaagacaatggtcacatgtatatacatagccaatacaatagcctctaattttaattcccaagagtgcgcagtgtacgcgttgatgaaatactcaccaaggtagtcgacgaagttgtagccgttgctgaacctgccggtgggcttgccccccgggtagtcgacgccgttgtgagggtagttggccttgtacatcggcagcgtcgctggcaggtagttgttgttcccgacgtccgcctgcgagtcgccaagtacgtacaccgccggggcagcgccgcgtgcgcgcgtcgggcagcaagccaaagccacaaggaggagggcgacgacacagacgcctgcacaggccgatgtcgacggtgtgcaccggcgccagaaacccattgttccttcacagcgtacagtgtgacgtgtgtattaaagcctcctagctactctctccgtcctaaaatataacaacttttagcccttagaatttatcttaaaatataactacttctccacaaatatttctcttcctaaccaatcacaactattcaccattcatttttcccacctgtctccactacccatccaatcacgacccttcaccacttatttctaccctacttttttaataatcgtgtccaactctaaaacctcttatattctgagacggagtgagtagtgtatataggctgtgtttagttggatccaaagtttggattttggttaaaattgaagataatgtgactgaaaagttgtgtatatatgacaggttgatgtgatggaaaaggactgaagtttggatgcaaactttagatctaaacacaaccataggatcggaggacgccaaagctagctacatttatagcctattgttgtgcacacaaagacggcagcggctgtccaaagctatgccaactttaggattggacgagagggactagtcaaccctagtcaccgtacagtactactctctctgtttcgaaatatttgacgccgttgacttttgaaaacatgtttgaccgttcgtcttattcaaaaaatttaagtaattattaattcttttcctatcatttgattcattgttaaatatatttttatgtaggcatataattttacatctttcacaaaagtttttgaataagacgaacggtcaaacatgtgctaaaaagtcaacagtgtcaaacatttcgaaacggagggagtatatatataattgagtaaatttcatgaaacaaaatatattttgagaaattccgtacagatttaacaccaaattacatattgaacatgttattggttggggctctagccccagctctctggttggcaggaatctaatcccatatatctgttgcgtagtgagttcatagtgccagcaaaatttgcacagcaaccagcatacggccaagcagtgatggctagttggctggagacgttcagggtgaaagaaatgatgtgcatgaaaaaacattaggctgtttattactagctggatcatttgtgaattgtgatcattaattatattgtagattatttttactcttgtgttctagctagtagctgttgcagtgtgcagctcatggcctttatacatggaaaagactataggtactaactttttcttactaaattctaacactgaagtgtcatgctacgagttcatctagatttttcataacttccatctacctaaatcaaacggttgagatgattattagtaaagatttagtaagaaaaaactagtatgtgtagcagtgctcttatacctattaatttcaatctttttcagttcacttcagtctttaatcctctttttttccctatccgcgtaggattttgaaaaagtatattataattattatgtattatgactttaatataaagccccaataatattttcatcacgttgtacattcgccactgcacattctgatggtacattgaactacgtttgtacctgaagaaggtgcaagtgcacatcatattatgtctgcacgactgcactagactatttgccgaactaatgtggaaatacctgcgccagcagtagctgtgaatctgtgatatgatcctttctttttattatcacgtttttgaaaataaataaataaaataaaataaggtcaatagcttaggacacttcgtcagtgcccggtttttaagggccactgactttccgactatgatgatcgttggtgccgattgcactgattttctagcactgagtggtttcaattattaatacgaactagaaatgcacggacaccttgtttaattttgctttaatttttattgtgaatgcttatgttagaataatattgttgaaatattccctgacttcattttaaacatgttttgcttaataactgatttggacattggttatgatttttttctaattaccttgaaacgtataaactctatactaaaagtaaaattacttgaaaccatataaccttaaattgatgagaaaaattgtgtcggttcatatctatttgtattatgtatgattattttttggaacatttagcacaggggcggacccagggggtgtgccgggtatgcaccggcacacccaaaaaaacgaaaaacttatagtatatagcatgtattagtttggggcaaaagttgatgagtatgaacgcatgagccagcccatcatagatgcctgtgtgatgtgttgtgcgctttgcatcgtgcaagttccccgcttcacctcgcattcgcgtatccacttggcatcgtgtgaaaggtagctagggtcagggcatcaggcgttgttccacattcagcgagcggcggcggtgacaccgaagagcacgacagtcaacaggccagagcaccgatattggctggacggcgagtgtggagcgtcgacggtggagacgagagccgcagccactagcatttagagacatggcgaagcaatgtcgatgcgagcccggtgagtctgtgagcaacgcaaggaatgcagctagcagcaaccacattgaccaaggcaagcaagcaggtccagcttcgcatcatctatctaaaacttcagatacagatatactctttgggacttttagtctctcactatttttagtttctttgtctccctgaattttcttttaaaggagagctagagattggttgaaaaattgaaaattctgaaatcagttaatacgaagaggaacaagggcattgtcttcttttagcaaggcatcagaaaattcagattatgctttgtctaggccatgtacagggctctacattttggtgtataaaatgctcggtttgcctatatttttgtgtatatgctctagaccaatgtgtagggcttgtatttgtgggcacacccagggtataaatcctgggtccgccactgatttagcatatcggtttccaaaattttactaacattttttcttgtgtgctataaatgactttatggatttacgaggaagcaccggcaccatcgtctttgctgaccgtgctgtggcctccacagattcaccctcctgaagttcgagatggtgttgctccattcttcgctcctccagatttttttttgtcttcctcacatatctttaattttgacatggaattttgctggtggagcagaggatatgccatacatctctgtttgtttgcatgcattcatatatggtagatagacatctaccagtaaaaaatcatttgtcggtaattaaaaacttttcctgactactggatcattggcaaacactggtggtagactaagtgtcgacaaattgtttgacgctaagagcaggtacaatagcaggctataagccagctgcaaatatattttaaggagataaatgagaagagagaaaagcagtgggctacagatttgtagccagctgtagcacactccaagacgcagtgtgtgtatgacaggtgggtctatgtattaatagtgtagtatataactattgtatgaatgagctattagattagctatagatgaattggagctagtagttggctatattattaaacttgctctaatggccatttataccgacagtctaagtgcttccatatgtaggtcatggtgtagcgtgctctcgtgttccattatcttctcgcgaatgctaggcgacacataccatcccccatcccctgcatgggacgctccaatccctcagacatgaatcgctggagccgatgaggatggacacacttctccaggagatgatgagattgtgtacggtggactgtgaaggtagtcccgccactcccgataggcccgcatccaagtgactgtatggggcgagagttgactagagatcatggagatcgaagctcctcaccacacgacctcaccaactacaagcggttcacgaagcatgcgatggaggcagatatgctcctcacgggcactgatgagctcttcgccatcactgacgtcctcttcatctcacagtcactcctcccctcgggccactgaagatctgctcaccatcctcaagctatacgcccatgtatggtacgaatcaattttttcttggtaccaataagacaatgagcattgggcgatatcagtggatatcaatatctagtaccgacgagtatcggctgatacccagggattaaaattttggttcgaaattttcgaaatttcagaaccctcccccctccccccggcatgccaatatctcggctgaaatttttggtttttctccaatttttgtgaatttagtcaaattcagttaaattgtgtcaaaatttcagtaaatttcagtccaaaattaccaaaattcccagaatttcggttctaccaaaagggccgaaatcaaaattgaaaattgtgccgatacctatggggtatcatatgatacctagcaagtatcatgcatgactctggtaggtatcacctgatatatagctactagctagtatacctagcaagtatcatgcatgactctggtaggtatcacctgatatatagctactagttagtataccgggtctggatcccctggagttgagtataactctaccgagtggagttggccaaatctgtactatccattgtttcctacggctgagatcattcatcatcaatttcacctaataaattaactccttaaattaatggttaaggcttccgaggaaacttagttttttcatgtgtttgctctataatagcgatttgattaagttctcacccccaaaaaaaaaagtaacagaacaacgttttgttattccccaaacaacagatatagtcgatcaactctaaagcaactcgcagtgtataccaacatagtgctttcacatatatgcaaacagtgaaccatatcaatattaatgtgtatgatttttttagataattgatgaagcatgaaatttttgttctaattatacaataaaaatgatctcgtgataagttgttgatgcgagtttatttgttgcatggtcagttactggtttttaaagtataaattaatgtggcttaatcccagcccctgaagtatatggaatggcacatatttggccaactccacccggtagagttatacccaactctaggggatctggactagtgtggatgtggatgcagatgtggatcggattatttcggacggcggatttggtacagagtcagtgcaaactcggttcggaaatgaaataaaattgtcggatgttatgtttgtattcatggtgttgttgaaggcatgtttctttaacgatttctagcctagcgagagccctattcattacatacaacaagaaggcagcaatacaataagcagcaatgcgatagtaaaataacatctgaacatgatctctcaaggaaaaaccagccaaaacacatccataatagtataattttgcttaagtgcttaagtgcagcttgcataatatataacatcaagtgcttgaataatccaaaacccttccaggcattgcttgaaaatataagtccatccatggctccagcctccatgccaatgccataacatcaggtgtaaagtcccaagtcctaacaaattaacacatccaagatcaagataacagtatggtaacaataattccatgcagaagtacaacaattactcttgcaatttactaagttgcaaatatgaactagatctatacaacacacatcaacatgcaaggatccagacttcacttctcactcttcatcattactgtcggagggtgaactcctggagcgggggactaaggggcccccctttcagttcggcggggggcagcgggtgagaatcaaggtttggtgcaaggagtgatgtggagggggtcgggcccctcaagaacgatgagataaaatgggtttatacaggttcgggccactgagaagcataacaccctactcctgtgtgtgcttgatttctatgaggaacaccgtgtactagttggttcaatcagagagtgatcgatccccctctcactaggtctagacctccttttataattcaaggggttaccacaggggcccaaaagatctacctagggaagaaggaagacatcctttacatttattacacatcttatttctctgacagaggaaatcatgccttcgacgctccagcatggccctatcaaatcaccgcgggtgacacgggggacgtgtgcgtcattccccattaaccatctgaagactttgggtacccgttcccactaaggaatggataccctaatttaaattggagtaggaaatcatccccggcttgcacacggggcaagggatttctcatcatggtgatgtgactagacggcaccggccacacgccacctgacagcgggccagtgcacaggcggtcagcgcgcaggcacactcaccctgccacgccggtcaatcgagtgtcactcagcctgtcagccacgcctgcacgccgcatttaataatgcggcgttatgcggctgcagcaccagccttaaatgctgttagttgggcgttgagcgcgcccacctaactcacgcatgctgggggggtgcgtggagggggtcgggatggcctgacccctaactgggagggggcagccgctgctcaaccccgggcccgaccaccctcaggggagtgccacatgagtttgggggcggcctcctccctctagacacaatacccccaggcctatatcaccgacaatcactactctgttgcttttctgtaattatgagcaatcaatatacatttttttgacaataggactacaaaatgtatgaaataaaatgttcctactaatgcaagattaagttggtcagtgtcataccatatcatcaatctcgtcaagcgtcaaattagcaaccaaggtctctgcaacctcatccaaccctcttattaggatctgaaaaattagaaacaaagctatattagactattagcaaataaccaagaatgccctttacaacaatataaatgagaaatgacacaagtgatcacctcttctacatcgagcaactcaatccttggtacaaactaatgcttataccattttcgagttcaagtttagtacgaaatagatcaataacacgtccccctgcactaaaagctgattctaaagcaacaatgaaagcttgaatggacaagcacgtgaacaggatatacatctttgtgagctttccaccatgataagacatcaaatttatctccattaggaaccaacagtgatggctaagccatttatttatccaagtcacttgcatcacttccactatccacatgtgaggcatagacataattcataaaatcataatctgcttcttctatagtatggctttcttttgattcaacattgacactagttgttggtgcaatagtagtcttataaaaagaagcatattcttgataaaattgcttaacaacactagtaaacttttgcataggtgcatgatatgattgcttaccatacacctcagcatgttatactctactgcctttgtcttaaacctaggttcaagaaagtatgccacaacaagagtaagatttgacctcttccagtacttctcaaccttcttattcattgaggtggccattgttttgatggcaacatcatcacttgtcatccatggagtaattaaagccttgatttcacgaaagttgtggtaaaataaatttgcagttggataagaagtacctgaaaaaaaaatcttagtgatatcatcaaacctcttcaagcacatgcaaagtgtttagttgccttataccaatcttcagcttttggaacaagaccctcataaatttctcttttagtttcataaagcctctcgaaagactttctataatatatggcatctgacaactgacaacatatagtacgttgaattccaccatgtcaaaacatcatttgagactcccctcgctatatccaatccactctcagatgcacattttataaattcctccttctgtataggagaacacttcacaagaatcacgaatgatcgaatactaaaaacagcttgtccaatatgtgccaaaccatctctagcaacaagattaagtatatgacatatatctcatatgaaagaatgcctcatcacacatgaggggactttttctattcagcaccttaataacatccttaacacaaacatcatttgctgcttaattgtccaaagtaagagaaaacatttttttatcgatgaaccacttatgcaagcatggagaaaatacatcagctaaatttagcccaatatgcctccctttacatgcatgaacctgataatccttttttgaacacaccaattgtcataaacccaatgaacagtgatacacatgtaccccttgttttggttagaggtccatatgtctattattgcactaaagtgagcattaacatttttaaaaagctcatacaaccttttccattcttctgaaaatataccaagtatatccttcctaactgtgatacgactcttcaaaggaaaagtaggccaaagagattttatgaagtcaacaaaatactcattctcaacaatattgaaaggatactcatgcatgataattgccaaataaaatttttgtaaagagatctcttgatcatacctgtatgtttcaaccgatgttgtaccggaacccttatccattttgagttactgctatcctggaaccacattgtgggtttttgtgtggttcaagaacacataagtaccatttcctgctattgcgcctagctaaataggcacaatatttgaacttggcccactctttttaaccatctagccatttatcttaaccaccttataaacaatattgtagtgttcccaagctggcgaggatctcttctttgctttttttgctatatgttcatcattagtttcatggtctcaatccccatctgcaccattgttatccacatgaacaacaacaatagtgttggttgccactgcccacagttgatgacctttctaccccttcagttggagctagtgatgaggcaaccatgctagtttcagcagctgctgttgctttagtacctctttttctaggtgccatttttagggtcctaatgaatgatgaacaattaaacaaattataagttgctattgacataatttcttaaagcaaagctcatcactaaatttctaaatcccaaatttcaaattagactacaagaacacaatacctgatttggagccatggagagtattgttggtatttcttagcgacactactagaaatataattcccagcaatagcactagaaataatcctggtatattatggttacatatgtgatccgcaagtgcacggatataccattgtagcatttcacccgggagtattccaaggtgtcgtatttatttgatcccaatgaaagatatgataagagagaactttactaacaattcatatattacttatatacatgaaagtttatgcagaggttaattcagttcaaagggtagggtgacacacagaagaaaaaactaagatactctcactaaaatatagtctaaaataaatggagaaagaataagaaaagtatcattcctgtacttctagtatacatacatctttagtctatacttgctattatacagtcatgcaaccaataccccgtacctagtgtcctcctggtgtttcaagagactacccctggttgctgagttccttacgacaacctgtcctggccatccaaccggggctaaatacggaggagtaccctccccaggaaattgcacttagaataatatacacatgcagaggacacccatactgagccgtcaccatcagcggccagcctctgaaccactgtatattaccccaattaatggtatctaataaactaagcaccgtgcttatattactaaatactactctacatccttgcaaccgacatagagcaaccgaatactcagacactaaacccacaccaatacacctatctggaaagctagttgcatggctatattgattcaagtatgaagtaaagtcggcactcaagtaatatgaatggaataaaataccgaaaatgtataaagaagaatattctattaattcaatatgtcttacaaaagaagagaggaaagctactggagccataccagcaatctcctgaagactcgaggactatgaagactattctattttctactccactagcactagaactactaaactaaacttgagagagctctagatctttttcttgaggtgtgtgagggaatgaatgagaggaggggtatttataggtggagaggtgctctgggagtgtggagatgctccaagcatcctatgagcatctttgctctcctcatgacaagtggcatactcaagcatccaaatagcatatttcatctcctcttgctatgtgtccatgacgatttcttcagatagaattagctccaaccgtcataggatgccggtagtaaccgcctggccgaagatgggttggattgggccaactggggggtcggccgaaccctggctggctcccctggcccacagccttcttcaggatgctgacatgtgggccccactttatggtacaccatgttttagctcagaataatttctcattttatatgttgtagctcaaaaccatgtgagtccatcggcgcaaaatatattcacattcttcacgttcattctctcccaactttggtggttaatcacctctcgacggcttccgattgattgttcgtttgttttccatcgattctcctccattcatgcgtgcttctcctgcatacatgttagtagcatagcacatagtggaagtagatattttatttgggaattatgcattgcaaacatagctagtcttcatatattgggtaataatgacggtcgaaactggtcgatagcgaccgtcaacaagtatcacctattgctgttggaggcgatgcgccaatgccggatcgatgatctgtttaggaggccgtcggcttgttgttgtcatgggaacatggaggaggcggtggggagcaccgaggctgattgcgtgggcttctgttttttttataactgttaaaatcttttatgatgtctattttttatccatatataaagttttcatagatgtttacacatacatagcagtcacacataatgtagttcttggtcattcaaacttacggtaaagaatttcacgcctttgcacatataaactttcagcaataaaactatagctgagatctttgataattaccaaactaattactctacaaattttgatatctcttttttttcttaatgactcatgagcatttaattttctcatgagttattgtgatatcaaattggacatcagcaaatatgaacatgtggtacatatccatttttcaggtgacctccgatccatgattccctagcttgtttgtagcctatagaacggtgtagttgaggctcatatatgcaaaaagttattgaaattaattatgccatataagggtacaaaatcaaccgaaatatttatgccatgattaaaaagtatgatttttccaaaatattgctcaatagcataattattttgatgctatactaaatagcttctaaagtcgattatatagtaacaaagaatatattttagaacacctatgtaaaagattactccctctgctataataactttattttgcccccacaccgtttgttttcaaataagtttatttttgagtaatcattgcattagagtttgtgaaattaaaggataaatatattgggagtagataaaaagagagaaataattgcattgggatttgatatagtaagggtattttagtcttttatgttttgtatcggtatacgtaggatgggtgaaaatggacttatttcggacatagcgactattaggcttgcttggattactcgagcaaatttcaaaaaaaatatagagtaattggattctttccttgagcacgtgttgtcctatcaaatattatttaaccggttttttatgccgcgacttggactattcatacttgaattaattctatatccaattagttataaatgtttgaaaaacaatgtatgatggggcaacctgtattattgaactgtttcatacttttatgttaattcgcatgacatatgaaagggtagggatgttgtctctcgataaaatattatttaatatttgaatttgtaatttttgtttggatattgtagatttaatttagatatgtatgtttatggaatgatatatgatgactcaatatatgctgtcaaatttttatagtattttattgctagattaggaatgagatttgtagcttgaaaatttttgctgttttagtatataaaattattgatttttctcgattaatttagtagctaaattaaaggaggaggagagagcatgagctagagaggagagctacagagcagtgtgcaccgcaaacgcatgcgagtgggagggggcagcgagtggttttttacttttaaagttctctacatatagttctaatggttaaaacaaatgggtccatcgatctaagtgagagtgcggtaagttttttttccatttttgttctcagaatttttagatcaattttctaatttattagatgcatcttgtggtaggttaggagcacagttaagaatgtttaatggacttttattacataatatattgatatacacgatgtttaatttaatgaatatttattatttgctagctagaaattaaggaggccaaagtgagcaatgagagaggatttttggtagatggtattttgtttttttctattaaaatagatctaatggtgtaaaataatgggcctattaagtgaaaatcgagggtaagatgttttgctttttttagaatttcttggatttctctaatttattagagcgctaagtgatgttttagaagcgtttgtagaaattttaatgaacttttattatataatagatagataactttatcttttacctgtgatccctcttactaaaatcacatgtgacaggaaaaaaggagaaaatatgtagtggaaactgcaacctatatgaaaacttgcaaactcaatcgtggaccattggatccaaaatgtgcagcctgatgaagccttgccagcccaaccgtccccacgttacattttatgaaatgccccccgcaccatgctgtgtacaatttcatatacatcctttaaatttcctcttttctcacgttgctacatctccacttcaacaccaaatggtctagatccaaaccagatccatggaggaggggggaggctgcacggcgcgtggagattgatagagcgacgacgagctcgggccagtcgaatagttgagtgaggagacacaacggtggaggcagaggcggctcatgagcttgaatctggtcttcctcttccccatcgatcctgcggtgagcctctctgaagacctccaaatccctttcctccttagcagtcaaggctggagctgctgctgttctcttaattgccaagagaaatgctccgagaactgagttgttgtggctgctgcattgtactctcgatgattttgtatctttagttccttagagcatcaccaacaatatctgtatatggttatcctgaaatttggagattttcgttcaaaaacccagtccaacagaatccctagccaagcgcccaatagttcaaaaaccgaatttttcgttctccacaagtagggagaggcgctcgctcccaatctccctctctcgtgccgtcgtgcgaattcccacgcgcacgtgaagtgttctcgacagggggttcatcacgaggttgttcgccgtcgcatcgaggtgtcctacaggtgcccacatctcacgcgcgcgccgctgcctagagctttctcggcgtcgatagttcctgctctggcggcggcagcggcaccatctccactacagccaggcgaacttccatcggcccgagttggtttctcctcaaatcgggattggtctctcgatgatggagatgagcgaaggtatctgctagtgcttgctagttttggcgctgctaatctgctactacgaattctacagttggtactgaataatgttgttggtgccggtggtggtgttgaaagttgatgttggtgttgctgatgatgtgctgttgttgatgctactgacctgctgctagttgtgatctgctgcttgttgcttgccatgctattgctaattgccatgctgttgccgatctgaatttttttttgaacgacgtttgctgatctgagttgacgctactgatctgctattgttgaaaatggtacgatgttgttggttctggttggtaattagggactttgctgatgctgctacttgtagtggttctgcttgattgtttgcaggatcagatttgctgacgtgctactgcgtggagaggggtgacagggaggtgaccaccaagtggttcccgcgatcaatggtcacacgggcgagcgtgataatctcacaggagggagagcctgaaacagatttcagttggtagttttgtagagggaccactttttagatttagggagtcaattttagccaatctcttggagggctcaatattttaacaccttaaattttatttaagattcccataaacaaaattttgggatactcttggtgatgctcttactgagttattctagtacagtactgaattttaacacctatcattattctgaatttttttatgctacttgtagagaagtaaagagcaatactttctagtatatctgttagtgggttttattatgacccacacaacgggtaatgtactaatgagaatgatttgaactgaggaaattaaatttatattaatatttggtgctatccctaaatttatattaatatttggtgctatcccaatctgcagtccattggaaaagcttgagaggagagcaacatgcaacagacaataatcctgtgggtctggggttcagcacttcaaaactgacgaccattgtgagaatacataggaggtgctaactaagatgattgaaggtgacaatctagaggaggtgctgcaggaattggaggagatgaagaacttcatcaagacaatgcatagcacttatcatgctattaggatttaaaaagaaaattcatataagagttagtttgtaatcaatttgtctatatactgaaatgacaatattacacaatgtgtaaaatgcctctgcttcttccaacttgacttgcactgcttttgcatctcaatgacagcccgcgcacgagcagaactcgacggcaatccacgacaatgcacggcagtgagagttatcgttcttcccttccttaattcaaaaatgagcacaagaacaaggttttgctgaatttcaagtggacaatggacactgcagagcagactgaagtgaatataatctaccttatgcacatgacaacaggaaatcgtgcctagggtggaaaatggcatctccctcaccacatacacagaccacatatatggacgagggtgaacagatatataccttcatgaaaaaaaattgacatctgaacattcagggaacttaattctgaagaaactcaacatgaatatattgttatagagacacgaaaaactttcatgaccatggtgtgcaaatgcagcacaccggtttgtgggaacacaggtgcagaaaattactagttcaagtagaaaaatacagcacacagaaaatttatccagttcaagtatatttaggattttcctagaaaatcataggtccagattgtggccacaaacaattggcagagtcaacctagtccatcaatgtataccgacatggtctgatattcagatgtcttctgctgacacaatttagatcccacagagttttggcaggtaataacattcataagttacaacacttgtgcacaaatattagttatccccttcaaggtgttgtctaatcaaaatgcaaccttgctattaaatggctaaaatctattaatagatcacacacgtgtgcactggatgatggcagtggctctactttgaacaaaaaactactctcagcaaaagaattctcgccagctgctctcagcaaaaaaaaacctgcacccagcaaactgcatagtgaaaaaaattgttaagaaggacatatatacttgtgagcatagataaaaaattgttaaggacatatatactggtgagcatagatacatacaaagttttattcacactacggaccaaactaagataacaaaatgttcctggaacacaatggttgttctaatatttttttcctgtcttcccatatgtactcttaaccatttcaagctgaatattagctgtccaaaatgtccttgtcgcaatatacatttgtatatgagccgaacttgtcgcaatatatttaaatattttccatatgtaattcttaaccattccaaactgaaaatgcaatccaaaatgattgtgcttcctacacatcccgctgtatattacatgcccacttgcccacctcgaatccttcccatatttttttatactttgttccaagttgataacactaggtcccaaatcatacagtcaaaaacttaaagagctataaataagaacccatgcaaaaatgcaagggaccacatcagctaacaggacaattgtacatttgcgatttatattattaattagactcacgacgacaatactaaaaatgttattacctcacaatggtcccaactaattatatttcaacatgtgttcactacctactgttagttaaatattatatggccacctattatcttttacatgaattgctactttgttccaaggaaatctacagtatgtccattagaaccagaatgttcttggcacactatagactttacgatacaccgttagttgaattttggatgacaacacacaatcttttacagagaaacgctaacttcttccaggaaattgtatgacaactattataagatgactgatagttaaggaagcatgatgtatagaaccttgcatcactgttgtggttctttgttaggacagttgcgcgaatcgtgcagcacgacttgtttgcacttcttgcacctttgtggtactctctcttttttctttatcttcttgttttgctttttctccttgtcattgtgccctttaattctctttatccgacccctggaacgagtgtcatttggcgggtggatttcaatttgacttggaatgctacatccaagatatgattcaaattcctcaatttggctaagctctttttcaggaaccatctcatttaatttatcaccaagcacaactagttcatccctcaaaagttgcatagctgctgctgattgcttagcttgtaggataagcttctccatttggttgcatgcttctgaaagcattttttgcatcacaggatcattactgttgcttgtgttttcttccaacaagataccatctgcatcgaacacatgtgtcttcttgcagtccttcctaaacctttctaataaatagtatctcggcagttcacttagctgggcacttcttaggactggaattagatgacgacatggtataccatgagtttcaaatagcatacatgtgcacgttgcaaccattgtctgtctatcataacgcacaactcttggcttcctggattcttcaatgatatcaatgattttgacctagccctcttgttgcacattgtcaataaggcaacggtccctggcagctagcacctctttctgaattatgctaaatacctcatgtgtgaagaactcacttgcatgcttctctatcacccattctgtcttcaaattgcggattgtgtggagcgtaatgttatcttcttctagttccttatgtctttgttcttctagtgcagcatcaaacctgagccaaaactccaccaaagcaagcttccgcccaattagacgagaaaagaatgaattggcactctctgaccttgaggtggtccttaacaatcctgacaaaggtatgtcactaaaataagctggcacccatgaacgccgttgatcgaactttgtactgaaccccagaccccagacccacatctcaccatcattctaatgcaatatgcaagataatggagaacataaagcacgacggcaggccggcagcagcaacatcaattctacgcacgatcctcccatcgatgaataacacaacagtaacagctgcagacgccgccggttgctccacatcagtgggtagctcatcataaccttacagaacagcagtaatggagggacaccattactaccttttgttggccaatcgatgaggggccaggcccaagtggagggaaggacaagaagaacaacaagaagaggaagctgtagctgtctctacaagaacaccgacggaatactaactctagttcatctgcagttgtcagtgttggtggcatcaaaaccctagttcatctcagcccccaaattgttcaaaccaagcacattccacggaagaacatacacgaactatagcagggatcaagaagagagaatgaccttaattcagtggatgctggaggagcaatcggcgaatcgaggccgccgttcgcagatgcctcgacgtcaccggagcagcatgggggttgattcgtgttgccgtgaatcacgtggaaaggtggcgctgctgccgaccaccgccggtgccccaccccaccccaccgccgtgccgccgccgcaccacccctcccccaaccccaccgtcgtgccgcagcagagagttgagtttggggatggatttggggatggatcccttctgaatcggagaagatgtgctgtgggacaatttgggggctgagatgctaaagtttggaattaggcggggtgttttttgaacatttcattctgtggtgacgtggacatatctggaacctacgttttgcatccaagtgtggtttctatgtttgcactagagatagtgtttccattacatatcttctcggaaaaaagctcacctctcctccctctcgcctcatatcaccgccgtgccctccagctggtgccgccgctgttgaccatgcaccctcgatctttcatgtatgcacaataatattttttaaaacaattgaaacatgcaaacaccctataagtaatacccaaacttcaatgatactctataaaaccactcaaatatttgaaataattttagaagcatacttagacaattgtcaataattttaggtcagtttttagaacgtatgatatgatgtgaagacatggaaaacaaacatgaatttaaacggttgaatggaaatagtatatatggataatattgtttacacacaaatttggcacctatggacgaaataggggaaaattaccaaagtttagaaagtgacgggttttcttcacagggccggtcagaccacaggtgtgtgggcggtctgaccggctagtagggccggtctgaccgcaggtatgtgggcggtcagaccggcagggtccgtgtccgagtctgttttcgtcgggtctcgggttttattgctcgggaaggcatgtttcgtgttttctttggtttctatcccgagttgggcatggagaagggcctgtagagggcaagaccaacccctatttaagggacaaggccggttcattataaaacccccgaatacaatctacttgaatcgttcttttaccatgtttttctattttaccctagtttagtccatctttgtcggtttgcgccgtaaaccgtccgccgccgctgcgggagtgcgacacttctttataggtttgtcttgaaaaccttccgttttgcccacgagacgggtagttatcctcttatcgatctaaatcggcctagaggctgattttgatatccaaatcggctccgttagccggtttacctgtttttctacgaaatccatcttgatttggccctttggctagatcgaggtggttggcgactccatatcaccgcaaggcgtttaggtgttacgatcgtgcttgttgacttgtcacagaaagttgccaacacgatttttggcgattccactggggaacgatctaatcggccatatcacggccgaatttcgtttaatctaataattactgtttcgtcgaatcatcgaattagtttcggctaaacagccggaattaacctacactgtaattattattgtcgccgacattggttttgtcttcaagcttaagcttaattgttctgtttgatcacggctagacgttaaaccctgttcacacagggagcagcagccggattagcaacattgtttcctttttgttccacacggcaacagaaagatttgattgaccaaagcttactgtacacgggttagaaaagatcaggctattcaagccgatctattactgttcacattaaaaaaaaagagacaaaaaccgattcaatttgtatcggttacactgtgaaactttagattagtttccaaattttgctaagtctactcggttgattaccaaataaatcaaatacttttgccgagtacagtagcatacaaggaaaatttatgaccgtatattaatttattcggtcaaatattttggctatgagctatatggccgaaattaatcaaggattttcttcatcaactatgacaagcgggaacgggttcaacaatactactacacaatacattaggaccgatcaaggcgtcatgagagaaaactttcaccaaaggtaacctccgattcgcccaacccatactttgctattcaaaaggttaatgatcgttgtgtagattcatatgctacttctagttttgctcctatacaatatgcttataatgatatggggggggggtcaatgggtgtttatacagccgattacataggaatcggctatatgcaaagtcgaactgacggtatgaccagtcgtgacaccggtctaaccgcaccctatgtcggtcagaccatgtccaacatggccggtcagaccatgtactatgccggtcagaccgtgcccaccatagccggtcagaccgtaccctatcctggctagatcaggcctcctatggctagcctgaccgcaccactgacctccggtcagaccgggccatgggccggtcagacgggctatctatagtcggtcagaccggttccctaggaatttctccaggttttcataccacgactagcagtactgattttaattattattcatcacctgttaatactgttagtcatgctactccacatgtccctaatacttacaatgatcctaatggaggatattctcacgatactaggtatggccaatataacaatattgtgccacaacaaccgctctttaggccaccaaatccaccaaggcctgaaatcatggaggtaaggaatcgtgctagggagaaccaaaagccgtattctgatttttatgacgttgtcccatatcctcctaattataaaattcctgaatttaccaaatttagtggtgagtatagtaggactacatacgagcatgtagatcaattcttagcgcaatgtggtagggctagtagtatgaatacatgtaagttgcgcttgttttctttatctttgtccggtactgctttgatatggcttacttctttaccggcaaattctattgatacttgggctcaattagaacaaaaatttcatgattattttcacactaatgaaactgatcttaagttgtctgatttaacatcggttaggcataaatacaatgaatttgttgctgattatattgaaaggttaagagatgttaaaaaccgatgtttcaattagaaaataactgacaaagatttggccaacattgcatatgatggattgcttgattcttttaaagagaaattgaatggctagatatttcttgatgttgatcatgtgttgcatgaagctctggctcaggaaagccgagtggatgacaatagtttaaatgccaccttagatgatagtgcaatatcatgtatagccgaaccaagcgatggttcggatcgtggtaataatttgtgcaatgatgccgtaacgagtatagccgaaccaaatgttgattcagattgtcttactagtttggatgataacgcaataaccaatatagccgaaccaagtgttggttcggattgtgttactagtttagacaataatggaatagtcgaatcaagtaatggttcggattgtattgctagcttacagaataatgccattgaagatatagccgaactaaatgatggttcggattgtatcacatgcgaaagtgaaatagcattgtcacctaagaccgagtcacaaatcggtcatgtggatgttggaaaagatgataacaatgtcttgcgggatagtagtgaaatagaatccaaagttgccatacatacatatcaaaggccgtatcctgaacatgtagattcagttccatacccgcaaagatttgaagtgtccaacttcacgaaattcacaggtgaggatgctataacaacaatagagcatatcggccaatttattgaacaatgtggtaaggctggtagtgatgatttgcttaagttgaagttgtttcccctttccttgtcaaactttgcatctacatggtatagtttacttgctcctagttcaatttctacatggtcatgaatggagcatgagtttcatgattatttcaaagatgcaagcttgatggagcaaagaccgattgatacttcatcggtcacttgtgaaactatttcggttacatctattcctaagaccggaattgttagtgatcctcttcctgttagttctattgatgttgacaaaaagaaagggaaaagtgttatttggggatcctcggcccaagaataggatcaaaaatacgaaggccgaagatcataaagttgcaaaggatgagtcatctatgtcacgtcctgataaattcatcccgaaataaaaatcattcgctaaaaggaataatagaattaattaaaattcgaaaagaaattggcaaacactaaaatacgtacaagaaaaattcaaatgtggcccggagaatttttgttaaattctccttggtctaaaaggagccctcaaattttacttgaattttcagagcaccagaaataattattaagcaaaaaaaacaattatcaaagtttattaaaaagaaaaacctaaaaataatcctccttcctcctttgggccaagtctggcccaaagtcctccctctctctcttggcccagcccaaagtctccctctcctccctctctttcccctctctctcccgggcctctcctccccctcccggcccactccctcctcctccctctctcccccgggccgcctctccctcctctcttcctgggccggccgcccggcccaagccgccccctgcccgagccgcccctccttcccgcgtgcacgcgcgtcgcacgcgcgctgacgccgcgcgcccgcgtggggcccacgcgccaggtcgtcgtcctcctcccgcccggcatcctctctctcttctctctcccgtgaaacctagcgtcgtttcctcccctaaatccacgcgattcaagccggctctttccaaattaattggggggttttaatccccattgaatcctcttcaattgcccccaatttcccccttgaatcgtgcccccaatcgccgggaacgcccgcgccaactccggccaacttccatggccgccggccgccttttccaccgccgttccgacctcccccatggccggctccctctcctctcctataaaatggaaccccctcgccccgttctctcgttttagccccctcccgcgctctcccgtggcctccccacctctccccgccgtcctcctctctctcccgtgccgccggccgcctccagccgcctctcccgcctcgcccgcgcgccgtccggccgtgccgtcgccttcctcggctctgcaacaccgtccccttcaccggtctcaccgtctcctcgccggaaactcgccggaacggtgcccccgccggcaaccagtggcattggtgccactgtactccctccagccggctactgtccctcgtcggtgcggcagccgtcgtcgtcgccacctccctcggctccgcgacgctgccctcatccccggcatcacctcctcctcgcccgaagcttgccggagtggcctcctcgtcggcgtccagtatctccccgcctccggccggctcctgtacgtcgccggtacaccgatcgacgtcgccgcgttgtcctctcctccagctgctcctttgtttcgccggaacgccgtcgcccgtgctggcctctccatcctcatcgtcgccgacgtcccttcggccgcccgttcatcctcgccggctcgtcgtctcgcggcgccgcctccgtcgtcggcatcgcagcggcgtgttccgcgccgtcctcgtctccgtgcagctgccgccggctgccctcgtcgcctcctcgccggttccggtcgtcgtcctctcgtcgttcccggtcgtcatggcgttcgtccctccgtcaagccattctcgtccgtctcgtccgcgtccgtcaagtgtgccgctgcagccccgtcgtcgtcttcgtcctcgcctccgcgtcgtcaagccttgtgccggccgcgtctcgccttcgtccaaggatcgccgccgaagtcgttccctcgccgtccgtctccgcctcgcccgttcgtcgttgtcgttcccacgcctcgtcgcgtggtggtaaggatccctctccctcgctgccccgtcctcgtcctttaggtgtcgcccgtgcccgttgtgcggttgtcggccccggtacccgtgtatcggtgtcggcagtcgttcgcttgtgcgtgtggtgaccgtgttagtgtgtccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaatggcgcagccttcctgtcttttccaggctagcgcttacatatgttttatggttgcaaagcctaattataataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttcccgaagcgtggtttgcggtcgttgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtgggcactctattcatggttccactagtatgaatttaggtagatgcttcgctgattaattaggcaacattaggtggtttcataactctagactttgggaatattcatatcacttggacattatggaatggttagattattgtggaattggatgcatacctccccctctattcaaaaccctcaaaatggttttaggctgggctcggggtgcatggttttgttagtagcacctcggccacctaaggaccggtcttcgggcctctgttgcaaagcactaccgtacttccacatgtctagtgggtaaggcttagtttgtggctcagtctggttataaacaaaagtacacggatggagatggatgaagccgggggtcgatggacatctctaggacaaatgaaggctacacgggctgcggcccggtagtcgagatgtcatggcacagggctggtgtcctgctgctaggggctcaattctgcctgcctgtctgggggttccggccgtaggtaggttgggtcggtactcttgtctatggctaggatgggttggaaactatgtcatgtcttccgtccatatgccgtggtggtatgtggcacgtggttgcacgtgaggaagacgtgtcttgtgggtaaagatgtacacctctgatcagagtataacctattcgaatagccgcgccctcggttatgggcaagcctagcaatgtacccaagttagtgttttaaattcttaaaacctgcttaataactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgcctttataaaatggctttgggcaactaagtgacttttaaatgctgtttactgcaaaacttaaccccgatattattatccccttgtacccccttgcattaattatgcatctccggtgtgacttgctgagtactgtggttgtactcattcttgctcaatctttccccccttcagtaagagaagctttggagaagaagtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacaatctagttcccaaaagaccaaaaagccgaagctcacttttgagatgcttatcgctaagttcaagaaaggattagccggtcagcgatttgataatcaaattagtgattcaaaaagaccaagatcatctcgtaggaagagatttggtcaaacatcaaagcaatcggagccatcaactataccaactccatacaaacctccggttgtgatgccatggtatccatattcaatgtcactatatggttatccttttatgtattatatgctatggatgcctcaaccacctatgccgtattatcaaggatggaaggaatcacctaggacagtgtcaaatcattcatctaacccaagacaagaccgtttcccacaaaagaatcggtccggtggatcaaaggtgaaaaaagtgtaaaaggtgtgggtgaggaaagaagccaaaactccggaggtcgttgctatcaaagaggagtctcaagatgttcatgtacctactggagatgcggtggaaaccacgcaagcaaaggagatcgaagccgacgccgtgactgtcaaaattggtggtctaaccgagacagctggccggtctaatcgccagtctacggccggcctgaccgaccttactggccggtctgaccgacggcttatggccggtctgaccgggcctagaggccggtctgaccgaggggcattagagaagagtgggaaaattgaaagcaatacatgagcttccacttcgacaaaaaatatcaagaatcattgcttagctcctggaaaacaaccacagccgaagtggataccttatggcttatctcgctctcaaaagaggaggctacagcgtcttcgggccataggtcaaaaagaaaaggaggccgaagatgcggagaacaagacatgcaataatttagagcctcaaacagcacctaggcaagtatggagacctaaagaagtaaaagttaagagaccggtgatttcccatagtagtagtgataaatccaatttgatgagagaagaatcatcggtcattagagataagtctccttcacatgatgctatggatgttggtgcggtgttcgtcttgccttcaaaatcgtgcagtcgagaaagccgattttgcttggggggcaagacattactatgctcgtgaagaaaccaagagaagatgaacagcgatggatacaacatcacatctttgagccgcattttgttggatgctaaggcaaggtatgggtttattgtgttcatcatcatattatttacctatgtcatgttagaacattgcttactatctagcacatgtgtttgcttatcaaattgatattatacatacatgttgcaaataccagttctaagtagtgaaattggtaggttggcatataatttgtttgaagtatgatttggcttatgagtctttgatatttatttaaagtcaaattgtatgtgtttttatggatcaccatataagatatagattttataattattgtaccatggaagttttgcttattagtaattcggctaatgtcaatggtcaatgtgatgatttattctagagttgttttctttagaaacattggcattgttaatattttgcatacatgctcaagccgattacttacatttgtagtttattggaattcatgtctgtgaggcatatgactttggtgattcattattgaattggctaagtgttttgatgccatgatgattattgtttcaaaagccatttgaattagtattcaactagacatgttagttggatgttatattttttcatatgtctagagagaaggaatttcggtccaataatttgatacaccaagcatctggctattatgtgaagaaaaattatatactaaaggccgatgcttgatttcaaaagtttggacgaaattggcaaagtcatagacagaggtggtctgaccggcattgcacggccggtctgaccggctctgcatggccagtctgaccgggtagacagtgaggtctgaccggcattgcgtgtctggtctgaccgatcctgggcagagagctggggggcacgttacaattgatttaaagaccggattaattgtgaattcggacatttgtgcccataagtaagaaatagattggagaatcactttgaatagaatatttcaatgatcctagtcttgggattgatcggaagattcggcggcaagcgctcaaatattatatcgccgaaaaataaatgtagtattacttggataatgatcaatctaaagttgctaggagagtagtacatgaagggatttgtgaaattcatcaatcggcccgtaagataaattggttgcttaggagagtggggtttcattggccgaaagtaattgatgattgtttcaaatgttatagagggagtgaagcttgttaacggatcggcaatgttcaattagcgcctatcgctgtattgaatcctattatcaaatcatagccgttcggaggttgggctttagatttcattggtcaatcttatgatattaagttgttaagttcttactctcaggctaatggataagccaagtcgagtaataaaacattgttgaaattgccgtttcgccagttgaggtaaatcttggctctcttcggtatttcaagtaagacgagttgtcggttgaagattatacgaccttgatgggaagcaatttttgaagatgtcatcacgagcgtttgaagactttgaacgagatgaagacacttcaagacggtgttttcagagatcaattaatgggaaatacttgaagaaatacttcccgagcatttgacaagatgattaggaagtcctatggccggtaattggattatcaccctgagacaacatattctatgcgtttaggttcacatatgatcaccaaaaaggcggggggcacgtgtttacacccaaatttggcacctatggacgaaataggggaaaattgccaaagtttggaaagtgacgggtttccttcacagggacggtcagaacacaggtgtgtgggcggtctgaccggctagtagggccggtctgacctcaagtatgtgggcggtcagaccggcagggtccgagtcagagtctattgtcgtcgggtctcgggtttcattgctcgagaaggcatgtttcgtgtttcctttggtttctatcccgagttgggcgtggagaagggcctgtagagggcaagaccaacccttatttaagggacaaggccggttcactgtaaaacccccgaatacaatatacttgaatcgttcttttaccatgtttttctattttaccctagtttagtccatctttgtcggtttgcgccgtaaatcgtccgccgtcgctacgagagtgcgacacttctttgtaggtttgtcccgttttgcccacgagacgggtagttatcctcttatcgatctaaatcggcctagaggctgattttgatctctaaatcggctccgttagccggtttagctgtttttctacgaaatccatcttgatttggccctttggctagatcgaggtggttggcgactccatatcaccgcaaggcgtttaggtgttgcgatcatgcttgtcgacttggcacaaaaagttgccaacaaatatacctataactggcctcactttttttagaacaactggcctcacttagtgtatttgtcatggttatggataccacatacctaatagtagtcaactaaatctcggcaggacccaccacataccacgtcttatacggaaactgacttcggatatggagggagttccggataaggaaagacaaccagagttctacatggaaacgacaaggactactcggattgtatccatattgcttttcctagttctacttggacaagggaacacctatgggtataaatacaaggccccctaggaggagaggggacacggacaatcgacgaccacctcaatcaacacctaccacaatctacggaacaatagatctagacacaagatcaacatacaagccaacatacgccaagacaagacgccggatatcgactttagggataagcacggctagtcccctacggtgtctccggatactgtcaggagagacggaagtgctatctctgatctcgccgggcacggattcgaggaggaagactaccctgttgtcgactacgagtcagaactttagacagccatgtcgacaacagttagataggctaccccaaatattgtactggtgtgattatggtaaataaagagcaacgaccggcttcggccaacagggtgtagggttattacctgacaattcaggggcccgaacctgtataaaaatctctatctctatctcttttacctcagtcttgcgtatatcctagtaccaacgatccccatactatgcaaataccagaactgcgacatcaaacatcgacagtggcgcgccaagtaggaggattttggtgcttcaggattttgaagagatgggttcaagagatgaattctccaacaataaactactcgacgacttcactgtggggaagatcaaatccgaccggagtatgtcttccgacgagatcgaaattatcgccgtcgtggaggacgaacgatactggcagcattggtgaccgatccaatatgggactgttctggaagctgacggatgtcctcgcaggcacagacgtgttggtttgattcagactaaggtctacacggcgctgtactccttggattcatacgaaggccgacttcctctatgcgcgatatcgatttctaccgagacaaatgcatccatgtatgtcggttggatttcatatgcgcctgatccaaatatctgtatcgtgtacgtatacggcctgtattggtcctacatgcacacggacaccagatacatgccacgctggaaaagtcaaagcgactctatacacagtcgtgtactcagagacgaatcgaaactttacccaagtacacaggaacatatcagcgcgctaatcaaggtaattagtggattgattttttaaattaatctactaatttcgtaaatacatttggcatgtatctacaaaggtacgcaataatttatatccaatttatcatacctactttttccaatctatacgatattgtcagatctataatttattatgtttacctacagcatgtcttttatacaatatctgctgtgcgagtgtttccgatgttaaatcgactgcggtttaacgctgggggctcgctctattttcttatgtataaatcatgcttacttacggtttacataatgattgatatttaatctgctcgttatatcctgataatactagaagacccatgcagttttttaagtacatactcgatattctctgctatatgtcttgccttctagaaaatatttttcaggaacaattgagcactcgagtaggttgtggtcgagtacatcccactatcgagagcattctcgataaatgcggagttgtcgcgcccaacctaccaacgaagaccgacgacctacctcatagcaccggccatggctggactactcgagaaaaggttgttaacggataattcctcgcgaacgtcgtcggcttgatcacctgacatgattgcgaacggacatccagatatgttataagttgggtatgtgagtcatgctggccacatgagatacacatgtaataaaacaactctagcacttccattggtgttcgagagataattctactcgctcgctggttctcgaaccagtacacagcaatctctcgcaccgcaacttacattggtgttcgagatataattctactcgctccctggttctcgaatcattacgtagcaatctctcgcaccgaaacttccattggtgttcgagagataattctactcgctcactggttctccaaccagtatgtagcaatctctcgcaccgcaaactttcattggtgttcgagagataattctactcactcgctggctctcgaaccagtacatagcaatctctcgcaccacaattttcattggtgttcgagagataattctacttgctcactagttctcgaaccaatacgtagcaatctctcgcaccgaaacttccattggtgttcgagagataattctactcactcactggttctcgaaccagtacgtagcaatctctcgcaccgcaaacttccattggtgttcgagagataattctactcgctcactggctctcgaaccagtacgtagcaatctctcgcaccggaaacttccattggtgttcgagagataattctactcgctcgctggctctcgaaccagtacgtagcaatctctcacaccgcaacttccattggtgttcgagagataattctactcgctcgctggttctcgaaccagtacgtagcaatctctcacaccgcaacttccattggtgttcaagagataattctactcgctcgctatttctcgaactagtaaaacgtagcaatctctcgcatcttaacttcagatggttgaggaacagctacgactgatcttcgaccgacagcgtagcggtcctcgtaccacgactccaaatgatcgagagacacctactcactggttctcaaccagttaatcgtagcgatatctcgtacatttacttctagtggtcaatttacgactactacctggtcctcgaccagcggtgtagcgtttctcccactacttccactttaagtggtcaagatacgactactacctggtcctcgaccagtggtgtagtgattctcccactacctttacttcaagtggtcgagttggggctactacctggtcctcgaccagaggtgtaacgattctcctattacctctacctcaacaaaagttgatatcaggtacacaataatgctaagtgttttacccagagatcccttaccacgacgacacctagtgttgaaacctatcctactgtccctttacgccgtcttgacaaggcctccgaggaacctaagggaacttcggctggggacgcccagagccgataaggccttgtcggatcctgtagagacaaaagaccaagtaagatctggtcgtataagagttctcgccgtgcgtattaaccaagccgtgtaatcggaaattgagttttccaacttcacagctgggggctaggatcagtgcttgttcaaccaaggcaggtcaagggtccaagagccttgtcctccgagaacgattctccgacgacaaggctgggggctagggagagtgtatgactctacaaactgactgatcaaagtcggtaagagagaagacgctcatatataaaacattggtcggtaaatttaattcatttttagttttccatacaaattataacatgtcaccatttgagcgtttgctcgggggctatttctatttgatattcttttctgagtattgatttctggaaaattctattcgacattgtggaaaactccatgtctctatggttctacaccaagatcgactaaggcgagtacgacaaatgttgacaaggctccgtcgcagactctacgccttctcgatcgctcgagaacggttgctggatctcgacaaggaatacggaataaagagatggtgtacccgccgagataaaactttttgacttcaatccaaattctcgattacagcaagacgggagacttagtcgtatgttatgtactttcttggttgacgtcggagattgactcaagacaaaccctttaggtgcccgcacgaggctgataaaggaagtctaacgttatctctgaactcaccgagaacggtcacttgagctcgataacagttactccatggtcagcggtcgagaatatgaattcgttcatttgcattgaagtcgggggctactgtcatggttatggataccacatacctaatagtagtcgactaaatctcggcaggacccaccacataccatgtcttatacggaaactgacttcggatataaagggagttccggataaggaaagacaaccagtgttctacatggaaacgacaaggactgctcggattatatacatattgcttttcctagttctacttggacaagggaacacctatgggaataaatacaaggccccctaggaggagaggggacacggacaatcgacgaccacctcaatcaacacccaccacaatctacggaataatagatcaagacacaagatcaacatacaagccaacatacgccaagacaagacgccggatatcgacttcagggataagcacgactagtcccctacggtgtctctggatactgtcaggagagacggaagcgctatctctgatctcgccgggcacggattcgagaaggaagactaccctgttgtcgactacgagtcagaacttcagaccgccatgtcgacaacagttagataggctaccccaaatattgtactggtgtgattatggtgaataaagagcaacgaccggtttcggccaacaggatgttgggttattacctgataattcagggacccgaacctatataaaaatctctatctccgtctcgtttacctcagtctcgcatatatcctactaacaacgatcctcatactatgtaaataccagaaccgcgacatcaaacgtcgacagtattattgctagctttctctctgtttttttttgataagctatattatctcaaaagtttctagccttctatcttgtacatagttgatctaagaaataggttacatcgaagtctataaatttaaaatggattggtgactggattatttctgtggattacatatttcattatagggataaattagatatttttagaaaataataaaataatgaaataagtggtcttactatacaatggaataagttttttttgggaaatgtatttttgagcaactaattaattgaatgatttagtaaataagctgacaacatggcagtcaagccgtctaactacctagcaaatcaattaatcctcgctcggcgagtgtgtaacacattactccctccctccattctaaattgatctacatatttcataggtacaccaaaaccaagaaaaactaataactctctcatactatatttactctaaaaacaagctcgatgcatacaccatcccattattttctattcaatagcaaatcaagatattgcatgtgggttataaatacttgtgtgcatggatacatgtatcaatgtccatttactccaatattaatgcacaaatactccaacgaataggcttaatgaatgcacataaatataatgataatttaggaataacctaaaaaactatatatagatcaatttaaaataaagggagtatcttagaaaatttccacggcaaacactaattagctaggtttccatcaagctaattagcgagggtgtaacacattatcttcatgaccatcttccgaattttggccatgctctatgatcagctgccatcgcatgcatgcatgcctcgatctggcggtgatctcagtaaccgaatgcttatcggagtcaacatatcgcacatggccctgcttagtaattaagatgcagatcatcagtgagccttaagcccttaattagcacaattttattaaatcattgagtgtattattatggcacgcgtggtataattagcaaacagctagctaacagcccacatttcaaaaagtcaatgtatgaaccttaacaacgctgctatacgtccgaccagcgtacgactcaacggcgaaatacacggcgcaagcccaattgaattagcgatcgttgcagaagttacggacggcggacggccaatgacgtagtcgtgcgctggtcgtacgcgtcggttggacgtatagcattttcggaaccttaattactccctccgtttcacaatgtaagtcattctaacattttccatatttatattgatgttgatgaatctagacatatatatctatctagattcattagcaccaatataaatatggaaaaaactaaaatgacttacattgtgaaacggacaaatagtttttttgttccaaaatcgtgagagcaaaaggatcacggatggattcgcgacatgtgctgggaacagggcatttccggattagtcgtgcagataagctgatccgagcactttccatttgtattaaatttgctcgctcatagtactgctgatgtgatgcaaagattatcttagtctaattttgttgcaccttcttctttaggtacaacgtataataatgatcagaacgcgtgacatgcatgtacgtgctggttattactcccttcgtttcaaaatatttgacaccgttgactttttttaagtacgtgtttgaccattcgtcttattaaaaaaatttaagtaattatttattcttttcatatcatttgctttattgttaaatatactttcatgtacacatataggtttacatatttcacaaaaatttttgaataagacgaacggtcaaacatgtgctaaaaagttaacagtgtcaaatattttgaaacggagggagtacgtgacagtacgccaatgtctgcagttaatcaggactcaggagcatccatgcatgcatgtttccaggatatcaatacgagcccactacacctccaattataattaagttggcataggtaatttggacagctagctagcgcgtcttcgtgcgtaccaattagaacaggctataaatgtaagccctcagtttcattcacatttcaccactcctccggtgacagtgagtgagccgagggttttcgatatctggataggagcagactcatcgctaaatgtcttacccgactattcaaaacaccggagtacgtgggtccgtgacgctgacgctgtgaactagctagccatggccatggctgcttcttcttcttcctcctggtgcgcactgaaacagtcatgcgtggccctcctgatggctttggcttgctgcctaactacgtgcgcgcgcggcgcagtcgaggcgctgtacgtgctgggcgactcgcaggcggacgtagggaacaacaactacctgccggcgtcgctgctcaaggccaactaccctcacaatggcgtcgactacccggggggcaagcccaccggcaggttcagcaatggctacaacttcgtcgacttactcggtgagtgtatatctcaaggccattcattagctagttaattatagtacgtttattagtaatatatatattgagtcaaaaatatattttgatagctgatatttttgggataatcgatctaacattcaacgcaaaaatccctctaaaaatatatcaaatataactacgataaatatatatatatataattatggtgtaattataatataattcgcatgtacttacgtccctaaaaaattcaaaagttgtgctggcttagtgggggctgcctgcggttgtcagtttgaccctcacctcgcgcaatgtcctctgatttttacccaatacaacatgcatagatcgtatagcccattcggtggctgaaaatttgatacgatttttaccaattttttttgtcgaatgtgaaataactaggctgtaaactttttggtgtattcggatgcaccaacactctagctcacccatagacatccaggcggttgctataaaaatagcaaggcactattattccccgggtgagggcgttcacactgcatcaccgtgacgttcagccctcgagacgccaacagagatttggactgccacgttctcgccactgctgcgctcctgcgaggaacgtgctaccaaactatgacgcgcgaacctcgtgttaggtgaggccgcgtgatgggcggagcgacgggatagagtctgcattggacctgcgatgctgtccggcccccacacggcacacccccactcccacaagccaccgcgggtacctcacccaactccggtaagagaacaaaaggggcagcaacagcgagatgggggaagaggggcctacctttccagccgccgctaaccggagaaagaagagaagacaaaagatggaggagaggcacatagccttgcaggcctcgtcggcacgagccgccgccggattccgaggggcgaagctcagcagcggcgtaggcccaagccaccgtggggacctcgtagcccgtgcactacgccactaccccgatctggtcggcggtcaccccgatctactcatcgccacaggtgtcggcgatggggaggggagggagaggtgtcgtcaacagggagggaggggagaagaaccggtgatggagagggaagggagaggtgccatcttgttaatagagaaatagaaagggctaaaatagaaaatatgaggggctaaaacaaaaaaacgaagccacacatagagacccatgcattgtgggagacaattttttttaaggtgtggttttagcccatggcacgtgaggcaggccaaattcttctggcacactgtgaacgccctgagcatacggtatgatcattataaatgatctcttgtgtcagtgcctgcatgtatgtactactttcgcaagatctataattcttagagcatgatcaataataaggtaatttagctccaattatgtccaactcatctataacttactttgcagcttgtacacgcaacatctagttgtattgttgggtcctatatgcttcacatcactattaaaaaattgcagcatcgatcctatgttgcaatttttgcatagcagcatttctctcactctctcacgtccaacgtttttatctagagatgcgtgttgcagcccgatgataaaattgtcgtccgctcgcgccagctcatgcatgttctctctctttagctcttttccctatatcaccattgctatctacgtggacttagtgtcgcctgactaatgtacctgctcttaagaaaactacgaagacccttgctcttaagcaaaccatgcatggttaggcaccgtaaaacttcgccaccgctaatcgattaacttcgccaccgcgcagagcgcttgcttggctagagccaaacaaaatagggaagttctaaattaaataacatgccgaaagtaaaggggaatcagaggaaaaattaactatgtgtagtatagcttcaatagggcaggctagctagtagcttagcttcagcatacacatgcatgcacacccgctgtgaacgaaggagcgagcgagcgacgatgggttcttgcacattgtcctccggcggcgtctgcgtcgtcgtcgtcctcctgtgtttggctgcttgctgcctaacgtgcgcgcgcggcgctgtcccggcgatctacgtgctcggagactcgcaggcagacgtagggaacaacaactacctgctgcactcgctgctcaaggccaacttccctcacaatggcatcgactacccggggggaaagcccaccggcaggttcagcaatggctacaacttcgtcgatttaatcggtgagtatatatccatcatcatcgatcgatcgctgcgtacacgtacgtacggccattgtccacagcgtatttttatgtcaaactgttttcatgtgctatggacgctcgcaccctacgtggaggatatgtgtcgtcctagaatgtttaagcatgattgcaaatctaagtgcctcatcttttcgtttatacttatacttatcagctaaaatttaaattttcaatcttaaatttgaagttgattttgaggtttttcatcaaagtttatttgctagactttgcttttaaatcgataagaatacgtatataaaagttttattcataaattacttttcgtttttaaatatgccgtttggcttattccatgaataagcaatggtcacctaacacaataggtgttttcggtagtgcttgctattacagcagcgtgcaggcgacagcaactaaaaacggccacagcctagcactgcagtagctagcgtttcaatcagcccctatgttgacgagagtatggtttttttttttttagtttttcagttatcaccaaatgtattcatgtgcatatgcatatgtgttttaccgatatttatgtattgtattaaaagtgttactccctctgtattttaatgtatgacaccgttaactttttaacaaacgtttgacctttcgtctaattcaaaaaaattatgtaattatcatttattttattgtgacttgatttatcatcaaatgttctttaagcctaacataagtatttttgtatttgcataacaaatttgaataagacgaatggtcaaacgttagttaaaaagtcaatggcgtcatacattaaaattaaaatacggagggagtatataatattgaaatatacaaacagtaaaatgggattttcgcaggcaccctcctaagctgcagaggcaacccaaaagggaaagcgcttgtgcaacgcttagatcagaaaatccagcttagtaggaattatttaatgacagagagttcgagtttatgaaattaaaatgaaacttccggacatggggttgcatatatactggaacttaagtctaaaattaatggaatcttccggacgaattgtttgaatcaaatagtagagagctcgaggtttgggaaaaccagatctgagccccctccgtttaatttgtacgccaatatgaacatgttggcaggtccgatccagcactgactgattgttattctcacaactaggatggtagctcgcgcattcgcgcgggcattcatgaatcattgcttaaatgtttcttttaagatatttgttagtttacaatatgtaaatttgattcatctatataagcacctatctataaagttaatcatctttatcatttaagaagacgtaggtcttaatccaaattaaagtaaggtgttgtttttatttttaattaaatgttttgggctcttatttaaaaaaaattctcaaaaaggttatttataataaatgtgttttattccttcttttaattggttcacaattgatgcaattttttatacgtacttatgtatgaatcaataaaaatatagagtagatatattctagacctcgcttcctataatatgtgtgatctatatatttgtttaaatacatttagtcaacccgagtgttaaaacccaaatttaatagtaagaaatataatattcaaagccaactatcttctgctatggcatagaacagagagaagtctattgatatgtagtcacttaaaaatgatgaagtggttatgcatggttatctcaatttaagggaaagttatgaaccacaatggttctaagaaattataaggttttctagaattggttcattttacacttttgttttattttatacaaatattattttaagttcaaatgtatgatatgacaaatagtgacatcattacaccctatgtgtcaactttttttaaaaaaaaattatcaataagcaagtaagattggtatagattttcattatttattaataaatggattatatgggacataaggctatggtaaattgatgggtttgtatactccaatatatttgcattatgtgatagataattcatttgggaacgttttatatataatgtgtgaggctctacacaaccattgtgaatacgatttgatggctaataatacatcatagagagagggaaccgaatgggtagagggaccgatatatacatgtatgtactaagtacgcatgtacatgatggaagggaggacgtggcacacgtgggcctttcaattgtttaataacaaaaatctaattagtccaccatgttttatggaaaatcaatggttgtgaatggacttgaattatttattttcgtttttcatctaatctaaataaaaaagaaaaaaatagaaaaagaagtagggtgggatgatacgtacgtacaaacgtacatgctgtacaggtacacggaccgagggataatttaagagagataaattgatttggtaattttgtactcgcaagatagatctaacggtggttgatttggtaattttgtaaaatagatctaatggttgaaaataatgggtctacccgattaaaagaaaatcaacggttagatgttttgttttttacttagaatttttaggatttatcaatacgccacgtggcgactttggagcgtttttagaagcaccacgtggcagcttgagagcgtttgtaggaagtttcatggacttttagtatataaaataaaatagaagatagatagatcttttgaaacttgacattatttttgctttatctctactcaaaaaaaaatttcgttggtgtgtgtgtgtttatatatatatatatatatctctttttgttgtctttttttttaaccttttttccacattgcagctatcagtctcggggtgcccagccctcctccatacctctctataagcagcaaaccaatgaacagctccgtatatctgaagggtgtcaattttgcttcaggaggagcaggggtgtctaatctcacaaacctggtagtactacaacttaatactagggtcgaaataaagaaaattgagtgatgtttcggtgctctctacctataatattatactaccagtatattattataggtaaaatagtaatttactaatacaataattatgatttactttgtcatttatatatgttttttcccggctaaatatatttcatcgaaaaagccaaaaaagagggaaaaagtttagttactgctaatgatgattatacccttttatacattttttgttacaatatacccctccacatttctattactgctaatagtggtagtagtacaaataaattttaacacttcgattaaatgagatcaacggttcatactgtcttccaataataatagagagcaccacactgaggctcaagaaaattttgaatatatttttagtgtaacacgaacagaatatgtatgaatcagaaatttaattacaggttacatacttattaatccatcaattaattattacatgagtatttaattctatattaattattacatgagtatttaattctagtacggcgcatgcaggcccagtgcatcagcttcgacgagcagatagagggggactaccacagagtccacgaggcgctggggaagcagctgggcattcctggggccaaggcccaccttgccaaatcgctcttcgtcgtcgccatcggcggcaacgacatcatcaacgacctcctgctgagtcccgtcagcgagctcctacgctcccgagatgagatcgtcagcaatctggaaaataccctcaaacgccagctgcaggtacgtatacttatgcttgcaaaacgatcttgcaattaaggtcaacgtaacatcaggccgggtttttgcagtttcggtttcgaaacagtaatttcagacacccccaccggccggctggaccaaaattttcgaattttctcaaatgtttatggatttagtaacatcacatcaccttcgttgctctccatacaattctccatgtgcttactactatctccatttcattttataaatcattttgatatttttttttcatttcaaactttcttaagtttgaccaagccttctacctattatatactaaaattttattaaacttcttatgaacgcttctaagccaccatgcgtcattgcttccgagtcgtcacatggcactttaataaaatagagtaatataatcatcgatttttatttaatttggtgtaccattattttagatcaataaatctatttaaaaacaaaactaccttgatctatatatattaaaaaaaacaaaaactcccactgtcccagctgcctaaatgcggcgtacacatgtatgtatgctccctccgttactatatcgctctcctctttctgtcctcgtaataattgaaattaaaattactttcacggggaaaaaaacccacatgtagacctcgacctagctaataagtccagccagctttccctctatccctttatccattaatatttatagtctattaaacaacatacaaatatttctaaaccactacgtggaactacggaattaaaaaaaaaatttgaccatcggtttctaattgatttgataggcacattattttaggtcgttagatctatcatttttcttaaaaaaagcatcccaaacctccatccccagtaaacatcctataagcatttctaaatagatacgtgtactctaaaattagataaaatcttaatattcaaacattttaccaggacaaataaaattgaaatatctaaagttttatatagaatctatcaaaaaattggactttttggtaaatttttttggtacgatatccttctggggagacgaaatacccaaaattttctcattagaatcacatatattattttaacacagtattttctcataaattgaaaattgcacggtttcaaataattttagtatagaatttatatgctgcaatggtaataattagaaaaaaaaatcataaccaacgttcaaaacacatcaaataagtttaattttagtttaggatatagtaaaagaatatttaaattaacagtcactctaacatgaacattcataataaaacttcacgcacattaaataagatgcccacgtatatatgcgggctaccttcgtactttatagaaaaaatttacaatacctaaaatgccaaattagtttatgtaatatagaattcaatatattttgttaatttgtttgttttctattggaaatgctactatattttttttataaaattagtttagacttaaataagtttgataaaagaaatcaaaacgacatgtaatatgaataaggagtgcaaatctatcatgattttagaccttgtacgaccttgggatgcgacggttgttcttcgtggggatagcaccgctgggatgttgcccgttgatacgggagctgaaccccaccaaggaatgtgatgctcaggccaactacatggcaactcggttaaacgatgcggcggtcgtgctcctccgcgacatgagcgagacgcatccggacttcacctactccttcttcgacacatacaccgcggtgctccagtccattcgttacccagaggcacatggtacgtatgtactccttccattttaaaagtatagcaaacctactatactccctcttccactttttaatatataacatcattgttttttaacgtgatatttgatcattcgtcttatttaaaaaatataaatattatttattttgttttgacttattttatcataaaagaaattataattcgaacttatcctttcacatatttatactaaaattttaaataggttgaatgatcaaatgttacgtgaaaaagtgaattgtgtcatatattaaagaaaaaggaggtagtacatatattagacggcaccggggtagtactataaatctatacaggaattagattactatatatattaaggtgaagagaatatggtttattaggattaagattctccacatttgtcactttattcagtgattttgtttttttaataggctataaggaggttaaagcagcgtgctgtggcctaggagataacaacgccatgttcctatgctcgccggcgagcgtgtactgcgacaaccggacgagctacatgttctgggacgtcgtccatcccacgcaggccgcggttgagaagcttatgaagattgcgtttgatggatctgcgccgttggtttccccgaaaaatatcaagcagctcactgagagttaggcattatataaagccaagagtacgtgtctactggtactactatactatactactattatcaccactggagaaattttgaatcattaatttaggagttatatttagtgccagtaactaacgtggtaaagtaaacaagggatttgctagatttgaggtgactgatattaatttgtaaatttacagtctcctaaaattacacattttgcaaagtttaaaattgcatagctatacaatgtgaaactttacttattttaactatgatttttgttgttatatatatccatggtttcactttatttttctccatgtttgatttttttcatttaattatgtattgtgtataagctataagtttatttcattcaattttgtaggttagaataatttattgtacaaccttttgcctaaagaaagaacgtcattgtaataaaaaaacaataggatgatcacaatcattagattatcgtacgatggaggagaaaagtcaccaaaccttttaaaaatttgaggtaccggaaatccagaaactttcaaatatgtggtctagatcagagtactgataaagaccattggaaaagagtagagtacatcactagtttctaaggcttcgttcgtatgtgcgagtcctgatccggttcatgttccgtgcactggaagcgtggtcccgcacacagtaccaaaacgacggcttgtgaggcgacgttaacggcgttaacggatgtgagaagttgcctttgcgcctcggcttttccgtcggagttagggcatccaatgctctcgatccctctttcttcctcctctcgctgttgctctcttgcttccgcggtcgtcgatgcgacgcaggcctggaggagaatcgattcccctccgctgtaggctcccgtcctccccgattctcgccagccaccctcctcccctttcgactgtggcttgcaggcccgtgcccccccccaatcgattctcgtccgcgcgtcgtcttgcggcagcggtcggttcaaggtgctcaaaatcggggggaagtggaagagccccacgcctgtcgagctgtctgcgtcgtcctcgaggggagaaaaagctggccggcgtgctcgctgtgaagcagcaagcatcggcgcccatcaggccgcccatctttggcagtctggctgcctgtgtgctcgtcctctcggcctctcaggtcagacagtgctggcttgaagagtctcatcaaggcatccaagctggcggagttgaggagccagctctatttcaggacgagcgtgtgcgtggtccgatggagacgagagtgaagaagcggaagcaagagcgggatctattgtcgatccaagaggaggggacgattgttcaatcccctcaaacaggggagatctctgtccgcggcgccgatctagagtccggcgaggactcctccgactctgtcacctccgacgctggcagcgccaaggctgctcccgacgacgtgcttcatatcgcgcatgccctctacaaggtttgcgccaagtctcctagagccgtcatcgactttgttcgaagagtgagccctgccaccgtcggccgttcgattgattgggacgtcgtccgtgaggaagagtcatcgaaggtattggtttgtattaatttgttcatttccgattcaattttgtttgacttgcacgtagtagatgggcgatggccgtagccggtggaccgatatggaggttcgtgtgtttcttgagagctgcttggaggagatggcagcgttcaccatcacctccaactcccccaagccgcaggcatggcagaacctaatacacaagatgtacaccaagtgtaagaagaaggtgaacaaggctcaattggagtacatttgggggcagtgtaagaagcggtacaacaggtgggtgtggctagaatcacatgcaagcgggctgggtcgtgatccccatacatcagccattgttgccgatgatgagtggtaggaaagcaaaaatgcggtacgtacacttgacaataaatattttgaaccaacaatttttcctacaagaggtattatctgaaatttagtacatgcatgcagttataaatacagttttgtgaggtgtaataatttttttgttcaagttgtgtgtgccaacaaatgactagctgcagtaaaatggaaggattgtgctcacatatgtttcatagttgttactgtcatgtcgtttttagtaatgtgtgccattcccttgtatttaagttaacaaaatgatgtttacactatttaccatgaactgattggcaatgattgcgagaagtaaatgatcttgtacatgtgacattcaaaagcattttaacagattcacatgtgtttaattgtgaaggatatagcttacacaatgtagcattctattagcttatgcaatgtagcagtcaatgtaacatggtaatgctcataggttttgttctctgcataaacaaaatctatatgcagtgtatcagtaaattaggaaagatcttgtacaagtcatttaggaacatgttaatacatattcaactagctgtacacaccttctttctgatgtatatagagagaatgaacaaaaatgtgctcatctacaaagaatataacatatgcagtttatcttatgtttacaatgttcaaactatctttctttcattctgtcagatgtgtggcccattgtaacatgtactcctgattatatttgataacttggtaccaatgtgcacatttactgccagcattttagtagtaatgcacattggactgcacatattcattacgttcaatgtttgcacaagcctaatgcacttgccttgtactaacttgtttttactgtctacttatgttgcagcaaaataaaggtgtcttaagcttcaggaatgatcctctgaagcacattgaccttcaccacgcggtattcagtgggcgcacagttgtcggaaaccactccgccgtcgcaggggcagccccagccgcaccgcaaggagcagttcagtggcagaccatcgacatggcgcagctcgctgctgcttatagaccaccacctccaactccacccccaacggcagcagaccggggcaagggaaagaggccagcagcaaacactcctgcctcagggagttcttccaagaagtcccgnnnnnnnnnnnnnnnnnnnnnnnnnnngaggattgcggacatccgagagcagagctaccagagtcatgctgcttagatggaagcagagaagtctatgggccttgatgcgtgcatggagttggtggaaaatgatggccatgaaattggaggaagtgtgtggtatgctgcttgtgcgctattccgtgacccattgacctgcaaatgctttgttcaactcaaggacgcctctaggcgcttggaatttatacgcactggtggtactggacagtcatctggtggcaccaaactgtactttactttgagttgtgatgtgcgatgttttccaaataaactagtatttatgtttagaactctgtgtgctaacaatttttacattctgtgagtccctaaacatttgcggctttatatccaattcgagcaactacgtattccattgcattgcttttatatccaaataattcttcgattgcatagatcactgccattattaatttctatccttttgattatgacaaacattgcgtattctccggttctcatatgttaaaggaaatcggcgatgagttacggcgcgggtggatcgagttggaatggaggcggtcacacaagcagcaaagaagaagatgccatcattgagtacgtggctgctacccttgatttcaatgagagggcaccaaggagaataccggtgcaaaccggtatcagttggatgatggacacgatggcaaatcgaagccaatgcagggcaatgttcaggcttactgcggaggagatacacaatttgcatgatctattggtcacttcttttggtcttgtaggaacagcaggggtctgttccatggaaaagcttggtattttcttgtacacgatgggtggaaatcgtccaatcagagacgggaacaatcggtgggtccgctccaactcgacagtgtcggttcacttccaccatgttttgcaggctatgaatgatctcgctgggaaaatattgaaaccggttgatcccaacttcttagattacaaccctcagattctgcaagagaatcctttcaagcctttctaccaatcagtgggagctgtggatggcacacatattccagttctgcctaatgcagctagcgctatgcaacacaggaaccgtcaccacataacaaccagaaatgttctagtaatatgtgatcatgatgggagaattattttctgtgatgctggctggcctggatcagttcacgaccaaaggattctcaatgaggcagtgcaggcttacccctacgatttcccacgggtaccgttaggtgagttgtatcagtcaatacacttttttttattgccaaatgtcttgattttatttaattctacacatgtgcactaatatttaattctgcgccgttaaccaggcaggtacctacttgtcgactccggatttcctaccaggatgggattccttgcaccgtacccacatgtacggtaccacagggatcaacttgcggtcgagggagccccaccacccgtaggacgggaagagactttcaaccatcgacactccacgttgcgagggatcgtggaaagacaatttgtcatcgcaaaaaagatgtggaaaatattgaaagaaatcccttattaccgagatgaggacatccctgcacgcatcattcatgcagctttcgctctacacaactttaggttggatagtaaagatccgacctatcggttcactaatgctctctacaacggcaatccagtgccgctgctgaacgattcattcgaccatatgtattacgcaacaaatagcgaggccgctatgagcatgttgcgtgactgtattgctgatgatgcgtacaataactaccattaggtaggtgatgttacccataatgcttgtcgtatgttcagtacttcaattttcaagattgtatggtttaccatttatttttataacgttaacaacaaatttgatgcaccgaatcttgtgttatttgtttcacaattcatttttttcttaattcttgcgttattatttcagacaaaaaattaatcaatgttattgcaaaatttatgtccgaatcttcacatattatgaaaattattatggtaagaaatactgcgtcattacgaaatggttttctgctactgcatagcacaattgcgaaattcaatctacatacaatctattatttcaaacgaaactacatgaaattgaatccatatgaaattactactgtaatgcaattcccatttcttctcaattttttcaaatcggggtgtgttttcttgtgtgcatctaccaattcctcccacgcatttacaccccctgcagcgcatccggcggcaacggcagccattgtcacgcccagaaattcccgaatagaattccaagcagaatgtgcattaaaacccccgtcgaggactggccggggtacacaaacgacaatgttgacatacagatccatgtcttacaaacattataaaagtcttacataaatgcagcggaaaaacaaaagataactggagctaatccttgacttgaactacagcgggaacaccactccacaggtatcctcgacggcacggacgaagcctactcctcagagaacccgccatcggatacatactcgagctctgggattgggggaaaatagagcaaggctgagtactatccactgtactcagcaagtcataccggaatgggggggtatgatgcagggattcaacaagggatagctaaacaggttcatttgcataaatactggcatttataaacaggaattgaatgcgaaaacagttgtaataattaagcagaattaatcgtccactatccaacgttacaccacgttgcaacaggcccaatcatccacctataccatccaatttcattagactaaactaaggtgagtctaatcacggtgagtctggttgaccgcccataaccgcgggcacggctattcgaatagttttactctgatcagaggtgtacaactgtacccacaagacacagccccacgacacgtttccgtgcgccgacatgccaccacgacataccggaaagaggtcgtgacaggacccttcgcataaccccctctagccaagcacaccacacctcaggtttcacccccgttcccagcgggcaactggcagtcccctctcgtgcctaggtgaatccgaaagcgacagaggccgtcgcagggcccgccctgctccatcacgcccacccttgcctggatgcgtcagctagagaaaagctacactacaagcccagccgttgcccacgctggcttgtggtaagcacgataaattcttccagggtttcccgcgaaccggtccttaattgctatgggcgcgactagcaaaaccttgcacccacagcccaccatgtgattcattttatttaaccaacaccagagcggtggtactaatccaacattatcatataaacctatagtctaggttttaaatgagttttccccattgtgtgctagttgaactaagcatggctaagcaattcctagtccaaagtctaatcatgttataacccaagctaacaaaggagcatggtatccaaaaagcatagctgtaacaataggtaaccatcccatagtataattgcaaaacaaatgcggtatttgaaagaaaacattaggacatttgcaatataggatcaatatgatcaagtgacaagcatgacttgccttgctctgctgctggaggaacctcggcgactatttcgaagtacaccggagcgtcggaagagccggaatctagcgacatacaaggcaaacaatgcaaacaggctataagactactgaaacagagaacaaaaccatttttaatggattctacacatttttcttgatttactgagacttgaatgggcttaaacggagctcggatgaattagttatgaattttagaagattcaatgtgtttattactataacaaaaatccttaaataatttattgcgcaatattttccagggctgacgtcagcacgggggaggcgcggcgccgacaggcgggccccactggtcagcgactcaaggggggcggttcaccgtggaccgggaccacgcgggtggtccaccgccggtccacgggaccgacggcccagatcgccctcggggccgatcggacgggcggcgatagaggcggccgccgggctcggctcggcatcaaagccgaccggccagccagggctagcggcgacggcacgcggccgacggcggcggcgaccggcggcacgggaggcggcggcggcggccgaaggcgacggcgcgcgacttgaagcggcggcgcgacactaggggggaggaaggggaaaagaggggagggatgcctcaccgagggtggccggcgcggaggaagacgacggcgaacggcgacgacgagccacgggaggacgacggcaaccgacggacgggattcggggtgccctaaggaaggagaagagagagattagagggagggagatgaaccacggcgaccggcattcatggccgaaggcggcggtagaggttgaactcaccggagcgcgaggggatgcgaattccggtgatgaatcccgacgtggaaggggcggccggggtgaagcttagcctcgcgaacccgacggcggcgacggcgcggtgcggcggcgaccctagtggcggctagcggcggccggagtggcggaaacggcggcggcgggtggttgcacggcgcgggagcgatggggagcacgagggagttcggcgagatggggaaaaagcgagagggggcgacagggaagcttaaataggggaggggagtcccggacgtggccggtagggcgagattttgccggccaacgtggggagtgggggaggagagagaggcgggattcgaaaatcgaatcccggccatctcgggcgcgggtgcgagcgcgagagagggggaagtgggtgcgggagatgcggcgcactcgcgggtgtggccaacgcggcccggagaaggcggaggcgtggacgcggcggcggttgcgggcgcggcgacgccggctggaggaaggagacgggcccgacaggtggggcccacctgtcggcgtcccttggagagagggaggggcggtttgggccggcccacaaggaggagggcgcgcgcgcggcggggtggaatgtgccgacggcccaagaagaggaaaaggagggaaaaggaaaaaagaaaaggaggaaaagaatttccctgggatttaaaatattgcatgctcgattttaattggttaaaattatttcgagagctctgaaaattccactaaaaatcttgttagtgaatttcgacatgtagaactcaagaaaaattctacatgccaattccgattattatttgcattgatttaatagggttaactcttgctttgcaccggtattttcttagggtctcttattaattcgattttaggcttaggaggagaacttccgggtgtgacagccatccttctctcgacgacggaaagtgtcggcgctccaacggcgcggtggacgccatctcgtccgtcaactgctacagtaatatactacagtagcagctacagtactcaggttcgtaaatccctggaaagcttccaaacttgctcatacgaacagagcctaaacttgttcgtttatgttatctgttttcatacaatcaaaaatagatgtagttattaactggttaacgtgtcatttcagtctgaaattgcacggatccctctaggattctacatggtgttaatgtgccacacggacgctgatatagcatcactactaactctacactgactgaaatgggtcccacttaggaatttccttttccttcttttcttcttttgtatttttccttgtccatcttatctcctttttttcccctttttttctcattttccactacaattgttgtcgtcaaggtcatcgccataaacttgtccatgttgtcattgggatgaagggaacaataacgagtggctcctctgctttgttgtcacctccacgagagggggatcatgcacggtgtcgtctacatccttgggagctgttgtttggtgtaggggcaaaggtccgggccgagatccagacccaaaacaccatgcatggcacgaacaatggataccgaagttggaggttgtccctagtcgccatcaccgagttagcccttgctgcgggccctcgagctcgcccccccccccccccccaaactcttcaccctatcgcctctattgagctcgtattcagtcaccacagatgggctctgccatggtcatgggccctcaagcggtcacccgggttgccaccatccttgagccccttcatgtatatgagccgtgcatgggaagaggagaagattaaaaaaaaagaacaaaaaacagaggaaaagaaaaaaataagaggggaaaattgaaaggaatttccgtgaggtggcaaccaacaccagttaggataccggaggcgtcgtagcaatttgggactaaaatgatatactttaacaacttctaagacctagatatgtattttcagagcatggggcctagatatataggtgaacaaatttagcaactagtcatgcactttatatatataagctaggggcaagaccatataggtgtaaatggccgttgtgaaattcatttacataagggtattaacaagcactattgcaaaaagtcacatcgtcacatggtttaaaactggccgccgcttacacgtgcttgaaccgacaaaagtacaatcttaagtggtactgactagcatgaatatcacaacctactgtgatgagtatcactccaacaattgtactattttcatccgtaagaatacaatacaatttgcattattttagaaaatttactttagtaaagattcctatagtgtcatttttatctcagttgacatttgatcatgaacatcatgagcaacataagtcaaccaacgcatatactccctccattccataatataaagcacaaacactttgtaacgtcccgcctctcccaggccgggcccgcttacatctgatagcttttataggttatagactgccctcacagaccaatacaagtcttttctgcatactttgtcctcactcgtgcgcactcgggaagaatttcccgatcagtcacccatccctaaattgctcaaggccaaacacgcttaaccctggagttctttggaaatcggcttccggaaaagaagttgcaacttgttccaggaacgtcccctcctggccacgtccgtgcgtccagtgccagcacatgtgccatgctgtgtgaccactcccggtccacaccagccatgcgcaccatgcctgcgcaactgcgacacacgcactcgtgaaaccgcgagagtcggctctgataccactttgtaacgtcccgcctctcccaggccaggcccgcttacatctgatagccgtttacatctgatagctttcataggttatagtcttatagactgccctcacagaccaacacaagtcttttctgcatactttgtcctcactcgatcagtcacccatccctaaattgctccaggccaagcacgcttaaccctggagttctttggaaatcggcttccggaaaagaagttgcaactagttgatatgagtattctattaatcctattaagccctgggctgggatgttacacactttttttagatgttccataatataaggcatacatgcatgcatgtcattaactatgacatattctccattaaactactattttttaaaatccttcactctcacattctctaactctattggatgcatgcattacatttattaggataatccaaactacaagataataataactatttcttggtctttggattaaggtggttgtgccttatattttggaatggagggaatatctaactaaaataccaagagcaccacaagagaaacacttacgaggtgttgggcatgacaaagttaggttgtaggagctaaacctggtctctggttcctccatgagaccactttatatggatcataccgatatgtagaaatgaggctgctgccatggcattgagtggcagggtagcaattaccaaggctcaaagcacccaatgccaggtggcctaattaactatcaaaaccttagctataattattaaaaaatggagcaaaaatgttcagaaatgaagatttacaagaaggcattttggtactggtctcccggacttgtacttgaagggaatcaaatggcttgatgagaaggagatgggccacaggagatacgatgacctacaaccagtttcataattcctattaatgaaagattgttatcatttctgattagtgcgtgaaatcagaatctaaactcctttagatattaagtgttgtaacctgagttgaaccaatttagatacttgcatatcagcgaatgggaaagtacaaaattgaactctaaatttcatttgttgttaccggtaacttgtaatatggtgcagtcttgtggcgaacaccaaatccccaatccatttcttctactccaattttcataacaattttgaggcttcatactacactagactcgagtgaatggtggaaattggtggagtctgtgtttgaaagggacaaaaaaccaaggaagaaggaaggttgtttctgttgcaagaaggggatgatgttgaggaaggagcaacaatctacaactacaggagggttcaggaaaagccacaatgggatgggcaatcaggagacagatgggtcgagatgggacaggtggaagagctaattgtgattggtatattggtagagaagaaatagaaaccctgtaaagaaagctatctttatataaactttgattgagagcaagccccgtatatggagttaagtgcatttccaggctccagcaattaatatcccatattttggactccctaaaagccaaatggctccatgtcaagcacaaacatgtattgctcagcctccatttctttttctcttctatataaacatacgctttatgtataagcatagtttaacaccacacaatagttcaaacatgaatatttatggtgcaaagaatttactatattcaaattaaaaatttcaagcaccataatttaaattcaaaattttcaactatggatgtgtcaaataatcctattaacatggatgtctccctcgttgtgtgatgagtatccaacatcagtagttcagaactatgcatgacaataaatcactgaccaaaaaacaagcatcaagcatcacgtattcctgaatgttaggaatgtctcaaatgaatggccatatgtgtagcaaaactagcaaccattgtactatccatgagattcctgaatctcttcgaaaaccttgtagctagccgtcgacaggctatagccgacaacggtatccataaagcataggggtcattggtactaggatatatgcgagattgtatcaagaagacatgggacaaggatttatactggttcaagccctcgagatgaataaaaccctacttcagtttatatgtattgctggaaaaagtaccacacaggttacaatgtgggaatctgtaaactactctaatctaccgactagaacccaccgagtacatctcaacgagtggaatacaatgactagggctttggctttctccggattatttttcagtgtggctctagctatggcttgtgatttgatgccctaccttcgtatggggccttgtatttatagcagtaatcgctttcttcttcaagtagatctcgaagatcacgggcatggtacgaacattggaaaacttatcttctttggatcggactgacacctgctatcccacaaatatagtttccttccgagttcgtcttatctcctcatctaagtataccttctcgtataataacattaggtgtgcggtatctcaatacaccacgaactcaagtataggaggtatgccttattcgtagcactgacgctatccttcacattatcacttctatagtacatggtggggagtgggttacgaacaaaaatactatgaatgaacccatccttaatgatcgatgcatgaagttgtctgtctaactcaattgaatttatagagctgaaaacggaaggttggcatttgtcatttggccctaggccatcatgaatcatccaccttaacaactaaacttttggttactaaccccccaatatgaaggctgaccaaatacttctattgcttaatgtgccaccttcctaacttgctctaacaactcaatagacccaaagtttttatatgttgaaatcaaagtatccttgacaacgtagaccaagaacaactatatctttgttatcataccatgcatctggcaagccttataccatagacttccgagagcaagcaagcaagatatacacgaacccacaccatatcacgaaacatattgatgaacaaacattccatgccattctacactgccatggagataaccacacctgaaaccatgtgttgcactagtccctatctacaaatgccttgaacatgtcagaaaagatgccaggcatagttgcataacagatcaggaagggagcacggtggggcagggaggggagggttgcggactgcccaacttggggatcctagggcatcaggcaaagtaggcttggagtagggtagagtctccagtgacgctgatgacagcaatgaacaatgtagccgggcttcttttctaagatggtgtagcaagatgctagtgtagggcaggcctcaggcggagcgggagcaggtgtcgcagtcacgcgggatcaattcagcacaggcacgagaccagaatattcctctttcacgtagaagctatcgatgggggttatagtttagagctccgggattaagggatatgagttgagatttgggtggccttcctattttttaaagggttctctagcaggggcattgttagacctttttttacatcagtcaaaaatatttatgggttatgtttagaggccttgtgtcacaccccgaagttttcctcccaagccaaaattttaatttttaaaacgaccctaagaaaatgcaggtgaaatcaagagaaaaccctaagaaagtaatgcaaataataatcggatttgacatgtggaattttttcttgagttctacatgtcgaaattcattaacaggatttttagtggaattttcagagctctagaaataattttaaccaattaaaattgagcaagcaatattttaattccagggaaaatcctttttccttttctttttctttttcctctctttttcctcctttttttcgaatgggccgtcggcccattccctccttcctccccctcctccttgctgggccggccgcaggccgaggcccagccaggccgcccgccgccctcctctcccggggtcgccgacaggtggggcccacctgtcgggtccttcccccacctcccgccgctcccggcgcgccgccgcgcccacgtctccgcctcctccgggccatgtcgaccacgcccgcgcgtgcgccgcgtctcccacgcccattcccctctctctcccgcccacgcccgcgcccgcgcccgagatggccgggattcgattttcgaatcccgcctctctctcctcccccactcccccacgtcgcccggcgattcccgcctctcccggccacgtccggtcccctctccccctatttaagcatcgccgtcgtcccctctcactttttccccatttcgccgcactctctcgagcctcccatcgctcccgcgccgtgcaaccccttgccgccgccttttccgctactccggccgccgctagccgccgttagggtcgccgccaggccgcgccgtcgccgccgtcgggttcgcgtggccgagatccaccccgtccacccttcctccgtcgatgttcgtcgccggagccctcgttccctcgcactcgggtgagcaccacctccaccgccgccttcggccatggtttccgatcgccgtggtccatctccctctctctaatccctctcttctccttccttagggcaccccgaagctcgtccgcccgccgacgtcgtcctcccgtggcttgccgtcgccgttcgccatcgtcttcctccgcgccggccgccctcggtgaggcaccccctcccctcttttcccctccctctccctcctagccgccgctttagcgccgccgcccgttagtcgtcgctttagcatcaccgcccttcggcgccgccgtctccgccggcggttgccgtcgtcggcaacgcgcgtgcgcgtgcgcgcgccgtcgccgtgaccggtcggccggctttgtgccgagccgagcctagcctggccgccgccgcaccgtccgatcggccccgggccgatccgggccgtcgatccccgtggaccggcggtggatcacccgcgtggtcccggtccacggtagaccggccacccgtgcgccgctgacatgcgggtcccgcttgccggcgccgcgccccccttgatgacgtcagccctggaaaatattgcgcaataaatcatttaaggatttcttttataggaataaacacagtgaatcttctaaaattcatatctaattcatccgagctccgtttaagcccattcaagtctcagtaaatcaagaaaaatgtgtagaatccattaaaaatggttttgttccctgtttcagtagccttatagcctgtttgcaatgtttgctttgtatgtcgctagattccgattcctccgacgctccggtgtacttcgagatagtcgccgaggttcctccagcagcagagcaaggcaagtcatgcttgtcacttgaacatgttgatcctatattgcaaatgctctattgttttctttcaaatattgcattgttttataatagtatactatgggatggttacatgttgttacagccatgcttttggataccatgctcctttgttagcttgggttataacatgattagactttggactaggaattgcttagccatgcttagttcaactagcacacaatggggaaatctcatttaaaacctagactataggtttataagataatgttggattagtaccaccgctctggtgttggttaaataaaatgaatcacatggtgggctgtgggtgcaaggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcagggcgggccctgcgacggcctctgtcgctttcggattcacctaggcacgagaggggactgcccgttgcccgctggggacgggggtgaaacctgaggtgtggtgtgcttggctagagggggttatgcgaaggatcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcacattagtttagtctaatgaatttggatggtataggtggatggttgggcctgttgcaacgtggtgtagcgttggacagtggatgtttaatactgcttaattattacaactgttttcgcattcaattcctgtttataaatgccagtatttatgcaaatgaacctgcttagctatcccttgttgaatccctgcatcatacccccattccggtatgacttgctgagtacagtgggtagtactcagccttgctctatttcccccccccccaatcccagagctcgagtatgtgtccgatggcgggttctccgaggagtaggcttcgtccgtgccgtcgaggatgcctgtggagtggtgttcccgctgcagttcaagtcaaggcttagctcttgttgtctttcttttcttccgctgcatttatgtaagacttttatgatgtttgtaagacgtggatctgaatgtcaacattgtcgtttgtgtaccccggccggtcctggacggggattttaatgcacattctgcttgaaattctattcgggaatttctgggcgtgacaccttgctagagtcgctcttagatggataaatgggcaagacaggtataggcatgaatacacatgcctaccctcttgcatggagcgctagataattggacttagtagcatagggtatggtatcaagattcaacaagtcatgtcacgtgcacatgcacataattagtgaagcccattagcatagaaggccaagataaaactaacagttagtgggatttggattgcaagtgtactatagtgatactatatgttcacgagagtcctgtttggtccatgttaatcagtctagtgcgtggcttgcaggaaagtacgaaaggagtgacaagttttccagtggcgcgtgtctgagacagtgcttattatcgaaaaaaaagaacaagcctggacttagtgcatcatcaattaaggctgagttctttccccagttttcccaactcatcttccttgtttttcatccgcatacttttcaaattgctaaacggtacttttttaaaaaagtttctatacgaaaattgcttaaaaaatcatattgattcatttttgaagaaaataattagctaatacttaattaatcatatgctaatgggtcgttccgttttctgtgcgcaggagatgggtttccaacccaaatcaaccaacacagcctaaatatgagcaataggatataactaggatgtttgttggatgtacaatgacattaagtaaacactagtacagacccctctattggcaccggttggaaaccgaccatagatgttggttttatagtcggaaccaatttaacggcaccacaccaatacccaagggcaaaggtgacggttcacgacacttatagagattatagtggccagttcttgcctaacaaccagaacctatagttttcaatgaaacaaaaaaaaaaaagacagccggtggaggtagacatacacggagcaccagcgctcgcggccggcggcaaaagtgtcgagcgatggaggctgttgcacaatcacgaaaacacctgacaaccacccgagatcccatccaataacatcatccccatatatatatataaaacacgatcttgaaacacacaaaaacacatggcatgaaggcgcagacaaggccagtgatgatggggccggtgccgcggctcctccggcgctagtacccccttcggaccagcggcttggtggcagcggggtcacctccaccaaccaccgctgccggaagggaagaaggaaaagggaagaacaggaaagggagagggaggcagcaagggagtagggaagggagaggggaggcggcaagagaaggggagggagaggggaggggtggcgaacgaagagggaaggggaggatgcgcagcgagggagtggggaaggagcgcgaagaggggagagaaggttggggagaaacaagagaagggggagaggggatcgactgggtgtggctctgtgtagtggataaggacatgcatagtggtatggataagcacgttggctagctctggctcggctcgtatgggtacccattttttaaccggtatttataatatgttataggtaccggttcttttaaaaaataacacctataatattggtgcatgtttttgctccggaagcggcacctattgttgcctaaaagtgctggttctatattttcctgtgtgaaaaggactataggtgccagttttaaattaactaacaccaatgaacctatacctatgaggtgttttgtaatagtgaaaagaggctaattaagttataactcttattttaagagctaaaaggtgaaatttataagaacaaaataaaaggatactaaaataattttgattgtgggaaacaatgtaactagattataaatatgtgaaacaaaattataccaaatcatggagtaaaacatatctccatcaaaaattagttcaaccaataaacggtatgcaaataaattaatttaaaacggtgatataaaagctaaatttttgtatgaacatgactttgacttattatcatattaacggtgaatatatattgggttttaagatggatatcaaagtggcgcaaagcatgactatatggctagtatacagagtgagcgaaaagagggtcagacttatttctgagtatttaactatcctggtcattttggccattttactttcattaaacatttttcgtatctgcctcatgcctcttaattttttaataaaaaatagaagaaaaaaaagaaacttttcaaccgaaacacgcatagatactgtgtgggatcacaaagaatgaaaaccgcttgcagataaagctgcacaaaaccggagggagggctgatctacgcacgcattcgcgtgtttctactgttgcgaacattctcagccacgccgataattggctgtgcgacgctgacggcgttctattttaacatttactagggcagttgaccagttaatccggggaaaaaactcctgcatacatgcgcgtaaatagttggacgatccaaaagaacttttgcacgcatgttggagattagtttgaggactttgtaattaattgggtttcgcgtgattactgttaactttgctatattaaatattaagaaatacattctattatactgaaaaaattcaatggaaaaaccttcttatcaacaccttctagtatttgaattttctaatagttgacatcaaaactttgtactttgataaaatttatattcataaactttctagataaaatattttcattcataaactttatacataaaagaaaacatatctgttgaaaaactttatacgtaaataaaaaaaattagattcagaaattttctacgtagataaaacattttcatttatatactttataaataaaagaaaaaatctattgatgaactttatacctaaataaaaaaattacattcataaactttatacataaataaaaaaaatcatatttatcagttctgacatattcgctggatcggaagttagcgaacgttcgctaactaccagtttggcaaaaggagagagaacagatccaccaagcatatactgtacaatcttgaaagtgatatcactgtgtggtgtgtactggtccatcgtccacatgtagacagcgtgcaactcgagtcttgaatatcgccaaattaacctgcgcttgtgttgatggaggccatgtcgtccacacgaccaaactctccaccgatttcattgtagcctccacatatatagcagtactccgctgcgaatagtgggggagcttttcgcagacttctttcaaaaaaagatattcttttacagaagcttctgggtcaacgcagactggccacagcacagcctatatgagctggaatcttcctgccagttcgtctgagaattacacgcgcacatacagaacaacgcggccaagattacatggaaaaaggttgcacatagggccggtttagttgtcaaaataaattttgcctttacatgtcacattgaatatacgaacacatatttaaaatattaaacgttatttaataacaaaataaattacagattctactagaaaattacgagacaaatttattaagcctaattaatctatcattagcaaatatttactgtagcaccacattatcaaatcatggcgcaattagacttaaaaaattcgtctcgcaatttacacgcaaactgtgtaattggtttttatttttgtctatatttaatactccatgtatgtgtaaatattcgatgtgatggacgaaaattttttgttttgaaaactaaacagtccaatagtacaagctttgctcattagctgtgactacccatgcacaagcttagtaatccctctgtcccacaattactcaaaccctatatttccaaggtggatttaaagagagatatgaatgatcaagatatctctaattaattgtgaagttatatcgatgaataggtaggtaaagggtatgaaagaaataaaatttttagatttgcaaactaatggtaggtaaaagagtaaaagttgatttattttgattttaaattttagaagctgatttattttgggacggagtgagtatatagcatataggaccaccgaaccgcgagacaggcacgtcacgtctccatcgatcgatcgcgcgtcggcgatttgatttagctgcgccttttacatggaaaaggttgcgcatagtgcaagcttagcaatagagatcataacagtgtggctcctgatttagctgcgccttttatatgttctccgtctcgcgcgggcgcatatcgttttcctttgctcgatcggcaacacagtacagcggtgcattattctagctgtttcccccttcctcctgttcggaatgcagctagcagtttggtgcttcacatgctagtatctttgattcctttcgcgtggtcgcgcgtagacataatcattcttaattgatctgatgtacttctctataattttgattaaatttaaagaagcttaatctagaaaaaatcaaagcgcattataatttgaaagggatggatggagtagaatgttaaagtagttttgttccaccaccgttataatatctttatttgttataaccaaattaatagaaaaatattcagtcacaactatgaaatggacctagagacatattgatcgagatggatgaaattgcaagataagagtttttcaggctcaataataatgcaatgtttctttactatatgcatataatctatgcaaaggtcagatgcttaataaaaataatattttctacaaaataaaaataatccaaaagtatttttctgtgacaattaattctataggtcagataatgccacattaaattgtaggactaaaactcttaaatctataataaccagagcagggtgaatagttgcagaaacacctaaatctacatttttcataactaatatttttagaaatttccttgggaagcatatgtaaacgtaagtttagaaatattacttttatatattcataaacaaactgattcatatttaaaattagtgatttgtaatctgcatgcatggaaattaataaatatgtacaaataccattaattttttctactctaaggtcatcttgatataagaaactaattcaactactacaagtccaaaaagtaaataacattccgttcattcagttttcttgacttagtaataattgtgaaggggttgttttttgtaatactccatcaaaatttttcttttaaattttttttttggaatttcaagaaaatgtttaaattcattcaatatctcgtcaaataaaaattttattgagtttttttaaatttggaaatattccattctgttggtccgcaaaaatacctttttttcgcaatttgggaagaaaagtttcgaaatttgcaaatctgttaaaatttagattaatatcattcaatttttcatgttcaattttttgaaattcataaattttccaaaatattttttatttttgaattttgggacaaaaatttactcaaatggagcatgcatgcaacttgtcgtaggggtaaaaacgtcatttgtaaaaattttagatgccaaattgaaatagaaatgttaaattaaattaataatggtcatattgcgttctagcaaattactatatactacaatagaatatgcggcatcagtgtccgtgcgtagtggtgtttggaaaaaactacagcgatttaatttgtttcacacaagctcgtatacatatcgccgtccaggattggcagtatatatgtgaacacgtatcccaagagataaagagaggcggaggtatacgtacgcgccaagccaaataaaatcccgtcaagtcccactccatatacgctcggtcgtttggacgtcgaactatcatatatctccatcgcttttgctattgccagttgacatgccgtcttctccgaacacaccaaacagtcaaacaccgcatacacacgcaagacaacaacatacgttaacgttgtgcctccaatctcccaatcgatcgatcatacattcatactccctatctagctagctagcctagttagctacgtgtgtaccggggagattaatggggatgcatgtaacactcaagaagcaaattagctagggaagatgtgtatctcaaagagtaatagagtggtattatttgcagcacataggctactcgaagctctcagcaattcttagtttcataactactctatatggctgtgttcggcagcctatgttaggaacacattttctgcacacgaaaaacggagtggtccattagcgtgcacgtaattaattaagtattagctattttttttaaaaaaatagatcaatatgattttttaagcagctttcgtataggaactttttttaaaaaaaaacgcaccgtctttagcactgtgaaaagtctgcgagcaaaatacgtgggaggtgagttgggaaaattggaggaaagaacacagcttgtatatgtagttctctgcacgtgtttgtgtctattttacgaaatatcctatagatgcaagtcttcacatgttacatacacataacatgtacattaattaactaacaaatattcacaaaattctaaaaaatatgtatgtatactttcaataaaagaatttgtaatagtattatatccacatatgaaattccatcttcaaattcatcatacatggaaaaaaagacaacattttgacaaatttatagtcttaaaactatcagaattttttttgttgttacagccaaaatataatgaattaatttgtggttagatttatacataggtgtaatactatccatagtatatgcatatatttttttttataattttagataatatttattagttggtatgcacggagtgtgctgtgcacaggatatgttcccaccttactataacaatttacatctgacatagctccatacatattatagtatggtaatttttttggccttttcagtacgatgagtgtagctcaactgattatgttccttgtgatggaacctacccacccaaattcaagttccagacttgatatagatgagtttaagtcctatacttgacacgactgctcgcatctatggctaattagctttttaaggataggcaacttaccatcggtgattttatttgggtgctcgcatttacggctaattaggttttcagtgatagatgacttacccgtgggttcaagttttagacttagacacatgtgtttgtatgtatggctaattatattttcaatgatagacgacttacccattaattgatagtgaggccctattgatgacttcgtcgattttaaaatatgcgacatgatgactttatcaattttaagatataccggttcagtctttagatatgtttataaaaatatccgcgtatttataagcccttggatttgtagtatgttttaaaaaagaaatattttatcaccaacatataggaactggataaatctacgtgcatggtgcatctatgattggtgtagagaggaagactcgtttagcagtgtttgcagtttgcataatgtatagtaaatactcggtgcatatatatgcacgcacacgttttgatagctagtatcttgtagtttagcttctaggaaaaatatcaatatttatgggtggacgactgaaaaatgcttgagttgttctcgctatggtataaagtctgcaggtagcgcgcgtcgtctccagtccagtgaagaaagctcacgcacgcaacacgcacgcacccctagctcatgtgcaagacgagccggcgagctgtatacgtagcagctggactctggagaagcatcagctaagctgtacgtactactgtagttcgatcgatggatgctggtaataacgcaatcgctgcggcgtccttcgccatcgtcgtccttgtcgccgccgccgcctcgtctttagcggcggcggtgccggcggtgtacgtgctcggcgactcgctggcggacgtggggaacaacaaccacctgctgacgctgctcaaggcggacttcccgcacaacgggatcgactacccgggggggaaggccaccggccgcttcagcaacggcaagaacttccccgatttcctcggtgcgttatcgtcgcaagccccccacccccctcccccctttcttttttcttctcttttttttctttctcctccctcttccnctctttcaatctccccctttctcttntttctttcctctttttttcttctattatctatatatattaccctctttatttctac

SEQ ID NO: 66613 - DNA, 72420 bp, Oryza sativa
taacgagttaagacgcgatagatgtgaataaacgtcgaattagaagatcatagtaaatatccatcataacactataccaacatacatcatatatatgaatgagataaaccatcaaatatggttaagcataatagaatagagatatcgagattgcaacgtccctagtaagaatatatatttaatagctagtaggacaagtagttacaccaccagcgggcgaaatagaggtgatagagagggcgaaagatattgcgaactattaagtatacataggaaacgtctcatcgctgttagtagattatgcaatgagagggagaggaagtcgcgagggaaggatactatcgattttgggatgagagagtataaaatagattgaatagcagaagaacaaaaagtgggggatagaaggaagtattaagagaagattttttaaaagaagatctgtgagagaaagacgaaatattggtttaataggccgaaaaaaagggattatgaatgtaatattaccaccggttgtaataaaagggagtaagtaggcagacggtgggtttactgctagtaaaaagagcgtgaggtgagcaaggcggataagacccaatatcgaacagaacaacttctccggatagataagagatgtacaatttaagttggtatccacggaggttttaagacggccccctagtggtacgtgtagtgatggtgcaaaaggaccggcaacctcctccccctaaaggtccaggccttgacaacaaaactctcttcgctcccggggggttgtctgtatggcaaacccacatttaaattttgtttcacggggaggaagaaaaaaggaataagatgcgtgtggggcccacatgttagtgggccccacaaatgtgtatgtgaatgacaaatgggtcccacgtataactttttaattgaaatgccacctaagcgccacgtcaacgccacgtgtaaaaaagacccggtcaataccgccacgtcagcgccacatcagcgaaaccgccctctaaaaccgccgagggagtcaaattgtaccgatttccatagtttgggggtcaagatatccggttctgtggtttagggtcacggattagattacaatcacttttgagagtcaccaagtgaacttattccttttttttaagggtgaataactaacatggtcactgaagtttcgctttgggctcagtttagttcttgaggtttcaaatcgtccaaacaagtcctccaaattaatcatttgggttaatatagtcctttgaccaaaaaaaaaaagccatgtgagcatgctaagtcatcctcgcatgcagcggtatgaacaaaatgaccattctacccttatataccatataaaaaagaaagaagataaaagaagataaatgtttcacacgtatatgatcgttttataattatcacttacgattgctgcagcgatcatgtaaattaacaatgttgggactgggctggcctgttattttttctgtttgtctttttttttctatatggtatataagggtagaatagtcattttattcataccgctacatacaaggatgacttgatatgctttcgtggctttttttttctaaggactatattaacccaaataataaatttggaggactttttttggacggtttgaaacatcaacaactaaattgagctcgaagcgaaacttcataggctattcacctttttttttattggaaaatggagtcgtacaacgtatactggtaaaaaaaaagtccaagtatatttggtcccgtcagagccccatcaatcgaaattgttcccaaaataaaacaagatcagcccaacctggtctatccgctcaagatactgagcagattcaatgagatgccaagttggaagggcaggtcaatctagaaatacagatgtggacatactgcgtagttactgatgataccatgttggtgcttagtatgtggtatatcatgtcagcgccaggatctcgaaaggattatgacagttttggaccggaatgacacactttgtcaaattatgagacctgaatagcacaagtttagagaccggccgtgcactttactctataattcaaggaacaagccatacataacaaaaaaaagtgggttcaaaaagttaaaacaaaatgatatatatctcatcaccaaaccaatcttttgaaccatatggtggaagttacgactagaattccatcgatgctatagaacaatcatgacgatagtatgattcatatctggactaaccataggcttcagggcatctaaacgaatttcaatattgtctcctaggtggtttcgattctgctactgtaactcggatctgtctgccatccatgtcctgcacaacaaagaaaataggcttgttttagcacacactaaaagaacaatgatgctgaaagacatatgagaataagaaaccagccagacttagtgaaaactcacagcgccatcaagatttgaaactgcattctcaacctcttcagcggaaccatacgtgacaaaaccaaatccccttgacctgccactctccctgtcatagatgaccttggcttccaagacctccccttccccactgaataggtttgcgagagctgcattgtcaacaccccaagaaaggttacctacatagaccctgttggcctcacccctgggtgctctctgcgatgattgctcccttggtggtggtggccctgagttaaccctcaaagatctcccatcaagtatctgttttaagaaatgaaatcagcaaattagttaagcacaattcaatgatgttgtataggatataacacaacatatgtccagcaacatgccagaaaagagtaaattaaagtttgttttctagtcatgaataagctaaaagcaaacaaggattaaaacaagcaagcaggttcatatcgagcaacctcagctacagttatcttgaaagaatgcaagccacagcatgcaaaccaaagagatgaaataggagcgcactttatgcaatatatttttagccagcccatataccaacatggagcaaaaataatgacttagaagtatggaagcatatactcacatagccattgaattgctcgacagctgcctcaacttcttcaacactagacattgtcacaaacccaaacccacgactccttccagtcagcttatcatagatgacctgcaacaatgcagtttagcatgatacaatataggaaaaatcaaccaaagccgagtactactcttaaaattgagcaattaaccagaaaaatgcaatcctaaatctttcgccagtcacagaattaatagcatgagcgccagcacaccaaatttaacaaccttaaataatggcaaccttatcgcatccttaatcatctccaaatacaacctcacaatgagcacccgaaataagtttttttttcttaaaagaacgagaatatgcccacactaccatatgcaacccaattgtatcgcggtttaagctaaattaacaacagaatgaatttgtcgtgaactgtaatatgaagcaactagacacaatcattcatcaccacttcaccagcgaccagcggtccatttctggtttcacaaagacagggacacaccagcgagcgactcgacgaaggtggtgtgataggagtacttagtaaggcgagacgaatggggtggtgacctcgaccatctcgacggagccggcctgctcgaagaggccggcgagctgggcgctgtcgacgctgaagggcaggttgccgacgaagaccctcaggtcgtcggagaactcctcgcccccggagccctcctcctcctcctcctcgtcctcctccgtctcgacctcctccgacacggccacggccaccggcacgaaggggctggtcctcctccgcggccatcccgcgacggcgagggcggggagcagcggcttggagaggaaggagagggaggatgaggcggggttggaggaggtggaggggagggggaggaggtgcggggagagggcggtggagaagagcgtggccgccatgggtgaggaggaaaggggatgggatcgatagggttttggggataaggcggagtgaggagaggagagagcacaaactgggaaagaggcaacagtagaggagaggagacgggttttatattgtttgtttatacttgtagctaatttgcccgtgcatgaccaccaaatcttaaaggataattttggcattcatttcaaagccttaagaatctacaattccggctgtcttttgccatcaatttttagatgcttactaaattagccagaccaagaaacacaaagcttatgttgtttcaggatgaaacaccaacaccaccaacagcgtgaaagcctacacgctagtaagagtggtggtgacggaagattcactggcatcaccactgcccacatttaatgtagtatagatattggcttcgtttttttgacatggatgagcaaaaaatactatctctgtttttttcgttggttaactaccgtcaaacatttggggaataagatagtatttttaatagcaggtatatatcttctacttaattttactattgcttccatcacaaggtaattttatttttcacacattccgcatataccgatacaaatataaatttgtatgggcctaggaatcagtaggtagtagctttgtatgtgtgtgtgtgtatatatatatatatatatatatatatatatatatatatatatatatatatatatatatatatatatatatgtggcaacatatcctatgcacacaggccctcacgtgtacacacgtgcacaccaactaaaaaatgtcaccaaaaaatctagaaaaaatcatacacatactttcaattgtattacacctagggttaaaatcttaaagtaaaattcattatattttagccgtaacaaaaaaaaacaaaaaatctgacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgttataaaatccattccaatcgaatattgagtaatcaaatccttcaaatcatagtttttgaaatctttttaaaagcggattaatcggacgaggataaagagagagtcccattctacatgtcaatactgacaacaatgaaatttctggtaaaaggaaaatccgtcgactttctaagtcagggttcaagtccctctatccccaaaccctcttttattccctaactctagtatttatatatgccaatgtgtgaatgcaaaaggtgaaggtaaggcccacaagagaaaagaagacctctccatacccccacactgtttattgtacaaataatatagttaatttgcttattactgatagtagttacactttaacaaaccctaatatatttgtccctcacttttataaactctaaaactgggacatgcaagatgatgaaaggtggactataaataagttaccatccctccccgatgggttgactcctccagccaaacaatcccctagcatctgtctagattcgtagtactaggatacgtcacatccctctaaaatcccttacattaggacatccacaatgtgggagaaaagcaggtaataggcattgaatgcttccttccaacctggttatatacactgtgatgtgaaagttggtattagctgttacccaatcatcacgttgctaccggcaacaaacaaataaaaaatgaattgtagttcagtcacaagctaacaaatgtaccttttgtgcatggagccaccttgttttctccatcataggcttatatatattggggtacagatcccctagagttgagtacaactccaccgggtgaattttatcaaatccatggcatctattgcttcctatggctgagatgaagccatctattgcttcctatggtttgaatgggaattactttatttttttattatgttagtaatggttaagtttctgcctaccaaattaacaaagtatacatgttctcttctttcccaaacacaagaagctacattcatgtaaaaaaaaaagtgttaaccgcatagtacatgcaaacacacataaaccatatacatgcaaaactagaggcacgtgctcagtacggtgtttacaccatggattaatcaaagaatttctgggttatgcaagtaaaattagcttgtatattctcaaattgtctaaatatattgtagacggtgatttgttattgttacaagattaggataaattctttttttttcaaaagagactagtgggaagtgggaactaatggcttcatcccaaccgtcgataaaaaagagaccgtagagattctatcaaatccaccgatggagttggagtgactccaggggatccagacccattgcacatgcccttatacaatagagggatcatgttcgtagtaatgtacatatcatatcttactataaagttatctcccactaactcgttaagcttaacatgcaaagatgccacatcatatcatccactaacaagatgtcacattatcatccactaatccactaattaacaagatgccacatcatcatccactaacaatcatcacatttaaacatcatgcaaacatgttatatctttatagtttttataatttaagagcttttcaaatacaaacatgttaaattatcatccaatataattcacataatgtttcaatgtatatctttattatgttttatgatatcctatatacttatatagtttatcctcacttagttggtgcttaaatgattaatctatggtccaaattatctttctcattttttcctctaattaagtcatatcacatcaattattttccgcctttagataattaatctacggtccaaactatctccctacttttcttcttccataaagtcataccaccttactttttacgtttgaatcaccattctacatactatttaaatttaaattatcataaaccacattattttacttaatctgatattatctagctatcttacacgttattttttttattgttatcatactaaatttccgtagcaattcacggggtttcgctaggtataatatatggcagctgccgatgaatctattttccccaccgaaatatgcacagcgcgcacagcgagagaaaaaagtggcaaaatggagatggaacatggaagggaaaaaaagtggcaaaaaaaagtggcccatgcaggtctcgaacctgcgaccttcgcgttattagcacgacgctctaaccagctgagctaataggccttgctgtgcatttgaactttatcctactaatattggtagttccctttattcatttaaatacaattgccacaacactacatttgtctaggaaaatcacaacagcaccggtctatgaaaatcacgtactacaaagtgctcagtagtccatcaccaacaacagtggacatcaatcagtacataagaatgatcggctaattcgaccaaactgttcaaatacaatgttgagagaattgcttttacatgcataaacaaatttggccaaaaaaaagaaatatactgaaagcagcacaatactgtttgccatgttaccgcctacatcgaaaatgtatcatagtctacagcaatacactaacaaatgccctgcatggcatggcaccaacgttctgcaactccagcagtggttccatatagcagtggacaagtctgcagtagcagcacacggcgtatgctcctgcacctccatgagaagggtaaagaagaggaaaagactccaaaacacaaaggaaactcttaactcgataaaatctcaacccagttattaactttgagaggttctctgaaacttacccacactcagattgagcatcagagcacacgtgcacatcaagtcaagatcccatgtatagcatggcttgcacaattgcatgttagggcttttatgatctataaatcagcaaaagcgaaaacttccagctaactgtaaatcgccatagtagtcatatagcttaccagacaggttgatactagaagaccatgctgagattggtttataggtaaacttaagttttatgttagcctattttgagctcactgaggaggtacaattttctctggggaactatgtgcagataggaacgaatgtgaaggatgacacgatccacatccttaaagcaagggcaagtaacttctaggcttttggttggcaaacagggaaccaagttcttccacacgaactactaagatgaagcaggttgcacgagaacacatacaggaagtctcaactgtgaactttcaatacataggtttagaacatgtaagacggggaatcaacatagtcccagaggaaaatataagtaaatgctgtatactagggaaataagatggtctatggcatccaggcaggtccctcttaggcaaagcttccaggttggggccatactcttggtcatctggtttgggaaggggctccaataagcaggctccatacttcattggtcttggcattcttttgtcttggctgtttttagtaagggaggtgggcatggggcaaaggtgaaaagaacaggtccatcagaagatagctgagctgggttaaatgtgtttaaaaggcagaaatgcaataaggagcaagtcttgatcgcatgatcattctgttcatttcaagacaaggtggatgaaccatacctgttgcatttgtcaatctaagtcctaataaccatgtcgctttccataggaaaatgaactagggccagataacctgatgaaaaatgaaatgtgctaagtgagcaaaacatatgatataaagattaatgaaatattaagtagactaggcctaaaaaaaattagtgcacacttaagagtgaatttccatacatagagaaacataaatatttggtattatgacaggtactgtctatactgctgactcataaagtacaggtatgcttacccactgctgccagaacgaccactatatccaccataagccccataacctcctccagagacctggagaaattccagtcgaagttttgataagagtctgttagcatgaagaggaaaggaagggaagtgaaagggaagctatacctgggagctgccataacttgcatagctgtcaatagggccaatatcatctgagccacgatatccacttgaatatggataatcatgcccaagaggcttagtatctctgcctagatactttggcccttcagaaacaccaactggaagaggatggtaagggattacaggtgggaaacctgataaagcaccttctctttcaaagaaattggctttcagcctagtagttatttgcagaagagcatgtcttacaacatcaaggtctccactgatctgttgtgcaagcaaattacattggtgaactcatcgcagtacaaaagaccagtaaaaaaaaattaaaacataagtttaaattgtacctgaaccatctcttcgtcttctgctgctacttttggtacattctccttagaaaggatacgtatgtttgctcttgatgttctccttatctcagtaatgattgaaccaccttttccaatcaagcacccaatacgtgatgtcgacaccaacaagcgtgttgtgtaagacgggatcgctgattccggatcagttttctcactgcatcttggttgtaaatgaactgcagcatttattgttggggagacaggatcttcaaagaactgcatgagaaagagaaagcggaattgatcaggactagaattaaatatccgcatggatgctaaatcagcagaggaccgtaggagaaaagcacctcctttgcagaaacagtaattatgcagtcatcttcagtatttgaactatcaactttgataaaggctccagactcctgcctaatctgtttgataattccaccaccctttccaattacacctcccacatttgatgcagcacaaagaaggcgcaagctaaattcctttgcagagctctcctccctccgtggttgatatatagaaggccaatctccagccacatcacctttgtatcctccataagaactaattaaaggcgtaatccccacaactggtgcagttgaggaactaccaaggtgggagcccactggataaggctgtgtcatgctggatgcaagaagatgctgtgacctagatgggttgtcatggagacgagatgacacttgaagaagagcttttctgacaactgttgagtccccagatatctagtgccaaaagaataaagggttcattagcattattgactattccacagatggcatagcaaaaaaaatcaagtactgtaaatgataaattaaactagtaaaagttattttgctggttgactggaaagtgaaaacagctactattaaatctaagtcactgcaccttaaaaagggtactccgtaaaagagaatgttgcggacgtgtcacaaataacccatgttaccaaacagagccataaatgcctatagtagtaacgcatgtacgacatgtgtaacgcgggaaaaagatggaaacagagatcctccacaaacctgaagaagttcatcaccactgatggcacacgcagggagattttcattgctaagaacacgtatatgagcaccagtgtcactgcggattccctgtataatatgcccaccttttccaataatgcatccaatctggtctgatggcacaagcaaccgaacggtaacttgagctaaaccttcatcactttcttcattcccaatatcatcatctatggatagcttttcatgaactctaaagagagcgtcttgggcagggcaaaccttatcttcagcatctactagggtattagtttccctgcttgagctaaatattgtgataactctctcatcacaaccagatacactctcaccaatccttatcttagcttgagtgtcggccctcatctgcttagcaatttctccacccctcccaatgatgctccctatttttctagaagggcaaagatagcggtagacagtatcatctggaccaggagcatatgtatcatcaccaggattccttctcttgccacctccattttcagcataatcagagtgacgcttcccgtgactgttcctatgcccaggtccaaccattgtctacaatcggagaaagaacggtcaacacagtagagaatattgggtcaaataaatggaaactaaaataacgcgcaagaaggaagctattctaagattattcacatcaaaccctcctgaaattctcatttaccaaataaaatcaactataatcacacgaatcaccctgtcaaattcgtaatgacagcacatattaataatccttacacttgtatggctgcatgatggcatgtttatcatggccaagcgttaaacgaatccacatgaacaaatcaatcccataccacaatgaacaaaagtcatctttcgatcctaccaactagattactataaaagatctaacgagaaaaaataaaaattgtttggtctattcatgataacctctccgactctttttttacagttcaattattattaagttgaagaactaacaaagatatcccgacaaaaaaaaaattctaaccaaaacactccaaccacgcgaatcaggggcggatccaacttgggacgtgggggttcagttgaacccccaaactattggggggaacaaacaaactgttacttgtattaaggttaaggctctgaaatcaaatagaagaacctcttccagatctataagagaagctagggttaacgcaagcaaattccacggaggtgcaatcccggtggaagagagagatagatgaatcagaaagagaatgcagatggatgctcaccaagatcccctcccctcccctgctccgctcgccggatggagatcgccgcccctcccctgttcagccgcgagatggcgcaaggagcggaggagacgacgagacggggagattttcttttacgccaagcctagggaagcggccaagggggagacacccgtgtacaccgccttttatctcaagcttttcactaaagcccgaaaatttgacaaattaaccctttcagaaaacttatctaaaaaataaatcgtgctaaaaactaatcatgcgcttagagccatcgaggttaacaatgacgccgttgattttttttttaacatgtttgaccgtttgtcttgtttaaaacttttgtgaaatatgtaaaactatatgtatacataaaaatatatttaacaataaatcaaatgatatgaaaagaattaataattacttgtttttttaataagacgaacggtaaaacatgttttaaaaagtcagcggtgtcaaatatttaggagcggagggagtatatcctttttaacatctttgacgttggcgtttcatcgaagatgacatgaatttgccaggttatatataaatatcacattaacgctaaagatattgaatattccatcggaagcggcaagaatttaccagattatatataaaaatagtaggtatgaggctatgtctgtcaagcttgaaaccctggttcaaatactagggatgcctcccatttgaaggaatttctttctaccccttattttctttggcgaaattaagaaatagtgacatattttttggtgaaattattttttaatataaaatttaaaatacaaatatattatggataccacataccaaaaagtggttgactaagctcggtagggcacaccatgtaccaagtgttatacggaatcatacctcgtatatagaaggaattccggataaggaatgacgaatagagttctatatgtaaactataaggactacttggattgtatccatattgatctctctagttttacatggacaatgggacacctatggtataaatatatcccataggaggagggaaaaaaagatcaatacacgacacaacaacagatcaacacacgccaagacaagccgctagatatcgacatcagagataagcctagacaaacccaatatgatgtatgcggaggccaataagagagatctagcgctatctctgatctcgtcgagtgcgaattcgaggaggaagactaccccgttgttggctacgtgatggtattttcgggcgccaagtcgataacggctagataggtatatcccaaatattgtactggtctaattataatgaataagagcaacatcggcttcgcccaacatgagtagggctattacctgtcagataaggggcctgagcctgtataaaatttcttgtctccatatcttttacttcaatctcgcatataccttggtaccaacgatccccatactatgcaaaataccgtagtcgcggtatcacccatcgacaatatctattttatagttaatctttaactaaaacactaaatatatataattcttaagagaacactaagctcgaactaaagcaaatgctggtgtcctcgggagctttttatttcttttaaattcctaaaatccttatattattggctaaactaagaaattgtgatatatattttggtgaaaatgtttttattaaaattattgacttcataattaatactttaattaaaacacttattctacataattcttagttttaaaattcctaaaatatttcattattttcttcgtgtatgatttatttaaacaaaatgtgtcatttcccaataaaatacgaaaaataattaacaagtgtagaattggtaaaaaaggtaaagatccttaaaaggagtagaaggaaggactcaaaccagggtcttcaggatgagagcaccagacccagtagcaactcacgtgtgtattacatatacaagcatgtatttatatattttcttataacttagtaccgagcaccagatccagtagcaactcacatgtgcattacatatacaagcatgcatttatatattttcttataacttagtaccaaacaccatgaagctaattctatatgactagttaaatttttgtcttctcgaataggatgtgagtgtcaatattcttgacactaaagcattatatatcaccactaatcttaatagcgttgagctgacgatttatttatgcaaataagtttttagcacggtcgttgcaaaaagttttctggaagggtcagtttgtagagagatctatgctgcgcacaggcacaacctttaggcagccacacgctggtctcctcgaactcgaaccctagccttttgctgctccctccggcctccacacgcgcgagatcccttcccctctcctcccctcccggcgagatgtcgtcgtcggtcggcggcggcggcgggcagcagttccggtacacgcagacgccgtccaaggtgctgcacctgcggaacctgccgtgggagtgcgcggaggaggagctcgtcgagctctgcaaccccttcggccgcatcgtcaacaccaagtgcggcgtcggcgccaaccgcaaccaggccttcgtcgagttcgtaagccctccccccgttctccctccccttccccacccgcctggcccgcctccatctcccccctctcgtcgctcgatctcattcgagatccgttcggatgaatcggccaccggatgatctgccatgttcaatccacgatctatcgattcggccgtataggtatagcgcagtcctgtaattaggggattttgtctcggatagtatagcgcagtccgtaattaggggacagtgggggtcactggctcacatgccgtcctcacatctgcttggttttagctttttttttttttttttttgctatgccaacacatcgcgaagatggaattgatatgagcttcggtcatcgtaaaggatttgataagatgcggctgcaggatacacgcgggactggatatttgatactagtagtaaagttgtttaacaatgttagtattttggatgggttttcaggtggattgttgggtttgtgattggagttgaccgaggttagtttatgatactggaatgctatatgttgtatcaatctgtctgtcaggaatcgatctgtagcatactcggtaaccgctatctatatggatggctgggcctatgtggttttgtggttttaaaagttccacatgtcactgtttggtttgtgataggatacagttacagggatgtgatttgtggctcttggatatatggtggcgggagctgggagctttgaaatgacagcaaagctgtattctgtgtcattagtaactttagagtatgattctatttgtgagattgattatctaataaaatgtggtgtatctttagacttctaggaaaggctttcagaaactttatcttcctacaaattctattattgtttatacttatgttttatttgtaataaatgctgcgcattacttatgcaaagccattccttctttgcagactgacattaatcaagctatttcgatggtttcttactttgcatcatcttcggaaccagcgcaaatccgaggcaaaactgtttacattcagtattcaaacagacaagaaatagttaacaacaagagccctggagagactgctggaaatgtgttgctagttactatagaaggtgttcaagcaaacgatgtcaccatcgatgtgatccatctggtgagttctaaattttagtttcttttccaacatgaaagtatttcaatgggtgaattagtaagatcatgaaaaatttaagtgtgactgttgctatatcggttgccattgactgaagggatccaagggagtctacctgacctgatccttgtaaatcaaagattttacatagctcttcatctcgtagtaacgtattctgcatgaatcagcaggcccatgttaacacggagaaaatgtcgttatcaacatctgcaattggagagatatcatgtttgttttgctgcctctgtcttctaactattacatctgaagtttttatgaactcttggggatgccattttctaattatctttcatcatcacgcttttccacggtgtagggcacctccctgtttatccaagttattgatgaaaggttaaattcccaacctttagaaaattagtacatctatggtgcttcttttgtgatcattttgtggttcttttatccatctattagcaatacaatatagttccattcgtccctggttcatctgtctaagatcttctgtcctctttgtctttttggtggacaaaaggataacctttaagagtttcctgccagatagaatatttaataattgattttatgtactacaactacaagatttttatatgtgctgccagttcctggattaattttctcttttactcctatatatgacccttctattatatttcaggttttctcagcttttggatttgttcacaaaatagccacttttgagaaggctgcaggttttcaggttacttgaaatttcaaattctgttaatatacttgattgtttacaaaggcgatcttcccaccttattttcttcccccgcaggcactgattcaatacacagatgcagccacagcttctgcagcaagagaagccttagatggaagaagcatcccaaggtgacatctttgttctctgtacattgcatcttttaatattgttcacactttgctcctcctataaactgaattcctctgagactttaatttaatgtaggtacttgcttccagagcatgtaacatcttgttgtttgcgtatttcgttctctgcgcataaggatctgaatatcaagttccagtcacatcgcagcaggtatcacttatatcttttttgccttgagttaatttacaaagatcaaatttcgcggttgttaagatggatctctatatgtctaggaggattgtaatatcaacatactacctggtaccatattttaatgtctacattaagatttatgcctaggcattgcaagatcatacctcatattttccctgcaaattcagaaatacgtgttctgccacatcatgggcattttacctttattcatctttcctgttcatcctgctgcctccttatatactgacacatgattactttgaaaacctggtaaaatagactatcaaccactggattccagatttgaatttgcaacctaatcgttggctaaaacaaagtagcttttttcatgggttaagggcatattcatccatagtagcacttggcttccatttttttagcctcttgctttttgtatggaacttccatatttgtatgagtatattactgcaaaatctttatttgtcagtggattcgtcttctccatctttgttccttatcttatttgccttgtgttattatagatcaaaatgcttcttactatgtatcttgttaaacatgttttcttttttattttgcagggattacaccaacccttaccttccggttaattcatctgcaatagatacgttacaggtactactattggatatcaccaacatttgaataatttaattgtctttttttttccatttatatgaacctgcctttcatataaactgccttttgatgttccttcacagcctgctgttggtgccgatggaaggaaagtggaagctgaaggcaatgttcttctcgcatcaattgaaaatatgcaatatgcagtcacggtggatgttctccatactgtaagttaaattggaaagcacttattcaaagattttgttgttttgtagttactatatgctgactaagattaatcaattccaggtgttctctgcatttggtacagtccagaaaatagctatttttgagaagaacggtggaacacaagctttgattcagtaccctggtatgaaccttggaacatatcatcttagtagaattacagaataattatgttttgtgttgaattagtgctttcattttcaacatttgacctagcagaccacacctccaacaaagcttgatattgttatttcgtttacagaaattattttcctatttttgtaattgaagtgaatgtgcagaagttgtgcagaactaaccaatgtaaacatgctttcctttacatcgtaacaaacatgtgcttgttctgtttatgatttcatgtgctttaaattcagacattttttcatgatctgacttcattacattaccattcagatgtaactacagcttcagttgcgaaggaagcattggaagggcattgcatctacgatggtggctactgtaagctccacctgtcatattctcgtcatactgatctcaatgtaaaggtataataggtgtgcattttctttagtgtattatgggcatgaaacctgtttagacgatatgatttactgccatcatagaacccttcatcttgtattcaagcacagactttcctatcatatgaattatgaaccatgtatctgtctgttctttcaggcacacagtgacaagagcagggattacacaatccctcaaggtgcgatgcaagcagtaccacaaccgcctggtgtaccaacaacatctgctgggtggcaaggtaatccacaagccggtggtgcatatgcaccacctggagctgctgctccaaaccacggcacaacagggcaagtgccaaattggaatcccgggaactctgggtatgctccagctccaggagcatatccaggtcaaatgtactcgtcaccaatgcagtatggcgcatcagggggcttctctgctcctgctgccccaccacaagagttgcatacttcgcagcagatgccgccgcctcaatatggaaatcagcctggaccagcaggtgcaccaggaaccgggcaaccacatccatattatcgctaaatttagattcctattcacaactggtactatgccctttctaattagtaactttgtgtacctttgcaatagggcaaaaccagttccttttccctgtctttcttctcatggaaccttttttataaataaactcttcatccagttgttctcatccgcggcacaaaatgaagggttttcatcgaaactcatcatagttttctcccaaaggtaactttgtatattcctaatatgtttatcgtcagctcgttggtctgtatcttggaatttagtattccctcgttttttacttgtcactgttgtgacaaaaaaaatcactgctttaactttgatcaccaatcatttttttaagttgaacaaatccacatggttacatttatatcagacgcactttgattaatatggtactatttttttacaagtaaagtgcacaagcggttattaaacttataaggttatgtcatttaggttcctaaactcttaaaatatagatccaagttttagaacttgtcaaagtgtcatttaggtcttaaaacgtcacaacctctttaggatcttacgtgacgtgtgacgttgatgtggcatgccacacgaacatgacgtgacatcatcttgaccggcaaatgagacctagatgagatattttgacaagttttggaaattggatttgtatttgagagtttgggaatctagatgatacacccttacaagtttaagtatcacccatgcactttactcattttttaagtactaggaataatgcccgtgcgttgcaacggtaaagtcgtttgttccagtggtacaacaaaagccaaagccattttctccaatggcacaacaatcattaggagctgagcgataaattaaaacattggtaccgctatacattatattgaataagttaattaaaatccatacttggctttgggtcgaaagcccattctttcctttctttttagccgcagcccggttgtaagatttccataataccgttgggccaaaatagagtgaaatggcatgattgaaataaaatatattaattgtgcacataaataaaaatctattccttaatatcgtagacatatatggaacaataaaatattaaaacataacgtgacaattaacacgcataatttcataggattttaattgtatctcactttggggctataaataaagctaagtgtcaaaatgtcataaaaaacatataatggtttggccaaaatgaagctaaattaacattatatatgaataatggaaataaattaaattttgttgccaaatttattgttggttccatttagctacatatatgatcttaattgcacaagaaagtttataatgcaactttatgtcatcaaataattgcttaaacggattaaaatgctcttatgtaaagaggaaatcattaattcggtccgataataacggaaaatcaatttggcccgaagaccggcaacggctcggaggctagagctggcacgtgatcgtgcggcccatgaggcacgcgaagcccaagcgcggcccgttagcgtgagctgtccgatcctgatggatggctacaatctctgatgggtggctgatgcagtgtgggagagtcgtgggtcctctaatgctgatcggacggtttagattgatcaacccggataaaattgccaccagccgaaaccctaaccctattaccctctctccctggccctattttctggtgctaggcgaggggtagtggtcacggcgacgccgacggagcggcggcgatgttgaggcgccagtgtgtggcgaacctgatgtcgagcatggctccggcgaggccagggcggcggcgcgcagtgggatgccatggccaaggcgacggttcatgtgagctgaggccgtcggcatcgagcgaaatggcggcgatggtggtaaacggcgtgctgcgagctgataccatgcgtcgatccctctctcccacctcagttctcctcctcgacacggcgcaagactacaacaaggcgagcctcgacctcgagcggcaaactgaggcggcgctcaagttcgagttctcctcctcaacatgacggctaagggatgcacggcggtgcgtgtagctgtacaccagtcgcacgaagatggttgagagttcggaggtgcgcacacaggcggagctcatgccgtgcgccacgaagtccgacgaactaaccctaatcccggtgagtcttagggttttccattgagctggtgatttgcctgttcggggttaactgttcttaattttgggaatttcttaggttagggttcgtatttttcggaaaaatcaaaataagggtttcgaatttgggggatattcttactcttataccgatctgattcgcctcctcgtaacaatctcttattgtacttttaggatcggtaggacttaaggtttaggtagtgacaaacgaacaaagattaagtttccttatatatgagctaggggattgggggcgagtccatggcgtaatcggatgtgctcgtatacgaacgaaagattaccgcggaatcgacggatgaaagcttgtatatacgaacgaaagattaccgcggaatcgacggacgaaaacgcggtgacgatcggaaagttacccattttcttttccctttgtttttatttctttttcctgataataggagagcatgcatatttatatttgaccattaggatgggtcaattatttgactgggccaaaaatagaaagatgcacacacgcgcgcaggccatctccatctgaccttcccaggcgcattgtgcacctctctcatcgctacgttgccaagcccatctcttgattgctggatcgcggaaaaaaaggagaactgaatcggaggaggcgatgtgatgcgctacgggctgagaaaaaaaaaaggaaacacatgcgagcgccgagaaaaaaaaaacgatgacgagggaagtgattaggattcgaaggcaacggaccaaactatccggcaaaaatatttttaattttataatagtagagatttaataacttgttattaaaataagagtggtaaaagattgaacatgaatagtgttagcgacatgtaattggaaatggaggcagtgccacattcgtctgtcctgcccccctttgcttctgctgagcaacgcataattttcttgtctgttgtcttacggcccacatctcaaagtaaaaacatcaatttggaggaggcagggcaacgcgtttgggaggccattgtggtgccagcactgctgcagcgatcttggcagtaccagcaacaacagtcagccggttactaatatatactttccttggattcgatcggatgtcattatgaacgattatgggcatgttcactttgatgcaatttttaaccttaccaaattttgataaagttgccaaaaaaaagtggctacatttagtttgctgctaaattttggtaactatataggaaatccagcaaaattttggtaatataatgacaaaatttggtaaggttttttttgacatcaaagtgaacatgccctgtatatgtcaggagcaattaatcacatggcatatgccacgctgcaaagaaaaagctcaagtgactgtgcacttgtcaacctgtccacgcatctctctttgatttttcagtacggagtacccagcaatgacaatgcacgagccaaggttttacaagacatctccattatgtattcactgtgaaagtgtgaattatactcaccacattatttatttattttatttttgttttttttcttgtgaaatcccctggaaaccgcacttgggattgggagacaacaaccagcctactgccatggagtagcaagccactacttagcactagtgccgcgtagttacactggacaaaatcttgtgacactaaccatatggatcaaccaaattgatgtggacgctctacttgtcaccaaacttagattcagttaatgaccagagcttagtgacaatgcagtgtttcttgttcttatctctgttctctgcactcggattgccagggttggagtcatgatatggacaagcccaataaaatctcagcgtgagagctactcctaggaaaggttgtaagcaaatctttcttgtcactttggatatgcctttgtcagtagagagatttttcatcagtgaaaagaataagctctctcacggagaacattttgcagcgaattactgtacaatacaatgtgctctcctttctcggaatctccggctctcgcaaacagagctttaaatttcgctcctacttgtcttacgtcgtaccaaagaaacaggtgatcaatgaaaggaaatctgaaaaaacacacaccatgatttggaacaatggccggcttctttaatagacattagatgaaataaaaggtcaaaggactggaaaggactcaaagctgaggtggttaggcattggcatctaaagtaacaataaagtgaaaatgtcggtcacctacggttgcacctgtgccgtgctctagaaactgttaactgtccagtgtttacctgctgaattactagggttataactactgatggttccttgaaaatcacaggattgaaaaaacgtagaaataagaaacacatagaaatagtaaagaaaatcatatgcaaaacagaggattaaaaacataggaaaactatagaaatgatcgtttgattggtgcataggaaaaacatagtaaagttaagtattaataagttaatagtaatcagagtttgaatgattttgctaggataaaccatatctttcaatagtgctttgccttgatcctacgtgtagcaaaagaaaaatgagctcacggtggatgttaattttcctatgattttttcttgaaatcatggtcgtaggaaaattttacatgcttttcctttgttcagttcctattaatcaaagggatgaatagtaccaattcccctggtattcttgttcctatgtttttcctccagttttttcccatgaatcaaaggaggcctaaactcttatagtagtattgagaaaattcttaacaaaaaggaattgctttactgaaagatacttcttcgatagatgcatctaagacacatggaaatgataaagatttgttatctgcatacggcaatttttacaggctagcttgtaattttggttcctctaacggtaaatctgtttggttgaacttctctgacatatgagtgtgctaccgacaagaaaaaaaatgtctgaaaaatatgggcctcagttttctgtttgttctgacatgacagcgaagatgtcaacactgaaacagcgtcccaattactgagccaccataattagcatcgtaaaatctccgtggagaattctaagatctcgcagtgcacagaggctcttttactgaagatgctgtgtgcatcagtgcaatgtacccagccctgagatgctgttctttcctatctttcctggatctgcatagtttgatgccaacaggcagcaggacatcatgatctgaaattgggagacttccataactgatatccatggcctatctctgttcataaatatgcctacacagtcttcagtctcacgcacagatcttgttggtttcatctccaccgtacgtaccaaatactagttggttactggttacaacttacaaccaaacaggagcaacttgcaggctggagagatctattagcatccatatcatcacctacctacctctggcactggcaatggcaaaagagccaagaatggttttatacttgtatgcacaatgcaattggaaggagaaggtaaagaaaaggggatgtagtttgagaagaacacacagaggcagttccccaattggttgtggaggcttaaaggcttgtcttgcctgcacatttagtgcccccacatgtatgcagattgcagccactctttgcaatcttgttggagatggtctagggatcttgacatcatgggatatgtcatggttgctgctggtcctgcttggcttatgcaatgcaggtagcattcaatttagcctcaggcatgcaaaccacaagcatgcaccgtacatgaaactgatgagcggatacagactacaaaaggggccatggatgtgctgttctgctgtagatttggtccctcgaagggaaatgcacaacatggttgtcgcatctagtcatttactacttcatataagaattaaaggtgtgaaacacactttgaagcaaaatgtagacccatttcatggttctgcattaatattttgcatgtggttttggctttgcaagccatctctgattacataactgaaggctgaatagcaggcggcctaaatttgaaacgatacatttgacttgcttttttctcataaatattcgggatgtaaactttttagcagaaatatatcgtcaatctcgcacaaccgttacacgaaaataacgacgcgagcagtctcgcccgacgaaacaacgagaccgaacggcgaaaacaaggacatgcgcggtggcgacgcgagaccgtgcggccaaaccgcgagaccgagcagtctcgctgaaccagccagcgataccgactgacatgccgattgaaaattgttaattagtgattaagtaccctaattatccattaattaattaaagaaacaatacatgtagtgtacaatatgaggtaaaatttagaacagaaactaaaatgatttctgaaaattggaaaaatgaaataaaagttcaagtagtaatataatttataaataaaaaatgagaatgaaaaatgttgaatgttgaaagttctatcagtataaaacacaaatagtagtaaatgaaaataaagtgggtaggagcaacttgctcttgggtgacattggttgatgggatatataaaactataaataaaaccttaaaaaatattatatttgatttttaaaattcctattacgattaaaaggagaataacaagcatatcgttaagcaactcagcctcaacggttggtgggacttttagccattaattaatcaattaataattactaattatgattaattaattattaattagggtaattactcactaattaagcggcaccgttggacaagacgttcggtctcgctgattccttatgcaagaccattccgcgcgtgtcgtcacgccaacatcattttcacacaacagttgtgcaagatcgatgatatatttctgctaaaaaattacatcccaaaatttctgagaaaaaagcaaatcattatgttttcaaatttaattctcgtagcaggccagccctgacctttttatcggcagatcagaactgtacagtgtctgtactgtagcaattaaccacatgaaaatatgcatgctacctagctttatattcttatcacccaaaaactatttgaactccttgcattttggagaaaagttgtagagtactacttcctccgttttatattataagactttctagtattgctcacgttcgtatatatgttaatgaatctaaacatatatatatgtttagatttattaacatctatataaatatgtgtaatgctataaagtctaataatatgaaacggagggagtatttattaaggcccttgtcgaggagtgatcctctctagcgggagatcgtgagatccccttttatgagttcggccaggggaaaagggttcacctctcgaaatcgtgtatccgccctaagtgtttcctaaccgcgtatgggcgacaagattatacaggttcgggccgctatggagcgtaataccctactcctgtgtgtgggatttatggttgaatgttacaagggttcctcaactccggagaacgttcttgctcttcgcttcctggagtttaggcctactgagtgtcgtcctctttttcggcggggaaggtcctccttttatagttcaaggggataccacatgtgctgcttctacctcttctctcacgggagaggaaccctccttaccttgatcggaccacgatccgtgccttcgcccggaagctaagcagcagtccgtccttgagtgggacccggcgccgccccccgcctgacacgggggacagccctgtcattccctcttaaatgagcgaaggcttgtggcggtcctcctcacgtggagggaactccggataacgctccgatgggacaggacatacctacctccactccgccggatacagaggcgacgtgggggcacgaccgcccgtccaatcggcaataggccggtcacagattggtcacacccgattgacgtgggtccatcgggcggcaccgcacgtctgcccttaccgcattaaacgcggtgagggacagttgggacgccgcgcgcactgatggctgttcagcctgggtctcctccccgctcgcttcccccgccacatggcagttgggcgagggcctcggggcgaggcagcgcgagggcccgaggggtgtgacgtggaaccccgaggccccctggctgcttctgcgactcgcgagacgcggggggagggccaggctgtagagccacgtggctggatgggaaggtgacttcccctcactttgcattcccccgggcctatatctccgatagccctgtttcttttagcttgggattattataatctagattattgagtcagattactataagctagattgttataatctgtagtagaataagcggttagttgtttcttttctagattattagagcctagattattgggtttgcaagtctaaagagggagtggggtggcatggtgggtaatttttcacctaataatctggaaaaagctcaccaaaatgagcttatcatattataataagctgggctccagattataataagctactttaataagttatctgtttctttcaacttactcccaataatctggattataataatcccaagctaaaagaaacagggcctaatatacttagaaaaaatgcccgtgcgttgcaacgggtgaaaactattttaatcttattattgttatacggtttagttaaggtgaaattcactatgagaattcgtttggatatataattttctagaaaatcattagctacaattaggagtccgatcatctcaagttagcatgcgagttttttttgaaaagatttcttatacgactccttctgtatttctaaaaacggacaaacttaaaacacgacccaaatacggtttccaaaagagaatgaacttaaaaaccgactcatacacggatgacgtgttaaagtaccagcaaaaacatcttcaatttttataatagtagagatattgaaagttgttagtcatagagcagtgacgatgccataaatttttaaagactagaggtaaggtaaggcacaactaataaagtattggttttctataaaatttacgtagtatatttaatacaatttaaacaagattttggaagcctgcctctgccccaagtcacaggatcgatgcccatgaacaaccttgttcatggacagcctgaagcctaaactctgaatgacggtgagatcgacgaggttctgggacgattcaattgtataaaaatttcgggctccaccacaatgaatgaagttcggaaatttcggatgtcaaattcaaactaaataggatataagagcacccgcaatggtaagtaagatgctctctataaaatatgtacatctcagcaatagactagattaatagtaaaccatctcaatagtatgtctacatgggtatctatagctctttaatacattgcctcgtttttctctatatactatcttcaggttagtagatagctttgctctctctcttcatttaatctcttccaagtagaaaaatatgctaatatagatatcttgtagagagcctatagataaccattgcgggtgccctaatgttgtgtaggttctcactgaaatcaaaatggatgaaatttgcccgattttcgatacacacttacgtatgagagaaaaggcatgcattcgtgctgtcggaggaacaaggacgggtccccgggcctctgcggtcttggggacaacaaatgtgacgtacttccttcgttttataacgtaagtctttataggattatccatatttacatagatgttaatatacatatacatatatatatatatatatatatatatatatatatatatatatatatatatatatatatatatatatatatataggacactcatatggggcaccatggtgcccgggcaccatggtttcaaatgcacaaaatcacttaaatttttcaaaattttcaaattgtgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatggtgcccgggcaccatggagcaccaaacaaatttactatatatatatatatatatatatatatatatatatatgtgtgtgtgtgtttagattcattaacatttacatgaatatgaacaatgctagaaagtcttacattatgaaacggagggagtatttctttaaaagacgtactccctccgttaaaaaaaacaaaaagacaaccgagagggatagtataactaatttggacaaccctccatccaaattcgttgtacaagatctatatgttcaaattgccgaagagacaactggcaacttagtacaccccatcctccatgggcggagtacttgttcatcatcgacatcttcaaaaagctcgttcatactaacaagaaaacctgtaaatatattagttttgtaagttgtaatattaaatatattttgataatatgtttattttgggttaacaatattactatatattttttcacaaatttagtcaaacttaaaaatgtttaactaagaaaaaaaagttaaagtaacttataatatgaagccgaatgagtaaattacaaactcatacgcacggtttgaaattttgattcgaaatttctaaaatttcggtaatttcaccctcgccggcatgctcaaatcttgcccgaaatttttggttttttgcatttttttataaatttggtcaaattttcaaataatttcggtcagagattcccgaaatttccaatatttcgttcacctccggcataacacctaatttcgaaattgaaaacctgctcgtagtcatatgtgttttcttctatgttttagctagccagctatggcgcctatataaatcccccacacgaacgaacaaaacgatcgatgtgtcgaagtggacaagctgcttaactaatcagctttccctttcgcttgcgcacgtacgtacgatacgacaatggcgccgccgtcgctaccgattctcctcgtcttgctctcgctgtcgtcgtcgctgtcctcctcctcggcggcggcggccggccgctggaccgacgcccacgccaccttctacggcggcgccgacgcctccggcaccatgggtacgtaaccaatgcacgccgatacatatacatctatctcagctcagaattgatcgaagtggcggcaatggcgccgccggttgtgtgcaggtggcgcgtgcgggtacgggaacacgtacgggcaggggtacggcacggacacggcggcgctgagcgcggtgatgttcggggacgggctgagctgcggcgcctgcttcgagctgcggtgcggcggcggcggcggcggcgaccggcgggggtgcctgccgccggcggccggcaagtccatcgtggtgacggccaccgacctgtgcccggccaaccacgcgctccccggcgaccgcggcggctggtgcaacccgccgctccaccacttcgacctctcccagcccgccttcctccgcatcgcccgcttccagtccggcatcgtccccgtctcctaccgccggtcagcaaccgccgccgccgccatcgattgatcaactcgtcgtactagctgataattaatccgccattgatttacccgtcttgtttagctcccaaaataaaaaattaaatatagaaaaaaacaattatgtgtaaatgacgagatgaattttttaagcctaattacgtcatgatttaacaatatggtgctataataaacatttactaatgatagattaattaggcttaattaataaattcgtctcgcagattcgtagcggaatctgtaatttattttgttattatacttcaaatgtgtgtccgtatattctatgtgacatgttaaaacaaaatttttcgctgactaaacaaggtctaaatgtgtgtgtagggtggcgtgccggaggaagggagggatgaggttcaccatcaacgggcactcctacttcaacctggtgctggtgagcaacgtgggcggcgccggcgacgtgcacgcggtggcggtgaaggccggcgggggaaggaaggcgcggtggcaggccatggcgaggaactggggccagaactggcagagcggcgcgctgctcgacgggcaggcgctgtcgttcacggtgaccaccggcgaccgccgatccgtcgtgtcgtacaacgtcgcgccggcgggatgggcgttcggccagaccttcaccggacgccagttcacctgagaagatcgatgagatgactcgtacgtatagtagcgcgcctagaacgatgatgtatgttgtccattgataggtcggataaaaaaaacaagatttcgaggaagagacatcccttaaacttcagattgaaatcgcataccccttgccacttattgcataccccttgccacttattaagtggatctccatcgatcgatcaatcattaggttcgattgacacgtaggaattccactgtattgcaatagtatgttgttagtagtgcgatggatgtaatatgtgaaactgacgtaatccagacaacactaatgtaatatattccccgtcttaaattagttgtcttactggattttaaattttgtttcaaaataattattattaaagtactacttatctcatcaatgaccccatataaatttctttccattttaccccaaccaccttctcactacaatacaaataagggcactataatttttccttccttactaaaccttaatttatgctaaataacctagaacgataaatattgtaggatgaaggtagtatgtaataggagaattgatccatgtgtcagttgcatgttgttggtgtactgctcatatgtttttggtggtgcgctattttctgtgcttgttaggtactatatatggatttcgcaagacatatcgagaagacatgtttaaatatagtgttataataaaacttacaacattcttctactgagcaatactaccacttcgtgttgccaatatgcttccaattccaattagacttgttaaacctagcccttcccattgttctcgttgactacccctctacctagcttgatctttgatcctctatcctccatctcccatccttcaaatttcattatactcctattactaatctcgcccaacactaactaccaacccaattgcttcactgttgttgccgcaacatcaacgtccctatttttcaccacccatcacagggtccaccctgtccgttagctttatgagcccgggatactcttcttttttctcatcgcactccaattacaattgtttggtgtgttcaggagagattgttgtagttgcagcttctttgcagcaacagtggcagctacagctagaatgttgatagatattattggtgctaagcagctgctgccgcaaataactaaagtgaacagattgttatctgtatcgttcctaccatcaaatctcatcgaaatggcgaagatagataatgtcactacaaaaacatagagtatattcagggagttaaagaagtttgcaacattttatccttattttttaatcggatttaccacctaattttaccatctttttcaggttggaccaggtttatggcatgggttgtgcttcggcctaatccacacgagcagctggtgtttgctcatggtggcgatggtgcgcgataccaggagcgtgcgcgacgcgtcggggtggtcatcagtgagggctagcatgtcgtcgtccagtggacgcctgacacggaccctgtggtgatcatgctcggccctatcgcactcaaaacaatactacgacacatctgattatgttgacaggatctaagactataccagaactatcccattcagatcatgcatgagaagcaaaaaaggccaactattacatttagcagtaatcaagatccgatcttctcttttcatgagaaaattcaacatgtttccgattaccaagcgaggaacacggattaattactctagttttttgaagagcataagaggaatattgattgccccacaaaacccaaatctcctaggaattactgaatacattgctttgtttcactctcccagatctcagggtcaactttcctccatggattgctccatgatcgaatagcagacgcatacctgtgtacctcataaacccaaaacaagcatgatagcaacgagccagccgacgaccccaatgattccatcttcaggaagccatcgatcgaggtggcatgggcgtccaccaggcagaggcccttcgccctgacgctagcgacatggccggatgacgagactttctccaccttggcaccgacgacctccagccgtatgcaacaagggtcttcagccggtggccggtggacctagatggtagcgtttgtgtgttgactgttgagtttgatcatgctgctgcatagcagttgcgtgtgaagggagacttttttaggttgggagggaagtactcgtaccagagaggcaggcggaaccgccgtcgagggatccctcgccggagcctggagaaggggactgccgaccgctagtaaatgcataccaagtgacccaatcagtaaacatggttcaacttgcaaaggatggtaaaaataggtggtgtaaaaatcgtcttttacccctatgccattaaaaaagttgcagcttacctgtgtgccacaaaaaagtttggagtcacctgtatgccatgagaaaaactttcgttgacccgtgtgacattccgtccaccttctgttagaacttaacggttccatagctctgacatgtgggacccatgtatgaaaatgactaatttgcccctaaggattttcagctctattctcctctcctgctatctcccgtgagtgcatgctctctcccagttgcgctgcaagccgccgcaccctaaccctagccgcacgccgccgccgcctcgcctcgccggagccgtcgccgcctcgcctcgctggagccggagccgtcgccgtgcgcccaggccgtcgtgcctcctcctctcctcctccagggcccacgcgttcccgcgtcctccctcgtcgcgcggcacgtgggcggcacgcgcggcgggtggtggttggtccgggagggcggcatcgtcgtcggtcaccgggtggtgcagcgccgtcgcgccctccgtcgatggccgccaccgcaggtgagcgagtgagatatttgcggtggtcacgtgagattcgaatcacgatgtgctagctgtggctactgctctcgtgctatctcttgatctctcgctctcgctctctcgtgtggggtttcaagatgcatctgtatatggtttggagttctcgtcttttgcgagaaacggaatttggaattatgcgattgcttttggaaattggtgccctttggaagctctatgtgtatgcttgattcgaagcattaaataaaaaaaagggcatatgcttgtttttatgtattggacaataatacctgcccacatgaatttctgtcactcacactaaactataatatttgattacccgttatttgtcggtatgcaatggtcatgcacctgttttttcctttttacaaaatttatttccaatttttccttattttttccaccattttctaatatttcccacattttccttttttcccggatttttaaacacttttaaaatttattctcactttttctgatttttaccttttttaaatattatttttcattttttctgatttttaacgcttttcctaaattatttttcacttttctaattttttaaacccattattgtacataagggcaaaaccgtctttacacagcccctaacaacccctaacacctctgttatgtctccatccatccaaaatagcacacgggtcaacgaaagttgggctcatggtatacatgtaactctaaacttttttttggcatacaggtaaccagcaactttattaatgacatagggtaaaggactccaaatttgaaggcgcagacagtagggtttttggtaatagaagggggtgttttgtgattttgtgaaaggttgagggggtaaagcagagagttttccccgaacagtcagaaaaaaaaaagggaaattcgaagtccgcagccggaggcccccacggcggcggcgctatggcgatctctccgcctccgccgagccctagctccggcgacccgatcgaggccgcgagacacgccgccgcggccgccctggcagtgcccgcacgcctatggggctccctcctcgcccgcctcccttcgctctcggaccgccgcccccgccgccgccgacgccctgctcttccgctccccttccgcacagccgccgcccattccgcccggtgagaaaccactgcttggattttagtgtgcctcctgtgcttcttatgcttgtgctgcaagctctcgcttgctagtgttatgctagtgcattcgtggactggacagaccgagtaaatttgggcaaattttggggttttaggttggtagctggtggtatgtgaggaattcgtacaatgcgtttggaattagtgactaggtgcaatataggcaaaatctaccgattacaaatgcgaatatctgataggaatgttgtgtaagcgtgtggctaatgcctaatgttctggtattttctttgcgtcgtcgatgaccgtgatgactgatgacacataattgcatgaagtttgttttttaaatcatttgttactttcagggctaccggtgagacgcccaaagcttttggcatcctagaagatattgtacaacacacgctgtgtagtttgcatggtattcagaaaagcttactcttttggcagtccaaagctgaggtctcaagttaattcataaatcttttattttttttacgctgcaattaattaaaagagtgcatcttatacttcatgctatttacctatttttggttctgttatatttattcagggaacaaattcacagaaaatgtattttatgatctttgaaaggggaccaagggcctttgttaaagcaacatatcagacattgactagactaaggagcaatgagagtccaacccagtacattttgcactctgcatctgatatggtctcaacaaaacttgctgtcctgacaaacatgcaacactgcttggctgcttttcttgctgaggtttgtttagtcagatgtttatcattacaaatgcttatgtctagtagaataaaactcgtgtcagcagttctttcaaagctaactttgtagttgctcgcttccaaaaattgctgtactactctagtcagatcattcaaacccaattttctaactctttgataacattgtttgttttacatgacacagttccacatttataaatccaaatcataccttgcttgttctataggtttattgcgaagttgacaaattcaaagaaggattaactgaaaattcagataaatcgcttcacacactgtttgctgttttgaatactgtcttctccaaattggaggtatcactccaaaatgtttgtgaggtatgcattgtttgcttttcttgcatttggatgttatatgtataatatacttttgtgtttggcattatgtaatatattttcttcaggggcatactctactgttcgcactcgatggaagcccatctgaacttctctttgaaagattaccagaaattgattatgataactcagagtggacagaggcctcctcaacagatgctatatgttttatctaccaaaacctccagaagctagataaccttgtttgctctcaggtaagcaactttctctttcaacaacagcaacttgtctcgcatttgctacttctattaatgttacctgagttgtagatggggtatggttggatcaatgttatactattggaggttctatgattgggcctgttcggctgcctgttctgcagttgtggcacagccggcaccaacagtgccacatgcacacgcgcagccgcagccgccgctgccagcttgctgaacaggcccactacctgtttgtgcttgctgtataaaatgtttatatagctatatgcatatgcattgtttcagactataaatgagtggtattgtcatacctatagttctgaacaggcgccccattagcatgcatataatggagcaacatgctgattatcaaaaccatgagatttgagatgtgagaattaatcatgtggatgaactagtgaaaatgtgttcaatgccaaacttgtatctcaatacagagtaaatgtgtaaatgtatagcattctccaggtagtattttattttttgtgatttctccatttatcatatttttacttttataaactatgtaagttgcagttatgtagaaataagtgggtttgttcactgtacaacaataaatcttacatttcttatcagatgattatatgttgcttaattgcctgaagcaaatattttctgcaattatagctctcaaggcataaaaaaccaagacatatgaccatatactggttgccctacacatgtggagcgttgggtctctcggcatgttctctgtggcttttgcgacacagtagcttgatgggaagttctgacatcgacaactgggttcaaagtgccaaagagtcaatagctggattttgggatgtgcatgttgagaaacctgtaggatactttctatttatgtccttctattatttatcttatgcatttttaaatgatgctagtgtaagttaactgagggtgaatcaaggcattctagttaaagtcttttctcgttattccgacattgacatatatgagatgttctctgaggtacaggaggataagattttgttaatctattcatgcaaatatttgtctaacaaaaaggaaaaccagataaagggaaagaaaagcatgctgccttgtgcatactagccgtactgttttcttatagtataagcatatatgatagagtatagaaacaatttcatgtgtttgtttactgcagcacttgcacttattaccatgaacatccttaagtttacatgtgtatataaggcatataactaactactatctttgttgacaattataaggcacacacgtagtttcaaaattttggacattgtaattttttaccaataaataagtaatgtaagatgcaacattatatagttgtgtgatacaaaaatggtaattttgaatttttgtttgcaataacttatgatcatgattttgtagttacacacgctatattgcaaaagattcacagtcataaattcattttggcagaccacaccaagtcaaatcgcacacaatattatataaaaatcaacagatagtagagtaatatgcaccaacatctgcaccgaaatagtctaaatactattccttgtggaaccattgaatgcaacatgatataacttcagagagcattagtgtaggagatcaagtgtcaagttttagtggggaacttctagttggatttaatatagctgcaatttttttccacacctttgttgtggctgaattttgatattgttcttaaaatttggaaatcaattatgttattgtgattgcatcatgattgttttattctcatttgatgatcattagatcatttccatcagaggtgagctttttgagacattcaaaaacagaggtaaacatgtaatggatacacaagaggtccaactgaatgaagaagtattgcgcaggttattccctgatactacatctctaatatgcaaatttaatggtaatcatatcacatagttttttctgccactcgacaaattagtaccatattgcatatctaatattgcattttcatcatgttcatctgtttactcagatatgaatactttagatgatatttacctgtggtttcaagaattttaagtcgagtatgccagtatgggggtttcaataatgcagcagatatgcttgtaattttgatttgggatacccaccaccatattttgaagtgctttccaattattttaggcataaatagtggggtagtcactatgagtatttgtcttgtgtgacatgaagtagatgtggtggcacaagagcacagtggtaccagcttagaatttctgtttcctttttgttatcttttgtttactactgttaggattctgtcctcgtcctcaagataccaagtaagtagctgctatgctgagataagatatgttaggtcctttctctgtataaagggtcagacaaactgcacctgctttgaggaatcaatcaatggaaaaaaaatcctaaaatatctctcactccttgcttccctcgccatgcaacagctacactacagctagtcagtcatgcagtaggtgtctagggacatgtcctgaaaacttcccactacttccattcccgttttaacccacagtaaacaatatgaaagtattgtacaggtgtgatgattgatgaagccattgatgacatagtaaatactgtacaaaagagtggtgacgcctaaacaaaaagattccccaacccagcaccaagattttcttcgtttatctacttttttgttgatattattggttttgactaatgttttttcatcctggagtgctgtaactttttcagtaaaaaatttgcaatttcttttgtcttgaacaaaaaattacaaactttaattttcttgaatatgcaaaacttcagctttgcagccatttttttctgagtccattagaggagcataaattatattttgcattttttaagcccactggttacatattggatttgtaggatgatgcttgaattttgtcagcaaacttcaaatgagaagctgccacaagatatatcagatcaagcacttatggagaatttcatggagaggtaagtctgtttgaaaactataaactgatgtggtgttgacttgtttgcatttatgcgttacagtgttaggccaaatgttgcaagttcaaaaggcacctgtaatatttttttctcaagaattttactgtattttccttatgctgaagaaagtaattcttcatcttgatctttctctgctaccttttaagagcaaatattatagaggtaattccatatgaggagcttttgattcagggttggaacttgggatcatttgatcacaaaggaaaacatggcatgtgcttcatatacttcatttgagtttcagttgcttttttgaaactaaagtgattatatttgcacgtggggtaaaccttgcaccgtaaggctcttccaacttcagggttcatttgtttcctagtatgtttggatgaaagcaatgagccatctgaatttcttgggaactctatttcatgtctcagtaaaattctgcaaggtggtgatagaagttaaaagttcaagatgaatgtaattctatgctcgaaacccagcatttgacgttaaaacagatttgacattacttttcaataatggaaattaacttattagcttcttagtttccaatagcatctggaagattcgtgttacacatgctttatagctattttacatagtagtaggttctacatatttacatacttcttgtatagctagctgttccaaaatttctgtttaggatgaccagttaatcacttaatgctcagattgtgcttctgtagtggaaagctaaattgacagtagacatatcctttatcttgtttatttgtgcattgaactatatgcatgtatttgcgcagatatgagaaggaatggacccatcctgttaagaatcttttcggtggagagttagcatatgccatgcttatccaggttagttcacttgactctattttggatgcatcgaatattccacttcatgatatttcctattctcaccttcaactttgaacattcagcttcagaagcgcacagtggatatcaagcagtaagttatactatttctgtctgacaataataactaaaatgcataaagatatatttttcttgtctaatattcatcaacagatgtaattggattcttcttacacagggcaatgctggaactggatcagattcttaaaggaaatgcgataaacttcgctattcttgcagctttacctgcatttggtgtttcgcttttgctcctcactgtggtgcaagcatggattatgaatgtatgttaatagagttccgtgattctatcattctctctttgaaatatcatcatctgtcagaagtatctgtaggtctgtggggccttgttgtgtttccctgtaacctatttgtgccacagatctttgcagtatgtggacatgcgtgtagaaaagcaaaaaaatatggtgactaatgtcttaattataaattaggaccaaggcgccgagggaagaggcaggattgcacggcgccaaagaaggctgctgcttcttgatgcagagagaaaacttatggagtttaaaaattgcatgattaatggaatggtaatgttatctacatctatatgagttgctctttaggattcattctctcaatctttaaagagcttttcggcctaaatttgttgactgagaatgcttcttttgtatcgatgacaaagccactttgatgagtgctccctcttattattattaacttttggattataaatttaataatattggaatgaggggcaccctttacaaatgatgcctctgaatttcttcctttacaggaggaagaggcatgctgtaagttcggattaacactgtacaaccttgatagattatacagagctgttgaatcacatgcagaagaaacaggcgagtggtcaaggtcagtatcaactcatattctttaccatttgattcctggttactctggatgacctttccacaaaatcgtttgtgttgcagattaagagaagacattttggatctggcgaaacctaagatgagtatgacagacaagctggtggttctttcacgactgaagggaacgtatgactgctttccatagccattagggggtgtttgatgcatctgaaatttttcatcatcctttttttttcctcgggtgatgattggtgaacttactgtggttcattttgagacgatgaatgcgcaaatcctgcctaggcattcagtctgatgcacctgctggtaggatttccatgaagattttgataccgaaaatacgatagagaaatggccttgtgccgctcctaatgtctagtacttatttcttatgatgtgaatggatgatctttttgatgagccactggaaataacagtttttactctcatgagctataaagaacaaacggttcgaggtgataagaaaacagaagcagattgtgttgttttgaaacttcattttctgatcatccagatcaaagacatcgttacaggatcagcggaaaatggcattatgtttttttttttgcctgaacatatctaaagtattgaaagaaataaagtttcttgcaatctggttgggccacgtcatccataaaacagggaccgtccgatacaactgctggtaaacgaccaccgtcggatctgataagagaagatttcagaaacaacccttcaagaaacttctctcagcttctagtcctcctatgcctgtgtattttcattttccccctccctctcctgtgtatcgctgcgactcctcgcacgcgtcgcttcgccacctccgcctcttctccttccaccgccaccgctgtcttctcctcccggccctcactgccatcgctgcctcctcctcgtccccagtgccccacagcctccgcctcctcctcctctccctctcctctcctctcatctccgtgtaacactactagatcatagcagaggaagaactagagtaggagaggtgaagaacagaggaggaggagacagagtcgaggaagaaaggggcagagcagagttgagaggagagattcgtttttcctttcttcatttcacacctctctcattacagggttccttacttataaaggtcatacatgccatcctggccgcttggccgaatcacacaacacacatgcgcacacacctacccgacacgttactgtaaacgtcatcctggcgttgtagctcgtcacgcgtgtggcacaggcgtgacagtaccgcccgccggagaaacagcttgtccccaagctggtgctgatggaaagcgggtcttgagcacttcataatcctcccaggtagcctgatgcgccggtaaagaagaccacttaatcaacacctgaacatgtgttgcattgccctttttcacaagccgacgatcgagtatttcttcaggccaaacgtcagcggcatccaaaaccacagggtgaggaagagaagtaaagaccggtgtatgatcaggaacatgtgctttcaactgagagacatgaaagacgggatgaatcaaacttgagtctggtaactgtaaccgataagccgactgaccaattttctccagaatttcaaatgggccaaagaacttgaaagctagtttggggtatggacgattcaccaccgaagattgagtatatggctgcaacttcagaaacacatgatccccaactgcaaaggatcgttcagaccggcctttgtctgcttgatgcttcatgcgcaactgagcccgttgcagttgttgttgtaagaaagcagatagctgattgcgttcagaaacaagatcaaccactgactgatggaccgaggagagaagtactagcacttgactgacatgaggatcagctccaaacaaagctttatgaggagaacaacccaatgcagtgtgaaaagaggtattgtaccagtactctgccaagtgcagccatttgttccacttagttggtgttgcttgagtcatacaacgcaagtacatttcaagacattgattaacacgctcggtctagccgtccgtttgaggatgataagcgaagctcatactcagagtagtgtcccacactttgaacaaatcactccaaaatcggctggtgaaaattttatcccgatctgagatagaatgagggatgccatgtgtcttgaaaactgttttgtcaactgcattggccacttgggaagcagtaaatggatgacgcaagggaataaaatgggcaaacttagtgaatctatccactaccacaagaatgacagtgaatccatcagacttgggaagaccttcgataaaatccattgatatgtccacccaggcttccttaggaattggtaatggtgttaacaagccagggagcttgcagtgttcagacttggcctgctgacaaatctgacactgcttaacaaagttagccacatctgatttcagacctacccaagaaaataacttcttcatcctttgataggtagcagtagtgccagaatgacccccaacaggagaagaatgaaaagcagtaatcaatttcgtttgtaatccaatgttagctccaatccatactcggccatgatgtctgatcaatctatcatgcagagaaaaaccttgtgtattagtagattgaacagccaattcagtcagcaaagtttgagcagcaggatccactgaataagaatttaacacctcctggagccagaggggagaagccactgacagtgcagcacaatgaggtataacaggcatcctggacagcgcatcagcaactatattgtcaactccttttttgtattgaaaagtatattgaaaacccatcaatttagtcatagccttctattgcaaatcagttccaagaacttgatcattcaagtgacatagacttttgtgatcagtgcgaatagtaaaagggcagcgctacaaataacatctccatttgtcaacagccatcattatagccaaaaactctttttcatagatagaaaatttctgattagctggtcccaaagctttgctatagtaagcaatagggtgattcaactggctgagcacagcactaactccataagcacaggcatctgtctccaaaacaaagggaagactgaaattaggtaatgctagcaccggggtagaactcatggctagtttgagctgttgaaaagcttgttgagcagcatctgaccagaggaatgctttcttttttaataacactgtcaaaggtttggctataatgctgtaattcggaacaaatttgcgatagtaacctgtgaggcccagaaaacctctcaactcagttgcagtttgtggaacaggccaagctaacatcgctgcagttttggcaggatcagtactgacacctttagcagaaattatgtggcccaaatactctaattgagcacaagcaaaagagcacttagacattttggcatataactgattctgtcgcaacaacataaacacttgtctcagatgatgtaggtgagaatccaagttagggttgtacactaaaatgtcatccatgaaaaccaatacacatttgcaaataagagatgcaaatactgaattcatcaggcattgaaatgtagatggagcatttattaaaccaaagggcataacgctgaattgaaactgcccatgatgagttttgaaagcggttttaaactcatcctgttccaccatacggatttgatgataaccggctctcaagtccagtttagagaagtattgtgtgcccgctaactcatccaataactcatcaaccactggcattggaaacttactcttaacagtgacagagttgagtttgcgataatccacacaaaaacgccatgtcccatctttctttttgaccaacaagactggggaggcaaaagggctcatgctgggagtaataagaccagaatcaatcatgtccttgacttggcgttcaatctcatccttttgtaaaggagaatacctgtaaggtttactgttgacaggagcagcatcagggtacaaggagatagcataatcaaaagtgcgatgaggaggtaaacacttgggctcttgaaaaacatcagcaaactcagacagtaatggagctactacttctgaaatggactgagaatctgcattgtcagtaggttcaagcaaaacagcatcccaaatatcacaacccttctgccatttcaatatttgagggtaagaaatagcacataattcagtctgggaatcagactcttgaacaccttgcagtgcaatccactgatcttggtagaaaaacttcagagttttagttgcccagttacaagacatatcaccccattgagccaaccaatccatccccaatattgcatcatggccccccaactgaaccactttcagatcataagagaatgtctgaccttggatccaccatgtgaaattaggaaccacatattgacaagagagaaagtcaccattagctacctgaaccaaggaaggggaaatagggcacaactacaaacccaacagctgagcaaaattgagatcaatgaaactatgagagctgccggaatccaccaacatcaacaatactttattctgaaccaatgctctcaaacgaatagcattatggcgagatgcaccagataatgcattcaaagaaatatgatactgctcctcagcatcagaatcttcttcggcaaccactgcattcaaaagatcatctggaataacttcagtgatttgcatagcttttaattaaccagtgatcacacactgatgatcaggtgaatatttatccccacatttaaaacagattccattcgctcttctatattccttcaactgtttagctttccataattcagctctttcaggtttaatggccgatggctcagagataggaacagatgtatccactttagtgccaacccctttgtatgtcaatttcttaagaggtttctgtccactgtctagtaacacactttcttgcactaaagcaattgcagcagcctgctgaacagtgtcaggtaactggaccagcagaactgagcggatttcttcctttagacccagaataaaacgatacagcagcatcatccctcccacagatggatcaaacacacgcacctggtacactagtgaatcaaactgggacttataatcggcaactgaaccagtttgccgtaaggtttgcagcgcctgaactttttcacactgtgcagtactttcaaactcgagagcaaccgcataacaaaattgagaccagtcacaaatctcttctactaacttaaaggattggtaccactatgctgcatttccagacatatgcaagactgctgcagaaaccttaaacatagccggaatctggtacatgtcaaaataggtctcgcacatatctagccaaatacagacatcagagccatcaaaacgaggaaaatccatcttaggcaagcaactcttagcacgaacaccctaatcaaaaccctggctagactccgcttcgttgcgagtaaacacaggatgagtatggaaccttggcggcggcggcggcggcggcggtggtggtggtggtggggaaacacccgcactgccaagagaaaccgcagatggggagcccaaaatactcacttgattggaagacgccaaactcttttgcaactgcgccgcctgaagctgatcttgctgcagcttcccgaccgcctccagagcgagatccaccttgacgacggcgtgatcgagccgccctccgtgtttcgtcatcttgtcgtccatagcctccatcttctgagtgagtaactccaacttctccaacaatttcccctccatcgactcgagcgattggcgtaatggagcgctgagcttgatgggcgtcgtggtgagcgttcgctccaaatccaaccaaacctgaactggacttacagcagccgcacccgagggtagccgtctaccggagcacagggattttaccagtcggatcgagagaatttgaacgcatcaaccacagaaaacccgaatctgataccactgtaacactactagatcatagcaaaggaagaactagagcaggagaggtgaagaacagaggaggaggagacagagtcgaggaagaaaggggcagagcagagttgttgagaggagagattcgtttttcctttcttcatttcacacctctcttcattacagggttccttacttataaagatcatacatgccagcctggccgcttggccgaatcacacaacacacatgcgcacacacccacccgacacgttactgtaaacgtcatcctggcattgtagctcgtcacgcgtgtggcacaggcgtgacatcccgccaccgccgctgccgctgccgccaccccctcctcttcctcatccctatccccaacacaaccacctcctatcagggctggattcggcaattgtggggataatctggattcgagaggcatggctcgacccgacagcgacgcactggtggatcgctgccacctcatcttgcgcatttttccacctgagcgcctttggttccccaggacctcctttgtagcgcctcttctcatcgtcctccaatgacgatggccaagggaaatacaaaaggtccgaggaactgcaccattatgtaagtatctaaaaacctctagcttctcacggtgtttatgttggtgaagcctgtacgatgtgtcctaccacgggcttcacctagcgttaagaagttgaatccatgcatgccctaactgctaaattggaaataacagtacatatcaattaagttttgtaataataatgtaagtagtaaatttagactaaagggtgatcaataagttctataatggagttcttaattaagcctctcatgtaatttcagtttttgagtgtgcaaatttcaattaagagcactataaaaaagaatgcatcctatcaaatgtatgtattgatagttcaggttcattataattataaatatttacacacacaattgtttcaatagctatcaaagatatgtgtgataactaatggatttcaaactagcagaaaaatgatttacaaatggattgaaatagtattttgctccggatgcccgaggtccgactcgctgaatcaagccgacggcagtggctcaccgggagataactaatactaataatcccccccccccaaaaaaaaaaagaagtaatactaactattcatgtatttagaaaaaaaagaaaaggttgcccctaacattatataaatgaatggtgtatttctagatgtgtgtatctatatatgtgtgtctaacgagcaaaagttgtagcaagcagaggagtggaaacctagaaaagatagttctacaaggtgatttgcttaactgtaaataaagtactattaacgatcagatgtatttgactctaagctagcctctggtttgctgtgaagggtgtattcactgattcaataatgatttctgtgaatttatgaagcaaataataaagcaatcaaatatggtattattaagtatctcttgatgttacaagttttaaagcagcaattaaaatgactgcaatattgatttgcattattcgttttcacctgaagtgacattaatgaattaaatggcctttccaaacttgtggtttcactttttgttcgatttactgccgtgcatctaaggcctctatatgaatcatgaacattagtacattttgaatggtaaaaactggataggagttgttgaggaataatgttgtttcatagaacaataaatttatttttgctgactgtgtcataaatcaagtcctttttagttttgctgattgaagttttctatttaacataattgaaattttctactctttcaccacttccgtggtaattattgaacaggaaacagaaagcagcaggaagaacatctcagatggaaagcttcaatgtgttcttaattatgctttcgtttggtcaagagctttattccctgagcctcttaatacattacaaccagttctcaactggaaattaaactgttacaaacggataaagatggtctgttcatgctccagttaaattcatatcaaatcattgttagcatacagtgacgtttcaagtggatttacaatttagtgaggtggcgtgaatgcatggccttaaaatgtcttgatttgtgggaaatactttcatgaggcaaagttactgatcttgcaatctatagaagctttaaagtttgcatccaacctgttttgactggatggaagaaaaactaaaagtgtaatggcccctctatatttgaattggtttcagatttaataaatgccaatatatttgtagaagaatgtgtttgtttttattgtgagaatttctgctaatgaaaaacatttaaagttggctctgtatgcaaataatgatcatatatatttcagttgttttcacttttatctatatggtaggtcagagctggagtacagtataattttgactaaactataccgagtgttaaataatcaatatgatgttatcagctatataaaaatatcaaaataaaattgaatgtacatactgagatatataaaaaggtaaccatagatgtctgctcatggtcacgcaaggcgtgacttaaatggctagtctaaacttgattcatggacccggcacttaatattatgaattttttctctctttgtttaaattctcgttcttcagcttcgaaacaggtaaaataaccagtctctcaactcccagaacggtaaaactcgtccacttcaaaaaaaaaaaaaagggggaacggtaaaactcttaaagccttgaatggtaggacatcgtacgggaaactacaatgaaacaaacaagctaggaagagaaaaatatacttcccgatcaaaagcatactatcacgaattcgaaaacttttggagaaattcaaatttgaaatgaacaaaccataaaaaaaatcctacaaatacgattatattgatagtaaaaattttcaaaaagaaatattgaatttacccatcgtttttgaatggaacagatgggaacaatatgtgaaaatgagaaaaaaatgcctaatgggctgacgactcaataagcccaaaacacacgcgagtccaaagcatcacagcacgagccgtcgcggcgtctccggccgccgccgcagccgccgccgccgtagcacatctcccgctcgctggagtatggctgcttcgccgcctccgcggagccctagctccggcgatccggctgaggccgccgacctggccgcctccgccgccgccgctctagcatctcccgctcgcgtatggagctccctcctcgcccgccttccctcgctctcggactactcccgcctcctctccgtaggccgcggccgcggccgccgacggcgtcgcgccgctctcccgctccccattcggcctgccgccgcccactccgcccggtgaggaatcccctcggctcctatgcttcttatgcttcgcaggcttttcatggagtagtgtagtaactagtaccattaccatgtacttgtgattcgtggattggtggacatgacaggtaaaacaaattggggcgaattctcggttagcaggtggtgtatgtggaactcgtactaatgtgtttcgatgttgatcactgcttgcagtatgtgctaatgtgcatcagtttttcttctactatattcgatgcatcttgttatgtggctggttcatgtaatgcattactgatttttcacatgccattgattattggtgtgcacagagttacttggatatgtttctgactatatgttattcgcaggattgccggtcagatgcccaaagcttttgacatcctacaagatgttgcgcaacacactctgtctaatttgcatgatatccagaagagcttaatattttggcagtccaaagcagaggtataaagttgattcataaaaattgaagtgcttctacacttttaatatgtagagaagtccactacttactcatcttccgttgtcctatgctattttctccagggaacaagttcacagaaactgtattttatgatctttgaaagaggtccaagggcctttgtcgaagcagcatggcaaacactgactagactcaagagcaatgggagtccagtcccgcaccttttgcactctgcttctgatatggtctcaacaaaacttgctgtcctgacaagtatgcaacactgcttggctgcttttcttgctgaggtttgtttaatcaaatgcgattatcaatatcaaatgctgatgtcaagtagaataaattgttctttacaatagtttcaatatcaactttgaagcagctcccctatcaactggtgtactatggtgtccaaattattcaagctcttctttttaatactttggataaatttacttatagaacatggctactgtttctcatacatgaattcgaattctaccttgcctcttctataggtttactttgaagttgataagtgcagaaaaggactaacagaaagttcagataaatcgctacatactctattcattgttctgaattctgtcttctccaaattggaggtatcatttagaaatgctgttgaggtatgcaatgttctttttgcatgttttggatgttacaagtatgacatgctagctatttcacatagtttcatttcttcagggacaaactctattatgcacacatgatgggaagtcgcctgaacttatctttgaaagattgccagaagttgatgttgagagttcagagtggacagaggtgttatcagcaaatgctataacattgatctaccaaaacctccagaagttcgatgattttatttctgatcaggtaatcaactctcctttttacaacaagacacatgccatattgttacttctcagccttgcgggttccacattaatgctaaccgagttggtgaaggcgtattgagggagcatttctatagatcaccctctatggctgtacctgtttgtgcttcctgtagaaaatatttgtgtttacacaacttagcaactaatttctgtccatgcaatgtgaatgctttcagtctagaaactagtggtagaagtatagatataatgcaagacacaacggtagttgattctaactgacaactcttttatcataataaccgtgtggataagaaggttaatctgttgaaacaccaaatattctcaaagtactagtttagcattgtccagtgaatcttttctttttcttttttgcaaaagttagttcccttttcactgaaattacacatgtttaacttcataccactgaaatattgctgttaacttttattttcaccgcgatgttactccattaactgctattatcaccttaaatccttccttttcctcttctcaatttcctttctaccctcgttttctcctgacctgatcttcaccctcctctgttgacgtggtgccaccacctaacgccatctctgcctggtctcggcatgaatctgtgtgtggtgttttagttgtatatgcccatccaccaccatctccaggactccgcatcaattttgcttcgacactggcaatgtggacataccacagaggcatgcgttccttcagctttagcaaggagataccagcaagacattcacctgctcctgctgcaacaaggatatggatgtgggtaatgagagcttgctgattgttaccccttgttgccgtgttgctgtctcttgccagcgagtgaatgagggttcagttcctttatgcttcttccttcttgagcttgacctgggccgtgtcctttatcatgcgtgccatgcctctcgctgactggcatgtgcactgcttgctgccttcttctctactctcacacagggtaaatacgaaagtacacgtgtcttttgcctaaaaaaaagtaaaaacaaattataattgttatatagaagtgaacaatgcaaagttttagtggtatagaagttaacggtgagatttctatagcataactctgagctggtgcggttttggtgatatgaaaccaattcttttggttaaatattttcaacttattctgttattaccgtaataaacaattgagttaatctgtaattcttacttggaataagtgaggattgttcacttttgaaaatataaatttgctactgttcgcagaagttagaagtatgtatatgtgttacagttccattatgtgaagcaatatgttgcataattatctcaagcatattttttttctattgtagttttcgaaccacaaaagaccaagaaatacgaccatatattggttgccctacacatgtggagcattgggcctctctgcatgttctttatggcttttgcgccacagtagcttgatgggaagttctgacattgacaactggattcaagatgcaaaagaatcgatggttggtttttgggatgtgcatgttgggcaaccagtaagatactttctggatatgtccttttattgtgtaccatatgcatgatgctagcattagttaactaaagtcgaattgagttactttagggctcattttgataggtgtagtttatgtccaatcccttcaagttggcaaggaatttgaactaaaatctccaccaagggatgaggtctaatccccctatatgcagtatgtgagggtagagatatcagataatcacattaaccagtatagataattatattggaagacatacaagatgttctatgaaatactgtatcccaatatttatctgttaaaaatgaaaagcagattactgcttaattagcaagtgtggtatgctgttttgtgtactattagctgtgcttttgtgtcaatgttaaaaaatcgacttgcctttaccggatgacttcacttattagttattaccatcaacaatcttaaggcaattagtatatccaggttaagaaacttgttaatatgcaccttcatcagcatgcacatttcatcagtgcactaaattctgctcattcaactcctatgtgtgtccataacattttttacagaactcctgcaattatgcttgatttggctgataacttataattgaccttactatgtcaacaaaaagaatgcatccctctgtgactgtgtccagctaaactcgatgttctttgtacttttcaaatttagaaatcatctatattactaagctctatcatgacctcattcttctctttgagaatcattagatcatttccatcagggatgaactttttgagacattcaaacaaagatctaaacatgaaatggaaaaacaagaggtccaacaaactgaagaatcattgcgcaggttattccaatgatgcccatgctcttttgtaaagcttacacatgcatgcttccttactcaaaacttagtaaagtattgttctgaattaggcttttctccttcaaacctacacgtgcctttctccttaccaaaactttttatagaagtgttctaagttaatatccatttgatatggcctaagtttcacctccttacccaaacaagatgacatgtatctgcagtttcaagattttacaatgactatatatggttcagtaatgtaccagacatccatgccatttgaattatatgcgcccttttactttcttggaagtgttcctgtatgaaattgtgggttaaaattaggttttgcttcttgtgccttttttatatatctcaggtaatatcgatctgttgactgttgagattgactaattttcgttagtaatcaacaaaaagggcttcatctcataacctacatcctgtttcttgcttgcttccttctttttttttctttttttctttttttgccttttctagtcccttgacaatattcatcaccctggagctatgtactttattcccacattttcttggaactatgtaaaatttcaggtttgcattgcatttattttctgaaacacattgagtattataaaatggtcttgcattatctcaccgtacatgttacatgttgcctttgtaggatgttgcttgacttttgtgggaacacttcaaatgaaaaaccgccacaagatatgtcagagctagcaatgatggagattgtcatgaagaggtaagagtgtttgaatatttatggtgtcttggctttgacagtcatagcttatttcaaggggaaaatttgcacgctcaaaagtcacctggaattattttgcttttgtatcggaatctattgacaagaaaaaatttgtgtttgtcaagtaccattttttaatttttgtttgtttcgaaactaaattaattcagttggtactggggacagaccttgtcttttttttttttggtggaatgaccaaaggaggtcattcaatgtaattaagataggaagaaaaagttacagaccttgtaatgaaaaactaaatattagtgattctcataaggctgtacataagtgcatcccttgatacctccgaggggtataagtttcgtttgaaaaaagtagaaacgaaccccacccaacactaacacgtaacaccccttactctatacttttctaacaaactacatatcttattccaaactaaactgataccttcctaactaatagatatgatagcaaataagtactctctattattgcaaactaccgaatttatttgggcaataggcgttattattgtgtaaggtttaccctttcctagtcatactgctgcagtattgcttgctgaaaaactgacgcgcgttccagctgtggtcacaaaaagcttttgaacttccattttattttctctgcctggtttcacagtgtaggctggtagcaactggttacccatagttactggccagtaggtttttctctgctggttactagttaccactcggtggtacttgccagtaactaaagcctgtgagaccaaaaaaggcatagcacatctttggctttccaactgtaattttctcaaggatttctctcttttgtttcagtaaaggtttataacctgttggtgaaataatggtactatttagagttaaaacttcaagatgggtttgactcagttccaaagtgggctgaatcaatattttcttagtcaaaaataaattttaaaatgatttgatcttgatgtgcataacagttaagttcgtgttgtagaattctaatctatgtctcatcttgcattaaaaatgatgaatttttgttaacaatcctaagtttagtatctttgagtttctgccatgatcgatgaattaataactttctaaattctaatattagacacaagcttcaggaagttaagaatcatttgtatagttgcttctatgactccttggagtgacttgttgcatggcttatgtcaatagaatctgaacttctgcaggagactttttgtgtattacatgctttgtatgcacttatgttgcttacataacttaatgggcacttcacattttatccttatttatctgatacctaaatttctatgcttttgacgatcactcaatggactaaattgatggagcttcttttgttaaaaaatgaaaactaaactagctgtttacattttactgactcaagcaatgaacaatgacacttctctaatatgttgatacagatatgagaaggaagcaatgcatccatttaaaggtctttccagtggaaaattaacatgtgcattgtctattcaggttcttccccttctatctctatttaggatgcactcagttcaagttaacctgcattttttctaacattctgatcctaaaaattcagattgagaagcataaactggctcttctggagtaagttatactaatgtattctgacaatactgcttaaaatgcatgatgataaattttttatgtctaatattaaactgcaagagatgattgaattgtttttacacagggcaatgctggagctggaccagatccttagggcaaatgagataaactttgctattcttgcagcactacctgcatttggtgtttcacttctgctgctctttgcagttcgagcatgggctacacatgtatgtataaccatatagacccattgctgtcttattcaggggcatctagcacaaatagggaagattttcactactttctttttgaaaaaaaatacaaattgatccctagcaaaacatttttgcagaaatggaactttctgcactacaccgtgatattaagcactatatattcgtagcatgggatctcaggattcggggctgtgtaaactaccacataggatggtccctagatatgctagagttctacaaaacatcccatgtggtagtatacaccgtgtcatgtacgtaaacaactaatgtcatggctctgatctatttttagcaaagtttcatgaaaggtctatttgtaataatattttctaaaaggggacaaattgtgaaaacactatccgcaactagcaggagatataatcttgatatattatatcccagtggtttgcagttttcaccatggacaagtgtgcatgaaaaagataataggaatactaggttcagatatggttaattattgtcctcactatgaaatagggccgtggtgctgagggaagaggtaggactgcacggcgtcagcgaaggctgcttcttgctgatgtagagaaaaggcttatggagtttcagaattgcatggctaatggaatggtaaccttatcattatcttaaattagactacatgaccttatcttgatcttaaattagactacattgacatttatttggatgagggacaaaatacttgatctggtttcctgttggtggctattcccttctctaagaaatactaccttcgttttttaataaataacaccgttgactttcagaattacgtttgatcatttgtcttattaattaaaaaaactagtgtaaatatactaaagtacaagtcatatttaaagtttctttaatgataaaacatgtcacagcaaaacaaatgacatttgtataaatttttttaataggatgaatggttaaatgtcatgtcataagtcaacaacttgaaaaaacagagggagtatataacgctttcctattgtattttgtctgcaaaaaccttattccttcacctagtatgagaaaacaagaaactgccattttcaagattggacatccccaccttcgtcttgaaaatccaagattgaagtgctttcgtattgatgagaaagtcattttctttcgactttcgaattacaaacttgaaaaatattaggattacaatacgtactaataaatgtctggctgaatttcctaattttacaggaggaagaggcatgctgtaagttcgggttaacactgtacacccttgatagactatacaaagctgttgaatcgcaggcgagagaaacaggagagtggtcaaggtgagtctcaaactcatagctctttttgatacttcccttggctacctaggtttgattgcctgtgaaccaaaaaaatcgttttccgattgcagcttgagagaagacatgtttgatctggcaaagcctggtgtgggcatggaagacaagctggttctgctgtcccggctcaaagggatgtacgactgcttacttccatcaccgtcaggtgtcttgccccgtctgtagtcttctcatcttcctttcctttccttttcttcttttctttttggtcacgtgtgacgattagtgaaccccaatcttagacgacatgaatttgcttggcgttttaagagtcgtcaaattttgaattttttatgccccgggtactttgattgtagccctttcggctccatggagtgatgatggcttttgtgctgctgcaatgtttgcaccagagattactgactgtaaatccaaaatctcttctaactggatgcttaattcatgtgccacacccattttacatttgtttctcatcattgaagcacatcgaaatttagggtggggatcctctaccataatatcactatcattataagtcacttggtatgtgggtctcattctcctattgtcctacacataagtgtctataattggagtgccactatggtagaggatgtaaaccctgaaatttggccctggaaagcgtgaatgtgtccagatactccatgttactagtatttcgtagtatatgttagctgtgatctaaggttgtgttttttcctccaacttcaatgaacgatatgttttttcacaaattttctataggaaagttgtttaaaaaaatcacattaatctatttttcaaaaaaagttaatacttaattaatcatgtgctaataaatcgtttcgttttatgtgcgcgtgagatgggttctcaactcattgggaagaacatagcctaaatccacactgcaacttccatttttagttagtacgcttttcaaactatattaaaatagtatattttttcttaaaaaatgtttctaaaaagctcattttaaagtgagtaataattaatactccatccccaaaatatatgacactgttattttttattttttcataaaaaatatagtataaatatgtaaaagtataagttaagaaattgtagattacagtttcttttgatgataaaacaggtaaaaaaattattcagatggtttttgaaaaaaaagagactaacatccattttcattttccatgacggagataagaaaatactactaataacctttcatcaaaagattagtttatgaaaaaaaaatgctatctgtaaattagcccttaaagaaagaagcacctcgacattccttctatttactttatacttaaacaaagggaaagcattgcatacttacatttgcatgcgagtatatacatagatagcacggcaaaatcctagttaatccagatcaccctttcttaaatttgagaggagttattaattaatccacatcatctatgagcacacgcggaagaggaggaatcggatccgtgccgcgttgctccgggccctcgccgtcatcgtgggcccggcccatgaccagcacgctcagcaccacgcgccttcccctcatcaccaccctctccccatgcaccatcgccaccaccaccttcttcttctccggctccgccgccgtcgccggcggcatctcgtgccggcacagcgggcagctgccgtggatccccagccaccgctccacgcactcgccgtggaaccggtgcccgcacggcatctccttcctcctcccgctcccgcacgtctccctggactcctccccgtcgtcgaggcagatcgcgcagtcggacgcctcctcgccgtcgtcatcctcctcctcgacctccctcagcgccgcgatcgatgccctggacgccggggccacgccgccgccaccgtcggcgctggcgctgccgtcctcgtagaagacgtggtgcaccaggtacgcccgcccccgcagctccggcgccgacgagacggacgccccgacgagcaccggcggcacgcccgccaccgtccgcccgctgtccctgtccgtcaccggcgtcacgatcgacaccatcgacgagggagcattggtgagcgacattacccgatctcttcaatttcctcttaataattcttcgcgatgcttttgctaccatctgcctcgctctcgctatcgttctcgctcgatttgatatagaggaggaaaagacgccttctcgatgatcggtggattgggttgatgatgcgcatggcgccaaagggttcgaggtaggtgagccttttttttcttttttgtctcacaattttgcagctccgacaaagcggtggcgatcgattgggatttgggctccacatgtgcacttcgtcttcttgcagcaacacaaggtccatcacttcaattttggatgcatgctgattttgcttggattcaggctgaatttggtttgtttggacaccagaaatgtccttttttgactaggaaggttgttgctgttcttgacatcccagtgcaaaaggggtttgatgattcacaattttggaatgttcttggaagatctctttgatgattgacaattttggggtgttcttggaagatttctcatggtggagccatgtgcgcagaaactcagcaaaaaggcagacctgtgaatttgttgatatatactggattgttattgacatttttgaccttttgtaactatgcaaaatactacaggtcaacataaactgtgacgtactctacaatttaaaaatgctttctggagaaatttaaacacagaaaagaatcacatatcagattgatgaaacggcagcagatttgacttgatttgtcagaagcagcaatgatcaggtagagtgccaacgcaattcagccccagaagaaagaaggctaatccttggagatagagatttatgtagaagctgttctttccatggaagacaaggttgtaggatgcacaaaagatgaggaacaccgataatccgatctcaggtagattcactctgcagcaaatgacaatgtcaggttaagcatgcatgcagaactccagcacctaccactaccagcttatctaaagattgcagtagcaaattggagaaataaattttacctgtttattaaccttttcctggatttttgaagcaatggagtctcattattctcgtcgaaggcattgttccccactttcttcgtcacaatccattggttgaattcttgcagttgcagcagaccagctacagcagctctcaaccgatgcatggacatgacgctctcgaataaaatccacagtggcactgtgtgcagatttctggagtgaaaagacagttatggcaaatcaaattcatccaaaagggtaaagcgatgaacaaactgtttgagaattgtaacaaagattgtaagagagaactgactctggatttcttatggcagtgacaatcaggagtgctgtaggaatgtaggcaacgccccagattggcaggaagagctctgggatcatgaccgacacagggatgataacattgtagagaataaaggcaacagcaggggcaacaactctcctcaccaggaagaagctatacagtatgtagatcttcttcaaggatgacactttctgacggagcaacagtggcaggttatgttttatgcagatttacttgttctggttcatcaaaaaaggagaagaaatggtaccttggcaaccaagacatcccatatcatctttcggaacaagtttgcaccgccacaagaccaccggaactgttgtcggcagtatgctttataagtggatggaagctcactctttacctgtgacgtatttgctttatcagatgctatcgtcgagtgattgaacagaacaaattaaggattcggtcttcttactctgaggtcccctaaatagatgaatttccatccctttaaggttgctcggacagccaagtccatgtcttcaactgtagttcgatccttccaacctcctgcgtcattgatagcttctgtgcgccatacaccagcggtccctaacaaggtaccagtgtttaggagactatcaccatgttccttttgtgatctacataaaacatgaacagtcgaggtgtgcaccattgaaactgaagaaagcaaatgtagccgatcctgcctcctgctcagctttgaagtggtaatcaaggaatgtcttctgtatccttgtcagtaggcttactctgtcattcactgtaaaattcggtcaactaaaaattggacagatcagaataaataaaattgctatatcagagttcaatgatgtgatattatctacagaaccatttgtttcgatctttgtcttttgtaacaccacaagaatcaagagctaacagaaggccacttcaaatgcaaaattttggtcaccttaccaatatatactgaatacttcccgctagcaagaactgcaaaaggtagtctcaatgacatatcaaaagatgaggtcttaccaaaaacccaccgagcttgtacaagcgcaacattctgattgtgcatgaggaacgggacagttctgagaaggaaatccggttctggctggaaatcagcatcaaatatggcaacatattcgcattgcttggcatagtcccactccattcccttcttcaaggctcctgctttgaaccctttgcggccacttctggtggcatacttaatgtttagacctttgcttgcccaatcctcacattccagctcaaccaaattctgcaaattaagtaaattcttgttcattttcattacattttcacaaggtagatgattaatttattgcccttctgtgttaacaaagtgctagggactgcaaatatatgcacactaaaatgacatgtacagatgtactaaggacgactagaggttgagttgggtaatttataacttttcagcttggataagaaaatatttacacatgccagtcaaaggtgacatcattcagttcaccagatgccaaatgctgagatatcccgaccgcaactgccttttatccaactacaactgcctttttacacaaaaagtaagccacaaaggtaattgatgtaaatagtagtttgtcaaataggatgtctcatgcaagtaaattactatttaagattaagtacttattgtctagacaaggatacttgaatcagctaatacttctttacatgaaactaaccatttatgacagtgatcatgttttttacagctacagggtatgtcgtcatccttttctttaaaaggtaatgatcaatgacgtgcatttcatttttcttagagaagggtttttttttttacctggcctctacatccaaccagatatatgcaaccttacaaattgagaacttagcccctcgaataacccaatctgaaattcgctcttatggagatttaaactcaggactttaggatgctacttaggtcactgtaaccactagactacatgctcttttactgtaatcacgtgcatttcatatggtccaggcacatgacttagctttcagtcctaggacctaagacagttaactacttaaggttaggttcctatgacgaaacttagttgcttttgctcctttttatactgatagtgatatatgaaagtgaaaagcaatgtcatccttatgtacaactaatccaactcattactcttcagtcttcacacaggaacaatgctaactcgttaagctaacatacagaaaaagtgataatctacactaattacagattttcagaggtctaagctcctgacgaaaaaaaaacccggagtttggacatctcaatcatatcattcagccagaaacttgcctaacaataagaaaaaggagagataccttgataaatgcgtccgtggaatcatccaaaacttggattatcaacctctcctttggccacttgagcccacaaactgctccgattgacaacttgtacacctacacccaagaatccaaaacatttgaattcggccgtatttgtgtctaatttgaatcttgttgaattgattggttattacctcgagctcattatacatgggtatctggaccatgaccatgggataagcagcagcagcagcctcccccttctcctcgtcgccggcgccggcgccgccgccgaggggctcccacttgaaccaccgctccggcctccagccgacgagcctggcggcgacgctgacggcggagttgtaggtggcctccaccaccagcatcaccgacatcaccatgcacgcccacaccccgacctgcagcgccggcgccaccgcgcgcgaccgcgcccccacccacgcctcgcgccaccacgcgccgccgccgctccccggcgacgtcgacgatccctcgccgacgactgggaacgtaccacgacaagagctcagctcactgaaagcaagaagctaattaacttggatgggaaaataaaaatggaaagaaaatcttggaacctgtgacgaggtaggtgaagtcgagggcgccggtggagacggcggcgaggagggagacggcggcggcgaggaggaagaggacggcgccggctgcctcgccggcctccattgtttctccgggcggtggcggctgccgtggcctctggagagagagaggagaggagagtgatgtacaacgcaggctgagctgagctgagctgagcagttggatttttatcgctcagctctcggggggcacgtggacgggacagcgacacggcggggccattatattgggtctcaatgccaatattttgcgcttaatagtttagggatatttaccattttcgttaattgcttattaaatcaaaaaccgtcctaaaaaaacgagagaggatgataatagtgatatggtgatggactggtggattcatttgatttgttgcattctgggtaaggacaaggaaagattcatattcagcttaatttgtcaaaatgttgagaattaaagcactatagtttaaattatatctatgagtatattatacacttatgagtgtcctttcaaggattcaaatcgatttccataagattaaacacacaaaattgcgttcccaatagtttagtgcacaatatgttggagatggatttttatccctcgaggaaatatcctcttgttttgtgtctgttatttaaaaaatcatcaaaaatttgaaaataaattatgaagataaatcaatatatgaaatacctttccacaaacatacatgttaaaatttgaaatataagattcgaaacaaaaataataaatttgactgcggttacgcgttctattcatagtcaaatttgttattttgttttttcttgtataagttgaatttgaacgtgcatgtttgtgaagtgacatatcacatattgatctatcttactatttttttctattttttatgacttttaagttacataaaaaaaataaggggatattcccttaagaaatgaatagagtttccccaattgttactagttgtgagtagagcagggtcgcggctctaggctaaggccggttgtgggatcgcctaaggcacaaaccaaagggaacctcagccctcaaatcaaatcgatatcgtgccaaaaaaggcgtgcggacagccatgtttagaagggcaatttaatttgatgatctagggtgtcaagcgtgttgagtattttagatctttcagttgaggcattgagccattgaatatctcgggcatcatgtccgtcggtttgtcctcgatctggcggttgtgacacatgtgtagtttatgttacagttaaaaagaaaagccttacgagcctatagtgtcgaactatcaaatttacctaggccctcgaaattgtagagccgatccgatagtaaatgtgatggttaatataactgtgtgagtgtgggttggttatgtataatattttatccatgctttttttttagggaatccatgctcttttttttttggcattgcacaggtgcaaatatcataataaaaaggaaaataaatcagttcgggtggtatggtgatttggagagagagagcaatgtgctggaaagatggtgagtcaccagtcaaatgtcatatgtggctgtgtcatatgagattgaagcttgcccattgcatgatgagctaagaattaaaatttcctgcgagaaacatcctgagagagaacacctgtcacccggaaagattagtttagatcgcccccatttgcatagtactagtatatagtactatgagccaaaattagtaggtcacgatggaaaacgttacaatatttcagagaaacaacctaactaaagttttacttgtttctcttgccttcttctcagatcgatcaatctattatatctatttaccagagtgttgcacaccggctgaccgatttgctgtgtaattatctatggtactatgcgccacgtggataaattaaatgctgtcgaatttaagctgcaaatcctaacaagttagtggtggcagttgagctctcatccatgcctagaaaatccaggtgtacaactttagcggacagagatttgatagcaggggacgaaagaagaagaagaagaagaacaagttgcaatttgcatcatgcatgtaatcatcatacgtgtgcctgaattttgaacgagatgatgatcgagcttgaagaaccagcctaaaattaaatgaaacctatgcaggattaaccaaataatccaagtggcgagagctagctagcttagggcggaggtggagtggagtatgggagggccgatcgaggggctgcccacgaatccggtcaaacaaaattttgtagccatatcttacttattttcaccatatatacaccctctcaatacaaacttatacatccacatctgcttaaatttgatctaaagtaaattaagcaagtgttactctctatttcgttctagctccgcccttaaatttacagcgcgccaaatctaatggtccaacaataattaactaattaagctggctgatctcggccgtatcatatgtgtgttttgctgggtaaatcatcgatgcatgcgcgcgactgcatatatatgcagggatttggagaaaacaaaaaggaaatgtccagctcgatataaagtgtgcaatttaattgtcctgctctattctatcataaatatttgacaatcagaataaattttgataaatagtttctcaaatgcttagtgtaaaacacaaacaaaatagtatacctacatttgcattgaaaaataatattatatatcatgaacttattggattttataaacttatactgatatataaaattaatggtcaaaaatttgaaaaaaatggatcagacattgcttaaatatttataactgggtaaagtatctgttttcctataaagcgatgacatgtatgatatgtaccgtttcttccttggactcctcgatctattctactacttcacttacatataaatcatcttatcaatcaagttgaatgaaaatatgtcaagttcattttttttggctaaggttaaaatggctgaaatgcatctttataggtggaagtagcaactccttgcgctaggtgtatgtaaaaattgaggttttcctaggcgatcaacacaactgcaagtgaaaaataagatttttgcatgtggcacatcacgatgcttgcctgtaaaaagaatttttagccaaaaagaaaatttttgaaaccctagcttggtagcggtcgtcgttcccatgcccagggtcgttgtcaccgctgcccctaaggtcaccacaatctttagtcaccactcaccgctcctgaggcaggcagcattcgatccgcactcctaaggctaccgtagtcgttagtcgatcctcccatgcatggcggatccaccactcccaaggccagcggcggtaggtccgcactcccgaggccattgcggtcgtcgttgccactcccatgcctggtggcagtaaatctgctattgaggtcggcggcggtagatccgttctcttgaggccgttgcagtcatcattgctgctcccatgccgcccggtggcgacaaatccattctcctaaggcttctacagtcgtcgttgctgctcccatatgcccggtggcggcgacaaatccattctcctgaggctgctacagtcgtcattgctgctcccatatgcccggcgatggcggatccatgcgctaagtatggggagaagcgatggaagggagaggtcaccggtggatccgcttctcctgttgctaccgacggatccacatacctcgagtctaccgtcattgtcgtggtcccacttagccgatgtttcgcccctccccaccgtcgtcgtggtcaccctagcaaccatcacggcatcgccccttcccgcacgaggcaaatctgacgcctccaccaccactcatcccaccccttcgccgctatcggatccggttaccaaccgtcgaggagaggagataaagggaggagaggccgaaaggaggataggtgaagtaatagggaggatggaaaaggaattaacgcatgggaggagagaaaaggagagggagcgggactacgaaaataaaccatgtaggtaggttttttattgggccccctcctattttttctacattttacatactagtaagcatgcacgtgaaatccacgtgactaaatatttaataaattatcataactcaaagattgacaacaattgcatgtacaggttcagaagcaacaaatatcccctttactgatcaatacatatcctcaaatttgacaagcaaaatatgattgttaaagatcatattatgaaattcacatagcacatgccaaaatcaggagataatatagcaaatcttgagactttggatgctcaaacacagccaatgtaagatgcttgtttggttcaaaaaattaaactacaaacactaatgtgcagaatgacaggactaggccatcttgtaaacaactcttctaactcgaacacctcaacataattcaggaagaacacaagaaatagggcaaccaatttagattacaatgctccaatccaacaggattgagccgccgccgccatcgccaccaagttgcccgttctgagttttaattcagttcattacattgcttatgtctgaatctcacccactcactcgttctttcccctcacacacgccaattcacacagctttcaacagcacacttacatggcccaatcaggcccataattacgaggattcgccttggcctgtctagccggacgccgagtctgaattgggtccttcaggctggacggcctcccctgtagcccatccgatacgcctccttgttcagcagtatcatccccttctggtacatcatcagtgctcctggcacatctgcagtttggtaataagctcataaacatcccactacttgaactcacattatgttcatatcaatttgaaacatctttggggatacaataactgacgggtctgcactttaaagttctgaaagaaaacttgatccaagacagaagacatggagatatgtcagtgttaacctgttggtaagatctgtgtagggaagagacctgaaagatggaaaaagacctgaaaggaagtgaattgaagtggcctgtatacaattcgctggtgttttttgcagggataatgcttaccaggctgtgcaaaggcagacgatggtgcaggtccaatggaaggcatgagcgtgggtcagtcggcggcaggagcgcggttgccagcctaggaaaaggcaaggggtcagtcggcggcagcgttcaggcagggcaatggcgaggagaggcgacgccggcgggagcgcgcgcggttgccggtggagagaaggcgaggggtcagtcgatggcagcggtgttcaggcgaagtgatcgcgatggcgagataggctgggtgcaggcggagtgcggttaccggtcgaggtcaagggaaggcggaggcacggagggcaggcgtgttatcgatcgagaggtgaggcggaggcggagcacgtgggctaggggtcgtgggactgaaggaggattgcgtgtttccttcggaaaatccaagacttaatcccgtgcgttaattcgagtggatcggacggataggaaagacctgtggggggtagtccaagttgctcattgtagtatagacggttctttttaaccttgcctaaaaactgagggtgtatgaaaaatcatttctttacattcctctaactgtactacttatgccaacgttaatcaaatacagcctctgcaggtcatgaccttcctgttgttatcctcagaaaaaaactccataaatggggccgcatcagttctacatggatcgccacatcgatcgatcacacaaaccaaacgccgccgagcacgcgcgcgtcgatcgtcaaccgatcgatcggctacttcactgcgcggttaaaaaagaagagggagagcgatcgatctgctcgatggggaaactaattaaccgagctgtatcgatctcggcattgatcggcaaacatgaatgatcagatacgcgtgtggtgagcttgcatttccgtcattaacttcttgttgtctcctgcgaacgaacgaacgggatcccaaattcggcaggggggggcgccgccatggatactgtcgagatatgcatgcggctatagtaaggaaacaaaatcccgtgtcgattatattccggggggcaaattaattctctcgatctctgggttggcaatgcagtttttatgttcgtgagatctttttcacttgggtttgttggcatgtgattatgttcgtgatctctctagctatctgtgtgctagctatagcgaattaagagccgagattcataattaattaatttagctagtagagcatccccataggtttggatgtatttttggagcattgcatgcataggttgtgaatttggtggcggttttgttgtcagatggactcctaaacaggatagagtttaatttatgcgttgtggagattttcagattatagcattaatttgtccccatttatcagttttttttatgaggataacaacgttggctcatgaactgtagaggctgtatttgatttacgttggcatgagtagagagttagcacaatgtaaagaaatgatttttcatacaccctcagttttttggcaaggttaaaaagaaccgtctatactacaatggagcaacttggactaccccccacaggtctttcctatccgtccgatccactcgaattaacgcacgggattaagtcttggattttccgaaggaaacacgcaatcctccttcagtcccacgacccctagcccacgtgctccggctccgcctcacctttcgatcgataacacgcctgccctccgtgccttcgatttcccttgacctggaccggtaaccgca

SEQ ID NO: 66614 - DNA, 36525 bp, Oryza sativa
  unsure (1)..(36525): unsure at all n locations
cctcccccggggtagatgggccgagagagattcggcccatcgaccccgggggaggcaaaatagacttttgcggaggaatttgatttggaaggatttggattcgggattgaactcgacgatagatcggggatttgagatcttgagatggcacggacactagacaataagcaaagaaacaaatttcgcaattagggtttttaagagataattttcccgctaggcgccacgacggaacgggcgctacagttaatcctatatcctatatatctataaatatcatccccactaagtatagttaatgctaattttctctactctcatgaagccacatcacttcagttacttttaaccttcagatcattcatcaagggtgcaaatttcatctcttgtccaaaaaccacaccatatataaccgaatcattataacctttggataattgatcaagttacaaaatatataagcacattaaagaaaattgtattttaattatgagataaaattttacaacgcatatttactatttttttcacataatttcctccgccgcaaagcgcagtctatactttctataaagttataacatgcaaccatgccacatcacactggtggagaaaccatctttgctcggttagccaaaatccacaatagtctcggttgcaataaaaaccgggattaaagattatctttagtcccggttaaaaagtttagagctgctttttaatctttagtcccggttggtggtgttaccaaccgggacttaagatctattttctatttttagtcccggttggtaacaccaaccgggaaaaaagatgcctactatctttagtcctggttggtgttaccaaccgggactaaagatctatgtttactccctggtggtgataccaaccacaacaaattttttttggcggagagtacggagggcatctgccatctgcgagatcgaggaggaggagacgggcagccttatctcttcacctcttcctccactgaccttatctcttcatcccatctcttcatcttcctcctcctcctctcctgtaactcctctccttccctcccccatcatcccttcctcttcctcctctctaacttctcctataactcctctccttccccctccatcatcccatcgggcggccggcggccggcggcctcgcggcggcacgccgacgggcaaaggcccgggcggcggcctcgcggcggtgggcggcgctgcggcgcggcggcggaccgcggggcctcgtggcgggcggcgcgccggctgtcggcgcagcggcgggcggcgcgccggctgtcgacgcagcggccgacagccttgtgttttttcttctttttctttctaagaatcttgtcgattcgtgattctgtgctattctgatcttgtgctgtgatncgtccgtacaatatcgtgcatgtattctgtgcatgaaattcttgctagaagcttgtgcatgctaatttttcgttcttaagcattcttgctgcatcttattttgcaatactgcgccgccgatttggggatttgaggatcggggataatttatttgggatttttggatggggatagagtaaaatcaatatattaaaaacacaatgaagaaaagaaaataataatagagcaaccggatctagctagctaggctagctctatcttaccaaccgggactaaaaaggctctatctttagtcccagttggtaacaccaaccgggactaaagatgtatttttactcccggttttttcacccgggactaaagatagtgatctttagtcccggattggttgtcccggtttgaaaaccgggactataggggggttacgaaccgggagtaaagcccctttctccaccagtgtcatcacccactagcaataattgcatgcaagcatacaccatcatctacaatatatttaattctacaaatcaacatacaagcatatcaaatcaccaccctcacatcatttacacaatattttaacaaatctatctatcatttttatagtatttaacataaatttatcaacatgttgaaaaaatatagtcagaattacttagtaatctcacagcaaagcgcggggaatcacctagctaactaatagatgggtacctgcgcgttgcggccaagccctgctcgatgttggcatatatggtgccgtggggttttggcaccagtggctggaaggtgtcggcccaatcaatctccttaacttgcttctagaaaaaaaaaatctatactaccaatcatgtatatactatgacagcacacgtgcttttgtttcacatcctatcgaataattaaatgttagcttgtttgagttgtggcttataaattgaaatcagttttgaatggtagaacataattttaggattagcttagggattttcttttgtcactgtgtcttattattttctatgttaaaagtagatctagaaaatgtaaaattttaccctaaaattattttgaattccaccagtcacatgtttttagctcataaaccgtacggggaaaaaacatccagctagaccctagatcgtcctagacctgccgaatatatatagctagcatccccgacaaatatttccattttatatcaacaagctatttatatatgtatatattttaataacatattagcgagatgtatgataaaataattatgtatgaataaaaacagtacaagaatattacagttgacttgtctacaaaatttactagagaaattttacacagtgtagttctaggaaaagcatttctcacggagagagtgtgcgcttctatacgcacaattgcacgagtcgcaagtcgcaacacgatttttttctgttattatacctgccaagtaacaagccaccttttcaatcttagaacacataaattttataagttctttatagggattagttcgatttccctaaaaattcttcacggtttctccatttcaaaggaggctggttccctgaagtgtagtgtgactgcaacataagcaatcacaggctacaactattcgatttgaatttaagggtaaggatttgctatagatgagctattatagcgcaatagatctgaattcttcgtgcaaaaaaatggatggacaagatcaactgcagttacgactgtagctgatctcaatccatgggagctcctgtgacaccaaaataatctaatggcatgggagctcctgcgtcacattggaggcccccagttggtgtggtgttctctgtggcgatgttccaaccagaccggcttcaatggttagagcgatggcaagatctaggcgaatgactgaattacgtcccagttaatctgcaacgttatctttctttgtggttcttatggtcaatgatgtgagtgagattcaatctgtaatgatcatctcatgtttttagagattatgtttctttgtttgagaagatcataattaaatataacttgcaagctattgggaaacaacggttatatacacagattctcaatagcagttttacctctgtctttaggttgatagttcaagcagttttctcgttttaatttaagttgtgattttgtaattcatagttatttgaccagtaatctgtgtaataataattggctatatatatatatatatatatatatatatatatatatatatatatatatagtttagagcaagactagaatcaattcaatctctgctattataaaaattaaagatgtttttgccgatattttggtacgtcatccgtgtatgagtcggtttttaagttcgtttgattttagaaatacatatccgtatttgagtcggttttaagatcattcacttttggtaatacagaaggaatcatataagaaatctgtataaaaaaaaactcgcatgctaacttaaaacgatcggactcctaactgcagctcattattttccaaaaaaatatatatccaagcgaactcccacagtgaacttcatcttaactaaaccatataacagtaataagattaaaatagacttcacccgttgcaacgcactggcattttttatagttatttaaaaaaaacaagatggtatgcaccatagggagtagtattaatatagacacgtatgcatgatactaataaatataaaaaataattttacattttgataagtattatttttctacctgctccactgactcttgctaatccatgtaacagatcagtgtatattcatgtgtgtactgttgtacggatccagagcactagtagcaagagtaaacagtaaaatccagcaacaactagtagtagtaaccactggctcgctagctaggctaaaagctaagcaattaactcgaattaattcttaatcaagtcgtgtggctctagtaccagtacttgcattgattggtagtaattaattaattaattaattagaaagcgtaattacggagagctacgtccagcagctgctcgtccagtgccagctgcggctctccgctgtcgtcgagcagcagccacgactcgatcgccgacagcggcgccaccccggccgccgtcgccgtcgcgtcgccgtcgtcgcacgcgaggagcatggacgacggcaggcagttggacgcgctggagtcgccgccgccggagcagcagtcggcggtgagctccaacgacgtcccggccgtggacgcgctctccgcggcggcgccaccgggcgtcgtcgtcgccgccgccgggttgcaggctgacaatcctttcctggccggaggcggcgccgcccagccgctcagcatcacggagatgttgcgctcgctcagggcgtacgccgccgccgccgccggcgcgggcggcccgctgctgatcatcgccggggaggcggcgtcgtcgacggagagggcgtcgcggagggcgcgcctggcgaggtcgatgtcggtctgcagcttgcgctcccactgccccctggcgacgagcggcgtcgtcggcgtcggcggcgaggaggaggaggaggtgagggcgagcttcttcttgaggtgggtgttccagaagttcttgacgtcgttgtcggtgcggtgggggaggtaggaggcgatggcggcccagcggttgccgaggagggcctggaggtggaggatgaggcgctcctcgtggtgggagaagccgccgcggcggatgcccgggcggaggtagttggtccagcggaggcggcagctcttgctgcagcggaggaggcccgtcctgggcggcacggcgcgccagttgcccgggccgtgctcctgcacgtacgacgccagcaccatgtcctcctccggcgtccatggccccttcttcaccccctccttctcgcaacacggcggccgccccatcgatcgatcgatccgtggtccaacacttgctatagctataccagatggaaggaagcttgagcttagctttatatatatatacacacagagacagagagagggagaaaaatgtgaaagtgactgtagcccggtggttataagatcgttagtagtacttttgggagtgaattttccataatttaacggctttgtgcttttagtgataagcgacgtacgtacccgttgacagcgaagcgtctggggtgatttcatcaatctccaggatttgctagcccgttcttcgaaggttctcaatagggtaaggtttgcgtgcgtgcgtttatagaggtgagtgtgcgtgtcttgtaagggtctgtgttgtactgtgtaattaaaaaaaacagggagaatgcccaggcaagcatgtgtgtgtatgcacatatagcctagagctgactagctggatcgtcataattgtttcaacagtggtatccatattagatttagtttttgtatggtgacccagaattatttatttaggagaatggattttaaactatccacgtgttgtctctttatttcttgtatgacattcaaatagttatgaattttttttaaaaaaaagagagaagatagattaattaatacatgatcgattacactgcattttacaaagatataagttaaaattcgacatccataagttgtagaaataataaattaaactttagcttagttaacatatatttacatgcaaatttgtttttaatgttgtagaagtaatatttaaaacttgcatgtgtacggagcaatatatcacatattatctatgttatcgaaatattttaattttttgcacaaccctttatatgacttgtaaggaactggcgaatatattcgcatcagtttagaatcgtttcagttatttagatttaaagtaacagtaagtactctctatgttcataaatacttatcgccgatttaatgagtaaatttcacaaagctacatcagatttaagatttatgagtaaattttacaaaaaatatggatactttgaccaaattatcacaaaattataggtatataataaatttattacaaaactatatgtttaaagctaaatatctaaaactacagatgatataataaaattatgataaaattatagattttagagtttaaagttttaatattatgtttgagttataaatattcaaattttatgattaattaacttgacgttagacttgtagttttatgataactttattattacatatgtagtagttttgtgatatatcattttaaatctatacttttatacttctatgaggtaatgtcaattaataatacttaaaattgtgttacctttcaaacgtaaaatcacttcattaaaattagattctttcgagtcaaaatcgtaactttggattcttccttaattaatcaaagtccagaaagagattttaaggcaacggtacgtgaacggtgtgaatggtgacggacggacggatgcggtgttaagttgatgatagtatcgccgcgtgcgtgcatttatattataaaatattgtataatgacgtacatatagtaatttattaaacttcaatgtggtacaacaatatcggtcaatacctttaatgctatatatgagccaaatacaaatggactaggaaatataattgacaaatttaacatagtacttataatattattattagataatggaattcattccggcctttgctttaaagaagctaaaaccaattattacaaagattatagctcaaaagactataaatgacaaaatcatagcttgattaaaaaacaaagaaaactatttagactacaacctaaagaccaggataagccaatggcttataagttgtacgtatagtctttgtcttcctaagctatgaagcagaatatccaaaaacaattactgatcattaccgattgaaacgcgcatatcatcgatgtcaacacagcgaaagataatgtcggagagcaactaagatgtaaaacaatcctacgcagtggcgaatctagaaaatcgattcattggtgtcataacgtgtctatcggtgtcatagtatactaattatacttaaatcatagtataataatacatggataagcagttttgttataggttttgccgaaagtcgttggtgtcacctgacaccggccctattattgtagctccgcccctgatcctacgctcaaatcttaccaccagcctaaccatcgaaaacggcaacagggatgtacactgcaccaacgggcaggggtgaaaatggtacggaaacagacggaaacaacttttatcgttttcgttttcatattttttccggaatcggaatcggaatcggaaaccccggaaacgaaaacggaaacgaatattatcgaaaccgaaaacggagcgaaaacgaaccggcgcggatacggtaacaaaaattattagaatacaaaaaccccttaaactaagcttcaaacttttgtcaagtccaattctcaactctcaacagtccacaattcatcataaaacacaattatatgaaatcgtctcaacaacaaaatatattcctctataacttcatataatttgcataacaaatattctaaaaaaattacagcaaaaaaccatggtacaaggtatacaatatacactattattcagtgctatactgctaatctgctatgagctatcactccatcatcagtacatagttcatcaatcatcattcatcagtcatcacagaacagcaacacacatcagtccatcagtacagtacttagttcaatcacaaaacagctacttgcatttgatgattcgatccatcgtaaatctgcagcacaaaagaaatcaaatcgatttaggctcgtcggctcgtcgctaggctgctgggactgctgaggcgaggcgtcgtcggctcgtcggtgtggctgtggcgtcgtcgtcagtggttgtagcggcggcgaaacagcgggatggcgccgtggctgcgagacggccgcgaaacggcgggacagcgccgcaagatagtggcggtatgagacggcgaaaacggtgggggcgaggtcgcgaggagccgaggacggcagagaagcggtggcgcgggcaccgggcggtgggcgctggcggtgcgcggagcgcgatgctccgccgccggctcacggtctcgcgaagtcgtgtgcctgtctctctcctctctagggttagccactatttgggttgggctggaaacttagggatgagttatagactattgattctatgggtctttttaacttcggaaattccgacaaattttccagaatttttccgaccgattccgagtttcgacggaaactgctattatcatattcaattccgtttccaagaaaatatttccgttttcgattccgtttccgagaaattccgaaaaaattctgaccggctgattccgtttccgaaaacaggcctggaatccggaaagtttccgtaccgttttcacccctaccaacagggacctctaacacgacgcctctaagaaggtcgtggcatctatggtgtcgtcatcgctattatgggcaaacctgaagtatctactcgaaagcatgaagatgagctagagcattgcgacatcgccttcaggaaggtgtgtggagtccacaggcatcatcgatgttgaacactgccgtcaacctacatcgccacctaagccatgcgtcccctccgtcgccactacaaccagcaccgataagcagcctctggcttggtggtccgcggctgccttcgactctcggccaaatccagctggccctccaactagaagtggccgcagccgcacctgtcatcaacacctatgacatggatctgaggacaagcatacttcgggactttcgctagaggtaagtgcatgatgatgtcatggcaccgcgccaccaccacaatcattcctgccgtgcaacaacggatagctgcagcgatgaggatgccgcaaccgcaccgcaagggccaccgccacgttgcatacgccatgcaacgctgcaacctggagctcacccttcaccccgccgcaacggtcagccacatcgcgatagctgccgtcgtgatgaatccaaaccttgctgccgccttccttgctactacgttggcagtgaacttgagcgttggcgaggcggatgggagaaggaggatgagccggagggaggagggagctcaccaaagggctttgtctgtcgccctaacctgctccgcttgccgtcgccgctgtcattgctcgactgcgtgtcctcttctccgttagagcagttcgcgggagggaaaaggagagggctcactggaggtccgtcacaatcgctggagactcgtcgctcactgttggcgtagagaaagaatgagaggaggggaggggagaggaagggaggggaagaaatggataaggtgagagagagaagggaatagaatggataaggtgagagaaaggggcacacaacttaatctgtcagcgtgcgcgcattagaacccctcatattttggagcgaagggaatactaaacactcaagggtgttggactacgactgataagaaaaaaacgaagcaaccaaaaataatttatgaataaaacctttatatttgcattactagctattgagagccaaagctagaaaatagattaagataaaaagaacctaataaactataaaattaaattaattttaaaaatttaaatttggattataataaaagaaaatgtgtaggcgcatgcgttccttgcgccagagatggctgacttgttcaatcagattgggcggcaagtggtcaatcgaagccctaaatgcagcaagagagaaagaaattaaaagctagctaagctaatcttcctcctgatcacaatcctaccaaccagtctgaagaagaaaaaagaggaccgagtcagctgcatgctttgctagcagccgatgagctctccccatccacgtacaccattcaatgcggtgtatgccatcacagatctgacatccatcaatttggctcgagaaatatatgtgcaggatattgaagattagcccatcatgcaaacgaaccggctcacgaacccacttattttataatataaatagatggataacccggtatataggtttttagattggtccacttatcccttacatcaaatcaaagagaattatcatgcagctaggtattgtctgcggtaagccggtaattaccactgacatataagtctttcatatattttttaaggggagtgctttattaattaggaaatagcagcacagtcttagctcacagccaattttacaaaatcatggaaaaaaaatctccacactgcactagcctcattcctacaagcaaactgagaaaataaatgagctactcagtactcactactaaccagctccatcattttgcttatacttatccttaattatggtttattagtagaaccaataaataatttatgaataaaatttttatatacatatttttaacgatttaaaataaaatactgtaaaataaactacgatgaaaaatatcataaagtcaccttcaaaattaaattttagaattgaaattttagcttaattgtaagcataaatgaaaagaggtagttgatcatatgttctaatattataatactcactctgtttctaaatatttgacatcgttgattttttattacatgtttgaccgttcgtcttattcaaaaacttttgtgaaatatgtaaaactatatgtatacgtataagtatatttaacaatgaattaaatgataggaaaagaattaaaaattacttaaattttttgaataagacgaacggtcaaacatatttaaaaaagttaacggcgttaaatatttagaaacggagagagtattataagtgtcattgataactagtgacacgacagtaagtggttgtacacgtacattttcctaggctgaaaaaaaaaagaagcagccttgtagttgtacttgttcatcgtcctagcaattaaatatgcagtgcaagtgtgcaactagatgtcctgaacagcacactaacacaaccatcaataattaatatagacaagcaggagcatgcaccggcaatcactattatgagacgagaaacagtagaaaaatacaaaagagttaatcaaggccctatttagaatggtgaaaaacgttctgttgatcttaatctacacggagaaaatggactgatttatgtgcaattcagcatttttaatcaaatcgctgagaaaccaaatcggttcacacaaatcggctaacctgcaataacaaagcaatgttttcaggaagctctagatcactatcatttcaattagtagtagggacaaccgtaaaaattattcatcaattattaattgttagacaataatggcagtaatagactaacaacagtggcatgaagtaaaagatagtaattatattgaggcttattcttgcatgcgtttgagaaacagccaagaagaagaccattcaatttcttcccggatatattccagttacgccgaaacggtaagcagaaataaaagcatgaccgacatttaatcatataagctgtggccagcttcaattcctaatctcgccaagagttacgtatgtaatttatcaatcatgaccgacaattaatcatataaaaaatgtattaaaacgtgtcacaaactaagctagtagctactagctgtagctataattaatgacatgcaaattaaagaatccaaagctatatatatagttgttgtcttgtttacattccttcaaatttaagccaaattaaaggcatcacgaatatgaagatatatagagcgttccgcgttgtttggaaataaatttgaaaatacactgttgttgactcgtttttttctcacaaatatttggaatgtaaatttattagcataaatatatcgtcgatctcgcacaacagttccgcgaaagtgacgtggatgtgacgacgcaaacggtctcgcacaatgacagcgcgagaccgcacgatgtcacgtggtggtagcgtgagaccgcacggtctcgcacgatgaaactacgacaccgaacggcgaaatcgaggacgtgtgtggtggcggcgtcagaccacgcggtctcgcacggccaaaccgcgagaccgagcaatctcgctcacccaatgagcgatagcaacggttgaaaattgttagttactttctccgtttcacaatacaagttattctagtatttttcatattcatattaatgttaatgaatttagatagatatatatgtctagattctttaacaccaatatgatataggaaatgctagaataacttacattgcgaaacggagagagtagtgattgattatcctaattagcaattaattaatattaattaatcgctaattaggataattaatagttaattagagtaattaatcactaattaagcagcactgatggacaagacgttcggtctcgctgattccttgtgcgggaccgttcgctctcgctgttttatctcgcgataccacgcggtctcgcgcgacaccgcgtgcatcgtcacgctctcgtcactttcgcgcaacgattgcgcaagatcgacggtatatttctgctaaaaaaattacatcatgaatatttctaagaaaaaaacgaatcacagtatattttcaaatttaatttcgttgtttgcgtgattggcttccttcttactattaattgacgcgtctgatccttgcagttgtagcctaaatgcctaataactaccggcaaaacgatggacttgtcctacgtacagttgccgaggattcaatgcatccaaatacccaatatttgcattggcatggccaaaatattcgagatatatatatacaagaccatatttacattagaaaatatggcactttctcggattcaaaaatataagtgatgggtatgaatatacttatattttgatttatagcaataaatgcttatattttaaaatgaagtgacgagctaaagaacccagagaaaaagaattgtaattaaaatcatttttcaactaatcttcatcaacattgtaagcccagttatcactgcaaatactatagcaagggattttaaatgatccaacaagtttttagcatacaaaatttgagggctgaatctaaaatagtgtggattaaaattttatgtatttttaatctaaaaatatagaagggctaggtagaattgtgaaagaacccatgcattggtctttacccattagttaccaccgctaattatagttctttaattttttttctatctgaatattaaggggttgtttagttgtcagccacactttactatgaatgttttatcaataaaaataaggtggtcaaatttttagccataccattaattatagcaagtataagaaaatattggcatactttggtgaaacggaggaccgtcctttgattaattaattgcctggccaatttaggacttgagaaggagagatattagatgataattaggccgtgcttagctctatcgtacttttgccaccatgtactatcagctcccattgtcacgtaacccttgtcccttggccattatatttcattctcttaattagagatgcaccattggtgggttgacagagttgtgggtgcatgcatgacgcaaaccctataaaagggtaaatctcatgtacatcaatattccataaatatatagatgtgtgtaaccttacttgatgcacagactaaaacttatattattaattattgttaaataattaaagagtcggtgcagaggtcggcatttacaggcccgtccatagacacatgcaagatgagcgaccgtacatggcctccaaaaatttaggccccccagaagtacatgttttaatccatacccatacgttctgatgtgtttaggatttctgcactcctttttttttattttctatctttctgctccgttatattagaccagaacgagatcttttcgtcggctccggtaaatattcgatgacgatatcatagttatcttaaagaaatgtacatcatgatgtgaacctgcattccaagcaataaggattccatttttgcacctattagtcagcaaaactgaattggtgcaatgatttttttttctgcttcatcagatcgccattacttaagtaggtgaatgttctttggtatagcagttgtcgccacggtatcctatctcactgtaaataaagttatctcccactaactccttaagcttaacatgcaaagatgcccatcatcatccactaacaagatgacacatcatcatccactaattaacaagatgcccacatttaaacatcatgcaaacatgctatatctttatagtttttataatttaagagcttttcaaatacaaacatgttaaattatcatccaatataattcacataatgtttcaatatatatctttattatgttttataatatcctatatatttatatagttcatcctcacttagttagtgcttaaataattaatctatggtccaaattatctttctcttttttttcctctaattaagtcgtatcacattaattgtttttaacctttagatgattaatctactgtccaaactatctccctatttttcttcttccataaagtcataccaccttactttttacgtttgaatcgccattctacaattcaagtttaaattatcataaaccacgttaatttacttaatctgatgttatctagctatattacactttatttttttttatcatactaaattcccgcaacaatgcacggggtttcaccaagtacataaggtcttgttccccaagatttttggggacggctctgggaaattatatgtacttttaactaaaagggaaacaaaataaagatggcgtaaattgatattacaccgggaatcagtaaaatagcaaatatttgacttaagttgacctaattacagggagattaatatttggtcagtctcatagaaatcaccgtccagatacagatagcgaccccacctattattattattttgagagggacgatctaaaagaatcgagtttatatatcatgtttatttattcttagctgtagcaggttaaaattatgacatcgatcgagtttaaaaatcttaagacagcaattgcagaaagtaacaatcaagggaggtgccattttcatactgatttgatggttaaaccctatcgtgacaggcgagaactggagagcagtatgtgatactgaatgtgaaattctgacaataacgccaaattaatgtaacaatgagctcttcacatgttgtattcaattcggtcagctgatctgtaatagagtctttttcaacgtcaaaactcaaaagtaaacggcagttttaataagattgaccagttgcgatctgtttagaacgttaggaggctttcaaatgggatagaacatagagaaactcgagcagaaaataggcagaattgatgacaagatggaccaattggtttagcaacttggctacatttcaagaaaacttgctgaccaatttgttgccaaaaccttatgaagtaagagtatttaagtaagtactccctttatcctatattccctttatcctaaaatatagggcctattcaaattgtaaccaaaataaaccataccatgttttggcaatgccaaaattttagcaagatggcaatattatcaaaattttggcaggatttcttatgtattgactaaatttgtgaacaaactagacgtagatattttttggtaactttaaaaaaaatgatatggttgaaaatggcatcaaattgaacaggctcataaacatttataattatatatctaacatgtttccatattcatagctaaaaattgttatattttgatacggaagtagtagtagtacataagtatgtacttgtgaaatttgtgaactgacaaactttcatggttttctgtcgatatgaaaactttgctctccattcatcggttggccaaggttgactgttgattactccctccattttttaatagatgacgccattgactttttttcacatgtttgaccattcgtcttattcaaaaaatttacgtaattataatttattttgttatgagttgttttatcactcataatactttgtgtgatttatatcttatacatttgcttaaaatttttgaataagacgaatggtcaaacctgtgagaaaaagtcgacgatgtcatctattaaaaaacggaggtagtacatgacaaaacatgaccaaaaataatttgtaggtaaagctcttatatgcatgtacttgatgacttaaaatccaatgctgaaaacaaaactatattgaataccctaaagttaactccaaaattaaattttataatttaatttttggtagctgctaatttttttcagggcaaacgatgaggctagaaaacagctgctagcgaagcctattggatatatagacttacaaatcgacaaaattcagcctgattattacgtgtttatgggtcaaaattcgctcttccaaaaactgttgtgtgcctaaattttgtcctggcctgtttatgtttgttccgctcctaattccgccttaccaaaatcatatataggcctaatttgtcctggcctgtttaagatcacccagggcctaaaaactgtttgagcccttttattgtaactggtgggccaaacatttgagataataaggtagtgggccaagtatttagtttcagtccattaaacgggtatcgtgggctaattacagcccattaaagatggcaggagggtagttccagcctgtttattcgggaggaaaaagtccattttgactcccttaaaagtcacccgaatctaatccgtgaccctcaaccgtaaaaccggatatgatgactccccgaactattcaaactagtgcaatttgactccctcagcggttttggatggcggttttgctgacgtggcgctgacatggcggtgttgacccggtcttcatcccacgtggcgcttatgtggcattacaattaaaaatattttgtagggcccgtctgtcatttgcacacaaaatatattgtgggactcacatgtcatcctttctctctccaacccttattcctcccccctctccctcccttctctctcttttctcctgcagccgcactcgctgaacatgccggtgcagttgaacccgtgcgccacctcgccggtgccgaacaccgcgatgagcccgatgaaccctttgtccagccgttccttgacgcagtagtcgatggcctcctgcagcccggcgccccttacttcatcacggcggcgacgtcgcgcgccagcgtggagcgtatgatggccttgccgatgcgcccggtcatcttgttcatcagcccgcccatggacatggccgccgcggtgtggccgtttgagtgcaccactgcgcaacccaccgtctccggcgcgggatacggcagtcaaactgcttgtaccaattaatcacaggatgtcacggttagatgttagcaattttcataggcgaattggtaacatgagtcaatgcgctgatcgacgaaccaagatgctgttagcctccttggcgagcttcaacatgccgacgttgtcctcggtaatgaagtagctattgtctacgacctgaagaccttgcaaacagtgaccacaaagaataaaatcagaccagtccacgacctcaagatctgcaggactcaggtggaccacgctggtaggacggattcgtcctgcagctactggtcctgccaaaattcgactggattccatggcggccgcgccttgctaccccacaccggcgctgcacttgcatctgctaggcaacgctatgcacatgcatgttcttcgggcagaaagaaacagaggcggcaccccctgccggcgcagaccaagaggcacggctggggccagcggcgtctcaggcttcgccgtctacattagccctctcgttcgtcccagcctggcgcggcaccatcgtgggggaggccaccagccgaacgcccccgccttctccggcgagctgaggccgtcgccgccgaacgacccgctcaagttccttcctccgtgccggccctcaccctgccgccgccgccgccactccagattccgcaccgaatctggaggaagagaaacatacagagaagggagaaaggaaggggggaaggaggatagataaaggatgacatgtgggcctcgcaattttttttcatttgaatgacgaatggagcccatataattttttattttaatgccatataagtgccacatcaacaacacagatcaggtcaacatcgccacgtcagcaaaaccgccatccagaaccactgatggagtcaaattgcactagtttgaatagttcggggagtcatcctatccggttttacggttgagggtcacggattagattcgggtcaatttttaagggagtcaaagtggacttattcctattcgggatgtgtgtctgattctggcccaattgaagctggccctattttcggcttattaatttctaaatagtttctaaaaaaattaacaattttgctatatatttgtcgacaaattttctcccaaaaatttgacagatacaattacagtacaatcgtagtgtaattacactgtaacttgcatgtaattacactaactataatgtaacttgtatgtaactttcaaaaatctctccataacatcttatttcggtaaaatgaggctgtgggaacaaatcctttcacacatgtgtgtactgttattttctttcttcctcaccagaacaaatcttgtaatagatctaacgattcaaaattatgtggaacttacatacaagtttcacggtagttatatgcaagttacagtgtaattacatacaagttacagtgtaattacactatgattgtactataattacacctgtcaaattcaaatttttaggagaaaatttgtcaacaaatgtataggtggtcccaaaactaattatttgagaaatgagtggtgattaagttttataagtttttgtgctaaacatcaaaaaatatcggaatgagtaccatttatctgttggattcctctgaaagaaattaaggttgggtcgttgaatgctaagcaggtagttttgtcaaattcttgagtactgcctaattaatggaacaatgagctgttcatagatcgtaatttagccaacatatctgtgatatatgtcttcttaaagtacacggcacgataacctattggcttagctattgcagcttctcagaacgttgaaggtttcatatgggacggaactagagcaatcatctagatctaggtctaagatacagaaaacaggcagaatagatgacaggaaagactaattggtttaacaattggctttattccaagaaagcttgctgagaaagtaattaatatacatacatcgtattagataactcttgaattcaccaaaatttcatcctaataccgcaaaactgagctaaagcagcaatcatgcatagagtaaaggagtatactaacaaaatcatgaaggcggtgccggaagaggcagagagtgtgtcaactgagagatttactacaccagttaggatgtttgcctgtaagatgaagttaaatgttactccatacagacttaccaaaaataagttccaaatatactagaaactcaaattgaggatctattagttggaacatttctgttttgggaaaattattttctaaaattgtgaccaaactgtcttaccagaaggaatgaaccaagcatattttgattgaatgcatcttcaagaaccaggttcttttcatatgaaataaacccagctagtgtgagaatagatataacctgtttttaaaatagccaccgccatcagtgaaatctggacagaaaattttaacatggctatatctagcaaagatacaatcagaaaactctaacaggctatatggttgctaaaccataagtaacagaattatgtcagtcaaattcgtgaacctcgccaaatttcatggttctgacaatacataaaatgtagcccccaatcatcaaagaatgaaaccagctagtgaaacaatgaatacaacagactaagaaattttcaaccatattctatacattagactgagttaaattatttcattctcatttgataatattaaagcatgcagacaaaaaaagatgcacagtgtaggttaactccgatgcacaatcagtttaagatttcaagtgcatagttttatttatatccttgactcatgtaatactactgtactagtgtgttactattaaccattgctggaaatagtacaagtaactaattctcccaatggtagagaggctaattgagaaatatggatacctaaatctggcaatgtatgcaaattaaataaaatcaagaaaggcgaagaacaatacctgaaaattctgtccaaatacaagcataacataagcaaagttgcactgcaaaatgaaatgtacaagttaaattcaaatctaaggacggattaaattgggagttaatggtactaatcctatcttactataaagttatcccccactaactccttaagcttaacatgcaaagatgccacatcatcatccactaacaagatgccacatcatcatccactaattaacaagatgccacatcatcatccactaattaacaagatgccacatcatcatccactaacaatcatcacatttaaacatcatgcaaacatgctatatctttatagtttttataatttaagaccttttcaaatacaaacatgttaaattatcatccaacataattcacataatgtttcaatgtagtacatcatatgcattactatctaagtaacggtatgttttccctttcattttttttgaaaggaaccacatttgtacacaggtgtcaaggcttctaggatcaagttatattgaatatataaggggaacaaacaacctggacaaggccagaatttgttaaaaagaatgtttgaaatgtatcagaaccaatattttggcaagagatttcctcagccttaaataaccacatctacctccgtcccaaaatgtagttatttctagcacagtaacttgttccaaaatgaagctatttcttcacctaccctctcctctcaaccaatcacaaccattcttttcacttattttctcttctccaccaatcacaacactccaatcatctctacctactttcttaatatcggtgcctacctcaaaaaggcctatattttgggacgaaggaagtattatgttagatttggttggtgctaccaaatttttgtagctgctcccagataatggaggcaaacaaaacaacaggaaatttccgttggaactacccatatttagtttggttcaccagtatgaaccaatgaaccaaagaggtcaggtatttgcctcagggtcagcaaagtaatcggatcaggaactatgcactttagatgcggttaattttctaagctatgctggtccatttcatcacagcatactctttaactatcataacaagggtactcagttcaatagaataaaactctgctcaatatactataaactactattaaaatgcacaactatctggtttcttatatttgtcaatctaatgctagtctagattttttgtttcttaagaaagcatgtaatcaattaatatcctaccattcgtcgagaaactctttcaacatagctgtcaagaatgattgccataatcctgtaacatggcatgggaggaattgttaaaaatgaagaaaggttataactgggaataatgcatgaaaaaattgtttcttaccaaaaagatgcagcaagaacccaaacttttaccacttgactgctcctactcttgccttttgaactattgtcgaagaatagattgtaacccaaggaaacaccaatcaggtacataccccagtaacctgttaaaagggatgaatcaatcagattgcatcacatcaccacaactttttcaaaaaagaatcaggtgcatgcaaatttatgacattcgggtataaaaaggatcaaaaagttacatgcaatcagcatataaaggtcagcaaggcaatacaaaagatgtatataataagcatggatattaagaaatccataagtgaatagaaacaaagaaaaagggctagaaatatgctgtgcagacaccttcatgtatgcctgaattatccaccaacaagttggaggctgattatttattggcaccttaagcaaagaaataacagataaataacagactgacatcaaaacttttcatgacaaatagcattggaaaattttgtgaactcaagttgatgtgagtagtacaattgggttgtttaagtgttacattagaggtgagtgttcctggtaatacgaaagaggttttgttgcattagtatacttaccaaatatgctataaacaccttccttattctgactgatgataccaccgtttctttcattagaaatgagatactcattcaacccaaaagagagccacgtttggaatcctgaaaacaaatgaaatatctggtacatgaaaaggaggctgtagcacatttgaaaataaactattcaaatgaatctttagtacctgtaagcacaagcagaccagctaatccacaatacttaggatggatcctgataacggacgtaaggatcgaaattgctgcaagggtgaaaaagaagttccagtgcacgccatattctcctacatgaacctagaaaatgagaaatagaatatgcatctttaggaagacagcagtacatttttgttttgtgcagtacatatacggtatctagaacaagtcaacaagagaaaataatcacatggtaattgaaaatgctggataaggaaagcaaagtttgaggattgtgcataattacgaagtaaatttaatgtcaatgcatatggcaaattgtggcgaaggcataatttaggtaattgacatggttatgaataaaaatacctgataatcaacacctgatgtcgatatgagacgagcaaaaccaagaaatattagagggcttatagacatcagtgctttattccaggtcctaaggacacacatgaagttgcattgtaagacacagcatactagtgactatttgcagacctctcaatcagaatatactcttactatccagagaaaattcaaatattcaaacaatgatgtctgcgaaagtcaaacattaaaatagagtctaaataaggttttagtgattatattagacaaaggtgggatgaattgtcaacatgtcactttctcaggatggtttattatttggagagagaaataaatgggaaggatttaaaaaagatatcgtcctacaataaaacagagcaggtgcagaaatttgatggataataaagcttttgtgggtgaaaagtgatcaagtcaatcttagcttcaacttgacgttattacttttctgacttgtctccagatatacaaatataagaattgtggagatcagcataatttatcttcagtgtgccaattctgaactaactcagcagaccaagctaatttttttatagatagctcgaactggtgaagttgacttgctttgtacctgtaccttctaggtttctaaactagaagttcctactttcaatagataaagccagcggaataaatatatgttctttatatcatttatataacatgtgatatatctaaaccatgatattcctttttacctacagttcctaacaaacaacaatctctaacctgcctaatattataaccaaagaagagtaagattatctgtcgtaagacatggaatctactttctccgcctatatttggccaacttcagaactgaaagtcactgtgatgaaaaccaaaaccctagatttcttagccatatgagatcatatgtagttaaggacttacattgcagtaaagtttcgtgcttgtctagataccagtgcattagccactacaaaagaccctactccgagatccatctgttggacaatgaggcagataccttagtatcatgtcattgaatggggaagaaaacacagaaactttttaagtttcaaacatgatgggaaacacaaataatccaaatcacaagcatgcagaataggtaacagagtggatgcacaatttgcagccagtgtctacttttgcaaaaacaagttcatgattcattaaaaatgctttgagacagtaaagaactaaaatacaaccaatgaaaaagatgaaagatacaacttacgatgccacaaccatatgtttcagccttggcataacgtctagggaagattttgaagtccactgctaatatgcacaggcatgttactagaaccttcaaaacaccccatcaccattaacttcaatagttctgttggatatatagtactgagaagtaattaaatgagtagtatttttccaattaatcaacttttacgtaccacagatactctgtatgatgatatatctgctcggagcaaaggcagctcatttggtccagctttgagatgagatcgagaccttagaatatagggaatgcattagtttctaatcagcatggattttgttgcataaaggaaatagggtggtcgactagaattgtaatagaaattagagagaatgtggcaagaaaaacaggtgtaagaactcagatatggtacctcttaaacatggtgaggatagatatcagcattacaagagaaagtgcacaagcacaagcccattcagctaaaacctgtaacaaaccaaggaataatcaaaagattgctatttaactttttttctctaagaagtgttaaacctcattataacatttgcaataagcaaataacaatagttggttaaaagtttatgcattgtgttccaatgcttggttctctacatattttatgatttctatagttgaacactgctacaatgtaatctccaagtcctatgaaagaatacttactgtgaaaatcagaagaactggcaatacaatactgaggtaatctatagccagtgtagagaagtaatgcacaaaacctttatgaccaggaagggcatcatcatttttcttcaatgaattcttcctagtattatctaaaacaagacaaaaataagggaagaagcaatcactttccagatctactctgaacagtaaaagaagctcgtgttattgatcaatgatgttaaaattcgaaaatccatgaacataacatccataacatcagatgggggcaccacagcataatcaaaaactggagtagagcatggtaaaatttcacataatcgagttaaatttatcaaaactacatgctgagattacgcaaaaaattcaacctgtcaactttctggttcaatctcgcaatggcatatctgaaccaaatgctaaatgtgcaagaatgcagcatactggtaatcttataccacacttctaaatgatatcaacaactcgctcgtctatttcttgtacaaatcgatcagctaaacaatcgcactaatagatcaaacgggtcaaaaattccacaaaatctgtagcgaactgacctccgcagctccatttcctcagaacgaccacagcctgcacaacccaaaaaaaaaggggtcaaaccacagcaccaactaacctacttcagcgggggtaactaagcaactcaccggaaccacggtggagagcgcggcgatctccagcagggaagaccccgtcaagttgctgacgaacctgcgcgaggcgaagaggacggttcttaggaggcgtaccagcgagaggttttcagggggggtttgggggacattttgggactcactgctccttgaggagcttgtgcgcgttgatgggctcgtcgtccattggtggcgcctgctcgaggggcggtggtcgcctcgcggcggcggcggcggagtggaggagaggggaagcagcgcaactgcgccgggggagagggagagggggggggatctgaactgaactggatcgcgcgcgacggcggaaaagaaggcgagaagccgagaagagaaaccgaaggaggagaaggtgtggcgcacgggccaagccggagcagaaaggaagaaaaatggcactctcaaaatataaaaagtaaattgtactagttgttcgtataagcttgtaatgaggttttatctagatctacaaacttgtagaacgtgcatcgatattcttaaaattagtttattgccatgtgaatgatgatgtgacactttttaatttttttcccttttttttcttctttcttcctctctccgataagcagcgacactgacgaccacgacgggtaatggtgatagcgatggcaggccaaaggaatcattaaaggggccgccaccactggtatcatcgttgcccgctgcctccaatggtggcgccgcttgctggagggaggactaaggagaaaaaagaaggaagagagtagataataaaaagagtaaatttcactttggccatgtatatttatcagattggcgcattggaccagggctaaacgtatgttttcacttaacaccacatttctttaccatactttacaggttggaccagagtttagcatctgggccatcaggacagcttcgggctagtccatgtgaagcgtttgcttgtatggaacctcttcgcttctctgtgtcaacccctccatgtccactaaagccgcatcgtgagcttggcctcggcacgtagacatcggctgttatcgacgtctcttcagactcttcaaaggcctcatcatgttcggcggggcgcgtcttccgaccatgttgttggcgtcaaagccaaggaccattctggtggacatcgacgccatcacatacaatggcatccggactccgaagggcagaagctgtggaaccgcccggatcgctacttggcttggtggaggcagtctatatatgctatattagtctgttattcggtcttggaatgtatcatagagaaaaatcaaaacgatgttaaagtctgcaactcaggtgtgttttggggcttgcgggattttattcctgtgtaccttgtgagtaatcaatttgtgttccttactcctgagttcaattggtataacataactttaaaaagaaagtttggttcttaattaatgccaaatggaatagttgggcccttattgcttcacataatctggaagccaatatttaggtctgatatgatttcaaaatctattgacctaatcatgttagcaaaagtttttcaacttctaagtggatcaggggtcatatgcatgaacagaacaccacggcatcggcgattcggcgtggaagtcgtggcccttggccccaacattggttacgctcctgtacaggatgacgttgggatccaccttgccgatgatcaccagtcgacagaaatgcccttggttaaggggcggaagctgtagcctgtaggcagcagcgctatcgaggagatctcacgccgtcgctgctccccaccaagcgtcgacgcatacacacgcctggactcgccccctccacacaaacaagcgcttcacgtggactgggccgaggaggctttcctggtggcccaagggataagccctggtccaacctacaaagcatggtaaagaaagatgttgtcaagtgaaaatataagtttatccctggtccaatgtgccaatcaggtaaatatatatgacccaaagtaaaatttactctaataaaaatataccatgtaagttcacgtggcatgccacgtatgcaagatcattgtcaaacaagactgtgaatcgaagtgatataataaatcaagtttagagacatcgatacgcgtttgcaaatttgtggacataggtgaaacctctttttcaaatttaaggaaatttaagtactaatcgtgcaatttactcaaatataaatataggtaaattgcacttctgactaaagtttcactttatattattcttatagtattttttttcattttgaactagttattgtttccacatgttaccctttagatagggtggcctatataagtgaattatgtacaataaaggtaattagtctcattgatatgtgggtcaaccagtttaaagtgcaacatttggcaataatacgcccaaagtaaaaaaaaacactttgaggatagattaaagtaaaattttgataaaaatatgtggcccaaaatgtaatttactctataaatatcagttgtgtgttttgtttatagagaaattggcacgtcaaattatttggtttagttcaatgtcaaaatgtaattttggcattgaagtccttcccaattcatggagaaaatattaacaatggccaatttggcaaggctaagaattgcaataaaccaaaacaagtcctaaatttgtgtagctctaaaagtttgggggaatactcgtatttctaactggtttgtaaattaagaatgaaaatcaaatcgaagtaaaagaagtcatttctcaagctggtaaaaaaaatactattttaagaaaaatcaaaccaaaatatatgtgaaatgctcatgctgtggctactcgaaatgaattgtatttcaaaagaaaagttatggaattacaaaatcacctttgaagacaaaacctacaaatggttaaaattatattgacatgaaaagtttaagtacatttgcaaaactaaaaatacttgaccaaaccatcgtaaagctaccaatttaagacgtttattaccaaaatatagttttagcacctactttatcatggatgagactacatatttaaagcagagtatcatgaaattacaatagtagtgaagttatcataaaaccaaaatttgcagtttagatcatgacggtattattatttttgagttataaatattctagttgtgttataaaaaatgttactatagtttttcaacagtttgagcaaagtatcaaacgatcaaactgtcagggttatggataccacatacctaatagtagttgactaaatctagacaggacccaccacataccatgtcttatacggaaacaaccttcgaatataggagaagttccgcataaggaaggatgaatagagttctacatggaaacgacaagaactactcggattgtatccatattagtttctctagttctacttggacaaggggatatctgtgggtataaatacaaggccccctaggaggagaggggacacggaacaatagatcaacatacaagccaacatgcatcaaaacaagacgccggatatcgacttcagagataagcatggctagtcccctacggtgtctacggatactgtcaggagagacatagcactatctttgacctcgctggatgcagattcaaggaggaaggctaccctgttgtcgactacgagtcagcacttcagaccgccaagtcgacaacagttagatagactaccccacatattgtactggtgtgattatggtgaataaagagcaacaccggcttcggcaaacaggatgtagggctattacctgtaagataaggggcccgaacctgtataaaaatccttgtccccgtctcttttacctaagtctcgcatatatcctagtaccaacgatccccatactatgcaaataccggaatcgcgacatcaaacgtcgacacaaacagtttttaaaaaattactctaatagttttgtaaaatttactcaaatttaatcgaaattaaagaagtttgacttatgacaatacaaaaacaacttattacaatatggaacggagtagtaatgaagggagagagtttccccttttacaacacaacacatacggaaaattttatcgctgtaagagggaaatgtttgcgtataataggccagtactatgcttagataattttccaaattaaaagggaagaacattcctcactaaattcatggaaaacggatctgataatttgccaacaaagtgaaccgaaattgtgtgcttataaggttgtccagatcgctgcaagagggaaatgtttgcatattattggctagttctatgcttagataaaatttccaaattaaaagggaagaacattcctcactaaattcatgaaaaagggatctaataatttgtcaacaaaagtgaaccgaaattgtgtgtgttaataaggttgtccaccgatgttggcagaaataccttacaccacttaaaactccgtataaacccaaaaaaacaaattatcagaatggcagttaaactctggatgtaaaaataaaaaataaattgtcaagaatgggattcgaacccatgccctttcggaccagtacctgaaactggcgccttagaccaactcggccatcttgactcttactagcttgcagaacattgacaatataacacctcaaacatcttaggaggattaccattttccaacgattttcttgcatgcttcacaattaggggaggcatgcataacaagtggatctgagacatatcacgtacatgagcaaagctaggttattccatcatcaaataaatagaataagtaaatggcaaaatgctctacaagtcctgtacatacacacatgctatccttgatctctcctctaaggctcccacccagctcttaaaaaggagaaagaatacaaagaattgaactcgtacactatggtacacataacaaacatctattcctgtcgtatatatatgtgattcctctgcacaaaggtcagcgtcagctgatgcgtgtgattatgtaccggcctttctccaagtcgtatatgatcttcgtcttgggcttcctccatcttgccaagcaaagtgctccacctagaagaaacacccccagcagcacagcaagcaatggtctacttctatgggctgatctaccagttgctgatggctctacaattacgccttttatgtttgagatgaaagcccccagggcccattcaacttgagtgtctccaacctgatttgaatactcaatcctgcggatataagaacatttaaatttaaaagtaggtaagcatataagatcgctgaagagtgaatttcagcggaagattgatgtgccatggtattcttgcctcttgtcatccagtggtacaccaagactgtcgtgcagtagagctacaatatatgcggatgagaagcaataacgtgaaaaatcatcatctgaccgattaggatacattttcctaagagtagacaagtccttgttgcaaaattgttctccagcaagcacaaaatcagacagtgatgaagattgcttcagtccaaagaactggcacataattatgtgagtaggtgtcctaagaaatggaaaacatgtacaaggaaaacaaggaggatgtagagttgaggacctttgatgtaaaatagaaattttcagttgctaagaaatgtccacgaagctcaggtacaaaagttggtccaagttggcattgttgatatcggcactcttctgcacttaggacataaaatttcagaagataaaagtggtaatgaactgacacatcatgctaaattgaccttgggtcagaacaaagaaaaaactccaacaaagtattcaagctacagaagatattaagtctatgaaatcaaagaacctcccatctttgttgatgttgaacaattgaaggataacctgatatttaaccattataaccttgtttatcttcatcttactggtatgatattttagctaatgatcacatataaaacttttcttcagatcattttcatggtattcttaagcacacaaacagtgaaagtaaaagaaagaaatctgttagcaactaagtaaccaggtaaataaagccttttagggattaacaaaaaacatggcacattcatttcctaccgttgccttttttcagcagtgccaaagaagaagatctgcacactgtaaagtctccatccccactatcagcaaattgattctctaattttgattttgaagcactgcttggtcttgatattacttctttgatgcgagaatatcctttaggagcacatggatcaacaagtgtaccatttttggagtctgcaaccacatgagtcatgataaggcactgctttgaacttcagtacatgcagccaagttcctctaaaagctaattaacgaaaataaaatagaatttgtgtattcatattggtttcattcagagcataaaatgcataaaagaataacaatacaatgatggatgcaagtacataacagctttgatattcaacccagcactcatcaaacttaaaatgtacaactgttgctttgaactatagtcctgacatatttgtgtcactgtagcacatcagaagtagaatagccatagttagtatactaattattgatgttctattggctaacatcagcacatcatatttgttagctgtgaataatattctgatattctcatttctgggaacttagtgttcccttgtcaacctagctaccattgtaagggatgccaaatgtctattttttttgctatcctttacattgaaagaataagtaaaaagataccttttgaccgcagtatttcacggaaggattcttgtgcagcattctgcaaaagaaattgaatcatatggtcagcatatcgtatcatattacaagattgtccataacataagtggtgggtgattcaatgtatacaaatagctcacttgtccaaagtttagaaagctgttgctatagagagtatatgttgttccaccaaaagtgaaatttcttgacagttccggaggaagtacttcatcagaaacaaatgtcagctgaaacaataagcaataattagattggcagaaaatcattaatataaccaaagcattaagcaccgtgttaacattgatattcaaatgtggagcttggttctagataacaccatctcaggtaagtgagtcttttcagattaaataacttaactttattacttattagtaccatcttattagcatggattttaatttaaagaggattcatggctcaaaatcaaaggaaaggaaaggaatcaaagaatttatctgtctttatcagagaacctgtgctgaggcgcccccaagttcaattattccaatggttttgtgtggatcccctccaagtgtgccaagagcatagtttgccgcaacccaagcatagataccctcatcagagcctataagaaatgaaccagccaaaaaatgagcatccatactgacaatatttcagctaatgatgaaaaaccatctgtatccaccatccaatggattttccctttactgattcactacccaaattactttatacaccgctttccctttcgaatagccggattcagtttcttgatgcctctcactaaaccagaatataaaccgaattgaggccgtatttctcaggagtactacacttcaacccgcaacgatacagcctagagaagaaacaacggtaatatccactacacatttttcagaaaatcattcatttcaggaatcaccaatgtgcaaccatcacaacaacgactgaattgacaaccgcggctgtctcagcatgacaccttagcatttccatggaatatgtcagattcatcaccagattcaaattctaacgtctcacctaaatcgaattcccagtcccccatctataaggcaaccagctatatcacttgagcattacgaactgggaagaaatcgacactacctgggatcacctcggcccaagagtcctcgaaccggaatccggaagccctgagcacgtccctgcaggacgacaggatggcctcctggaggcgcccctcctgcagccgcagcccggcggtggccatgagccgcacttccgccgcggcgcccccgaccttctccctggcgaaatcaatcagcggccgcagcgaatccccggcccgcgcgggctcgtcggcgaacgaggagagccccggggtgacgcgcatcacggccgaccgcgccagatccggccgcccgccgggccccgtggcgaagacgtgcgcccggctgccggtgctccccccgtcgatgatgaccgcgaagcgcggtggcgaggaggagggggagggccgcggcggctgcagctgcggctgcggctgcggcggggagaagaggtgggcgagggaggagacgaggagggcgaggagcgcggtgccgaggcagatgccgcagaggcggcagcggcggcggcgggggcgaggggaagggggtttggtgaggtcgggcatggcggggacacggccggggcgcgcccggccggtaccggcaccgccgccgcctctttgactcgtcggcggcgagggagacggcgacgacgacgagctttattttttattaattattaatggatttttaaatttccagggaggggcgtttttatagtacaggctggcacttggacggcgggggtggaggcgccctccaactttacgtaaactttaaaccgaaacgtaattacgtaagcttagagtttttcaatacagaaatgagaaatcagaagtgtttctgaattctgagcgactatgaattcagagtataaataaattactactgaactcaacgttccaatcttttgagttgcaaatttataccactgaattggaaattttggaatatatatattgaagaaagagggcgtctccggggtaataagttacccccaaatgctagtacaactgaactttctatgcaaagaacaaagaatctgttcgtttcagtttaaatctcaacaatctgacagcaatgtgcggatccacaaatggttgatttgatcgcgtggttgtctagagcctgagctccaagtccaattctttcccggcgccgtcgccggcagcagcctcctcgtcgtcgtcgtcgtcgacgaggttcacaaacggaataatactctgagatctactcgccgccgcagtcgtctcgccgtgcagctccatctgcggctgcgctcgacggcggcgataatcctgcagctgcatcctgtatagctcctgcatatatatcattagagcagtgtcaattatattatagagtaaatttcagaaaactgcaatttaaaaaaactattcgtttactgcaattttagcgatatgttttagtttgcttcagcaatagtgtgaaaaattattacaaaactgtaacttttacgttatatactgctacagtatatatgtaacaactgtagcagcaaattaactattatattatattgctactatctagtaactaattaactagcagaatttctcgcgcaattgcacaagtacacatatatatacctgatcagatgaaccctgttgctgtcttaggagaggggacgcgttcacgacgcacttgcctgaagcatcctgattgatctgacgttggaaataagcttggctgctgctgctgctgctgtttgatgcaagtaatagcctgctaataacacaattaaacacgcagaattaagaaaatttagtgattagcagagggtaaaatggaggctaggtcaggacgagtaggaagtaagattttgctctgactttgtcagtatcaaaaggcaaaattaagctaggcacgtgcctggtcaaagcatcattaggagtagtagtgtaatgctgctgcttctgcagtggcgatgagccgtaataatacggagtgaaatggtgatctcttgttcgcgctgctgctccatttccaacctgcacatataaataccaatatcatcgtcagctagggttttgattggatgatgtaagaaaaaattccttgattttcacgtacgtattgttgttgttgttgttgttgttggtggccgtagcgcacgccggccacgtgagacggcagcagcggcgggttttattgtatattaaatttttttccattttttgccttgttcttctattttttatatacaaatttcattggattatctcttatcttggttttttttcacttttacacctttaacccattttttgtatattatttttccttttcgttatggttttttttttccttgcatattaaatattttgactttttttaccttttcttataaaaattttttttgatttatcctaacataaggcttttaatatatcgaacaaatatttttaagattatttttttgatacctaaacatttttttttaatatacttatacatatttttaagttccatacaaaaagcaagacgtttaaaaatttttattcaagtgctactatggattaatatgcccttaacccatgaaaaaagctactttgttttatccaacgatttttttgcaaatttataatctgcaatccaanggttgatagtctatttttccaggttttcaaagtaattattttttactttttaattaaattttttggatctattttttttgtttaataaaggtaaaaatacctcttttgtttttgaacatttatttttttatttta

SEQ ID NO: 66615 - DNA, 4985 bp, Oryza sativa
tgaggactctaccaacaggacgaagattgctgagctcctgaggtaccactccaccaagagtggtgatgagttgaccagcctcaaggactatgtagcccggatgaaagagggccagcgtgatatctattaaatcactggtgagagcaagaaggctgttgagaactcccccttccttgagaagctgaaggactatgaggtcctgtacatggttgatgccattgatgagtacgctgtcggtcagttcatggagtttgagggcaagaagctcatctctgccaccaaaggactgaagcttgatgagaagtttgacaatttgagcatagtgatgaaggaggtgctcgttgacacagtggagagggatgttttttctgaccgtgtggtggactcttcctgctgtccagtcactggcgagtacagctgggttgctaacatggagaggatcatgaaggagaatgccatcatggacgagctacctaacaaatcccaagtgaacaaatgtgccccaaagcaaaaggttgatatccttcctgtgaaggagaatgctatcaggctccaaagcagtgaagagagagaagttaatactaaattttctgttaccggtgagaggattttttttaataaaaaaattacaatatgaagcatgcatcgtctgatcattcgtgttttgctgacataataacctacaggaatctgtggagatggaagatgcctattccgatctatagtacatggtgcttatattaaactaatgatgattccacctgatgataatcttgagaaagatatggctgatgacttaagaaaaaaggtatgcttgtaatgttcagatttacttgcaatgtgaatctatactgtttcttaaatactggaagcaacacagccatttctctgtcaatttatcatttaaaagatctgtttaaatggtgccattgttaggtttgtgatgcgttggagaaggaatgtgctgacaaaccctggttagttctacctgtccttggtttctctgcttctaaatattgaaatattgttgagttatgcattcttatgcttctttatgagacatcaatttgcaggcttgttgaggtgactgccattcctatatcaaagagatgaggaaacctcatgtgtggggaggtgagatagaaatctctatggcgtcacatgttttaaagtgagtactaaccatgatttttgatactttttaaattatccatatttcagatgcagtacatattagttcagtatcctatcctattggaatgcttatgcatgtacattgggcttgatggattcacttttactatgctaggatgcccatcaccgtgttcgtggtggaaaaaactggaggtttgagggtattcaccaaatacggaaaggagtatggacggaatgcaatacaggttctttttgatggtaatggacattatgatgttctgagtttgcggtagtccaggactgcaggacagacatttgttcccccttttttttttcttccccaaatacacttgctgtaaaaatgtaaccggagtttaccaacaattaaaaatgttgttctttccaagcgccaaccttattcgattctcctgtagcattacatatcatgattttgcatgtattatgtatgtttctgtcattacatctgcaaggctgcatgaaagcagcttcaggttgcttaccctgcaaaacttctctgccgcgtgagtcggctagtgcctggtggacacaagtcgacaccgtctctggacaaggctgtggagagagctcacctctttgccggccgccggcctacccacctgagccgccggttgtgctgagtttggttggtgggcagctggttctacgacttccatctggggtggtgtaagagttgtagaaggatacaaaacttccagcttcacccattttttatgtactcattcagttatgttctagtgttcgaccttctgtatctcttaccaagaccgagaccggagccttttttttacttgatattttgaggtataactattaatgacagaagtgcactagagtcttcttaaacataggtccttgaattactgtttatagttgcgaatgtgctgatactttggttcaatttagcttctgggtacatggtggtcgtgattttacaatgggaagttggcgcgtgaactgatgatggtgtcttttgattatgttcgtgtttgcaatgtgatattccagtcctggtaaaatgagccttggtcttcaggccccattttgaaatacaacaattttgtagtaggaatcatatcatatcatatcatatcatatcatattaaatccttagtttttacaacccactactagcagtgatttgatcaacctcagcccaggaaaagatgctacagtactacagtcatcacccagcatgcaccgtccgatgtccacgcgttgatttgatccaaccgtccacgcctcacatgcacatcgctgcgcccggcatagcttccccaatcccctcgatcctcgacatcctctgcgcctcccttcccaaaatactcaaatcttcatcttccccttgcgagtcgcgaagcccgccgccgccaccttcttgcggagctagcggccggggtcgtcgccttcttgcgagccacctgcaagcgccgccaccgttccgcctgattcgcttgctcgaccggccaatttctcaaggtggacgaagggtgcacgcccgctgccatagttgccttcgtccacctcttcgcacggtgttgacaacatgtgcagtctggtaagccaagccctagcctgatctgcttcttatcttcagcaaccttgcttttatcctttgcagcgatcaatttggatgacttattttgtgatgaatctatctgtagttagggtatgggtatggagtagagcagagcaagccaagccctaactcaatctgcttctccatcttcagcatccttgcttctatcctttgcagcgtcaatttggatgacctatcttgtgagtcagttagggtttgggtacaagctatggagtggagcaagtgttcttctagccattgtgctgccgtcaccttccttgggatagtgaggtatgatctccccattattttctatctggattaggccctaatcttgattcaggtttgggctaggcccatccagccagaagtcatacgatttttcaataaaaagaagtcctccgattgttgccgtttggccacttctcactgccaaaacaatattaatgtctggcatcaatatctaatgaatattttatttattttccttgcatatcttcattttaatccaggacagtggttcgtcagctccctgatccccttttatcattatgttgtccaattaatttatttcaccatcctttactctacaattgataatttacatggccattgttctatgcccaagaaatgcatggatgatttcaatgtaaagttgatgaagagtactgtcctatctctaccaaagtttgtcaaatccacttgcttcctgttgtagtgtagtattgcttaaaagctatttttcatatcatcctgccatacacttaaatgcatattctattttccttgcctcaggtatttaactttattttgttttggtacatgtgatcccaatactatatgatgagtagctcagttactactaaaacagatatatgcaacacagtttccctctccttttgtttaaatacctagctacatatttatgtgccatcatcctatctcaaatatatctatacgatttttcaatcatccacaacaacacatgggcatatttcgtttcatttatctttttttattttctaatagtgtacttgcttctttgagtggcttcgtttgctaattcctatgtttttcatatttcaggttcaaggcttccagctacttggcaattgctctttagggtttctctacctgttattgcctggtattatttcagttttttgggtagttccttgggaagtcttatttgttgtccaattgttatatccctatgcatgatcattatttaattagttgttttgataaacgaccttccctactctattttttatcatataaaccagtattcggctaaactgtagcatatatttttgcatgggtcaatatttatatttggcagcatctcactgaccactttcatccattttcgttttcaggcatgggcgcatggcagagaccacaatatgaggcaaacattggaccttagctaacacgataactgaatattgtgatggcattttagtggtttgttgcgtattttatatagctcatgggtttatggcttcctacaggctttcactgatgcttttgtgaccgccagtccgggtaatttcaactttctcatgctattatatactgatgctatattacttagcatgctttagtgtcacaccccgaagttctttcccaagcctaaattgaagttataaatggtctcaagaaaatacctgtgtcaagcaagagtaaaccttaataaattaatgcaaataataatcggaattggcatgtggaatttttcttgagttttacatgccgaaatacgctaacaagatttttagtggaattttcagagctctcgaaataattttaaccaattaaaattgagcacatgcaattttaatcccaggaaaaatcctttttccttctttttcctttttctttcttttcttttctctctttcctttgaatgggccgtcggcccattcctcctttttctccccctcctcccgctgggccggccgaaggctgaggcccagctaagccgcgcgggccggccgcccgcctccctctctccccgggacgccgacaggtgggccccacctgtcggggtcgtcccctttctccggccgcctgaccccacgtcgccaccaccgccgaaaccgccgccgcgcccacgtcccgccccctccgggccacgttggccgccccggtcgtgcgccgcgtctaccgcacccgcttccccctctctcccgctcgcgcccgcgtctga

SEQ ID NO: 66616 - DNA, 16942 bp, Oryza sativa
atccaccccgtccgcccttcctccgtcgagattcgtcgccggaacccgcatcccctcgcgctccggtgagctcatccccttcggccatggatgccggtcgccgtggttcgtctccctccctctaacctctcttttcctcccttagggcattccggacctcgtccgcccgtcgtcgccgtttgcccgtggtcgccgtcgccgttcgccgtcgccgttcgccgtcgtcttcctccgcgccggccacccttggtgaggcgtcctctcccctctattcccctccctctccttcctagccgccgcttagcgccgccgccttcgcgtcgcctttgcgccgccgcctccgccgccggttgccgtcgccagcaacgcgtgcgcgcgcgcgggccgtcgccatcgccgtggccggttggccggccttgagccgaactgagccgggtcgccgccgcccgtccgatcggccccgggcgtggaccaccctcgtggtctcggtccacggtggaccggcagccttgggccgctgacccggggaccccacttgccggcgcccctctcttcccttgagccgctgacatgcgggccccgccgcccccttgatgacgtcagccctgggaattaactgcgcaataaattatttaaggactttttgttatagtaataaacacagtgaatcttctaaaattcataactaattcatccgtgctccgtttaagcccattcaagtctcagtaaatcaaggaaaatgtgtagaatccattaaaaatggttttgttctctgtttcagtagtcttatagcctgtttgcattgtttgctttgtatgtcgcttagattccggttcttccgacgctccggtgtacttcgaaatagtcgccgaggttccttcagcagcagagcaaggcaagtcatgcctgttacttgaacatgttgatcctatattgcaaatgctctattgtttttcttcaaatactgcattgttttataatgttagtatgggatgtttacctattgttacagccatgctattttgataccatgctcctttgttagcttgggttataacatgaatagactttggactaggaattgcttagccatgcttagttcaactaatacacaatggggaaaatcctattaatgtttagactgtaggttctaatggtaatgttggagtagtgacaccgcttcggtgttggttaattaaaataaatcacatggtgggctgtgggtgcatggttttgttggtcgcacccatggcagttaaggaccggttcgcgggatgccctggaagaacttatcgtacttaccacaagccagcgtgggcaacggctgggcttgtagtgtagcttttctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtctaatgaaattggatagtttaggtggatggttgggcttgttgcaacgtgggatagcgttggacagcagatgattaatattgattaattattgcgactgtttttttctttaaacttctgtttataaatgctcgctttatgcaaatgaaccactctagctctcctatgataattccctgcatcatacccctattccggtatgacttgctgagtacagtgggtagtactcagtcttgctccattttccccaaccccagagtacgagtatgtgtcagatggtggtttctccgaggagtaggcttcgtccgtgccgtcgaggatgcctgtggagtggtgttcccgctgcagatcaagtcaaggcttagctcctgttatctttcgtttttccgctgcatttatgtaagacttttatgatgtttgtaagacgtggatctgaatgtcaacattgtcgtttgtgtaccccggctggtcctggacggggattttaatacacattctgcttggaattctattcgggaatttctgggcgtgacatttaggaaattagaaactgttttattctgttgaaattatgctttgttgtttgtacagtgtgggatatgcatgctcttcatcaaggttaaaatgtggatgtattttccttttcttattggtggctaaaatagatcgatgctaattaatgacaagctggcgagaatactgaactctcatatctccagaattggctataaaatcactggttctgggtcatggagcagtaaaccttaatttctatttgttattgctaatggccaatttgtatagattgtaaaacatatacaatatgagttgccactgccatatatatgatgtgatgtccgttgtccttccaaattaatcatcgcccaaggattcgtttttcctaggatctgctggtatcgaattaagaatgttgtctactatgtaccgagatccatgtttgttagtgtaagattgctcttaaaaaaacttttggtttgattacatcacttcaaaactgagaacattgttagattatatgccctttttgatattgcgctattactgtggaacagtgttgcatgttatcttgtgatatgcccaattctgatcttgagttattataggttgcctcatatgcccgcgcaatgcgcaggggacacaactgtgatgtgctgtggacatagttttgtttgactatccttccaaattaatcatcgcccactgattggtcttcctgggaactgctactctgctaggtattgaaatactaatgttgtttattttacttttgttgatgtaattgtattatgcaccgagatacccgttgttcgtgtaacattgattatataaaaaatattatggtccaattaaatcactcaaaattgagaacatcgtgatattctctttctgatcgagttattattattattattgttgtgtagctctgttatgtgctatgttgttttcaatcatgcttattttttactattatgatttttttttatgattaagattatcttggatgatgtcggcgcatcgcgcggggggcacggctagttatattgtttaccgggcaaagctacggagagattcttgtggtacgaatttctgtttgcagagaagtgtcataaagatcgcctagtcgtgttacattgaatcgtcaaagccgccccgtgctagtccactcaacatattgtacgcactggtttactgactggttatgtgcatactctacattatctggttgaatttagggaggttatcagttgcctcatgcctagtagcttgcatctcgcatcagtttggtgtgcaaatccttttgtttgttgccatttcattttgaaaagctgactgggattaaggttcatcaaacacgcttgcatgatttggtccccatcagcaggaacgctctgtagcggtattctacagacaacttaacaaaagaggagttatctatcctacgatcctctcaactgagtgttgttatcaaaatctcagctgagtgttgttctatatatcaaaagtcccaaactttaagatatcagccttaacacccatcaacccttatcagaagtgtgagtactttttcataagaaaatcttgccatactactctatttacataacctaaataaccgttttctccttgttctataattccagattctgaatgtcgaggccgccgcactactttggtttatccacagtcctacatccatgcgtaccaccaatccaccatacgtccccttccccttacatctagacatctagtgatgccaatcggtgttttacctcttgcattttcgtactaattaacgaggcttccatggctaaatattattgggtcaaacaggccaagaccagtgcatcctcgaatgcatgttggactcaagacgagcaatcatggaggaagtctaatggcgatacgtaagagaggtaaaaaagaggtaagggtttgttaggttcaaagctaaattttggcctaacaaaattttggtagtactaaaaccttgcaattgttggcgctaccaagtaaaagcaacaagttttcctacacaagaatacggcacatcatcaaaaacgtattgaccgtcggataaaaagtttgaataaacaatggccattagataaaaaagtatatgcatttaaagaaaaacacaaatgagctaaatatatgaaaatttctggaggtttatagtgccacctcttaaactcatgaacaaagaaagagaggggcaattacgatgaaaaaacaggagccttctagtgattcatcatgcctagattcattttcctaagtggtatcaaattctcacatactatgttgtttttctttacggagggagtgtactctagtataatttagctaaatctataattggttagacaatttatacttactagataaatgaacttacgtcaaaaccttcttaaaagctaactaaactaataaattatatatagaagttttttcgtgggatcaaaagtcgagcaaagtgtgactatgtgactagttttaattattataggcaaaaactagtagcatactaaacatttattgatataaaaattagcttcaatccaaacaagctcgtatatagtttcttttttcttttacatgaaaagacatcatcatcaatacaatagtaagctagaccagtacagattaaataggtggaagcagaaagtgctcgaggacagttcgcgttcgcaccatgagcatcttggccctccgtcgacggcgctcataagccacggttactataggagtgatcactacgcagggcacggccccaaccacggcgaacggtccactcatgtagtcgttttcgaggaagaaaaggccagccacgcataagaccagcacgccgacgacgaaccagaacgccacacaagcgacggacagctgggtcgacccgtcgagctgcaggttccaatggatctcggcgatggacgccgcgatcctgtcgacgtcgcgctcgcccagccgcggcgacgccagcagcctcggccgccactccggcggcattgctcccgccgcgaacgcagcgtcgatctcatccttgatgctgctgctcatggtgatcgatgccgctgaactgaattgcagagatgatgaatggatgatgatatctggtgactgcttgtatcgatcagttgtcttctttccttcccttccaggcaaattaaaaactaagtgctgccatatccaattcggaatagttacaactaaaaagaaacgaagtacagttctacgtaccttgaatccgagtccatctctctcttgacggttcgtcgtcggtcgtttgactgacatggatgcatttcgtcggagagtaccacccactggagacaatctttcattcaaagaagtacgtagccgccgtcaactgcatatgctgtggattcactggaatcaggaggtgttgggtgagagtaagcaagcaggagccttactgagctcactgggactatcggcctccggccatggcaagatcgacaaagtccgtccgatgtgcaagcgacggtcgacggagatcgtgagttgaacgacgtcccactgacgtagaatcatctatgtcctttggagtgactattctttttagttctctttgtttacactttaatttactgggagcacactgcacattacgaaatcgttcatacattcatccttgctgatttctgctattacatttagggtcactagtgtagatatgtaatttgatagtgaactttatcagcttcaccatttttatatactctgaataagaattcctttcggcgtctcgacggagctctttttacttgatattttgaggtataactattaatgacaaaaatgcactagagtcttcttaaacatagaccaggtcgttgatgtgactgtttatagttgcgaatgtgctgatactttgtttcaatttagtttctgagtatatggtggtcgtgattttacaatggaaagttggcggtgaactgatgatgctgtcttttgattatgtttgcggttgcgatgtgatattccagtcatgataaaatgtgcctatatcttcaggcctcattatgaaatactccctccattcctaaatatacttttatgtgtatatatatatatatagttttacatatttcacaaaagtttttgaataaaacgaatggtcaaatatgtttaaaaaaatctacggtgtcaaacatttagggaagaagtgagtacaacaattttgcaggaattacattatttatttttgttgcagggaagtgtcatgaagatcggctagtcgtgttctcgtaacattgggcatttgggggtcgtcaaatgccaggtgctagtccatttaacatactgttcgcgctggtttactgactggttatgcgcataatctacattatctggttgaattgtagggaggttagcggttgtctcatgccatgtagcttgcatctcacatcagtctcgtgtgcaaatgtttgggtttgttgaccaaccagaataaagcccggcccagggaactagcgaaaggaaaagttgacgatgactccctgcttgcgttgtcagttggtttggaaaagctgactgagattaaaattcatcaaacacgcttgcattgtttggtccccattgttttttcgaacggccaccctcttacttgaacaggtttggtccccattgttaaactttgccttctttgctgcagcaagaatgctctgttgaggtaacgaggatctattttagaagcttgtggagttacactactgttataaacaacttttataatatctgatccccaaataatctaaattctcatctaatttatgagaataaatagcggtttcttagaatctcttgctaaagcagaaatcacaaccttcttcatctcatctcacagtaagttcatttttagcttcttctatttgtcctaaaataaatccatttttaagtaatcattatatcaaaatttataaaagtactagtataaaataattacattgagaattgataaagtgaaaaacaattacattaagatttatgaaataggggtatttcggtaatactaatcgtttaactcgacacgtccatctcctgcagaacaacatgaatacgtcgaccatatcaccactgcaaacaccgtatcgagatcacctacgacaacgaagcgagacgcgacagggagagcctacccgcacgtttcttcagccatccaaaccgtagctgaaaaaaccagacgcggtaggcgacccggaccagtcagcccagtcggacggaccccctctcgccttgccgcgacgcgaccgagccgacccgaaccgaaaccgaaaaaaaaaaagggcaaacccaacccaacataaaatcgcccacctccacctctcgcattccccttccttccttctcttcctcctcctcctccacccccaaatcgcctcgacgagcggcgcggcggcgagggcaggagagaggcggcggcggcggcggcggcgggggcgagatgagcgactcgttctgcccggactgcaagaagcacacggaggtggcgttcgaccactcggcgggggacacagtgtgcacggagtgcggcctcgtcctggaggcgcactccgtcgacgagacctccgagtggcggacgttcgccaacgagtccagcgacaacgaccccgtccgtgtcggcggcccgaccaacccgctcctcaccgacggcggcctctccaccgtcatcgccaagcccaacggcgcccagggggagttcctctcctcctccctcggcaggtggcagaaccgcggctccaaccccgaccgctccctcatcctcgccttccgcaccatcgccaacatggccgacaggtccctcctctttctccaatcttctccccttccgccaccatcacggcttagttttttacgggctcgattcgatcgagacatgaggatgtgcctgcggcttgcccttgatttatctcgtatgttgaaatgaatcacttgatcgtgcggagcccctgccctgatttgggtttgcgggggagcggatttaggagttgaggagtgtgatggggcttttggagtaatggggatctttcttttgcagctatgcctgccatgtttgtaggtttggaacgtgtgattctcgtgtgaagttctagagcggttcatatatccagtagatttactgatgcatctctggttacgcttgggatctatgtgtggggaaggactcttcgttgatagatttctgaatttgggataatgcgataaatatcatcagattgtaaaaagtgtaaaaggaatttcggggcgtataattaactttgtgcaccaccaaatgctcatctcatgtagttgtattagtattatgtaccttgggagcaatgataaatctactacaaaaggtgtgtagcaccagttgcttgaggcatgtgaggtagccatttagcttcctagcaagctagaactagtgaaatgttactttttggcatgaggcatgtgcaattgcaatagcctcttctactagtggatctataggaagggaaacttcgatgaagaaaaacgatgttaggtttatttggtttgattgaaggagatgcagaaacacgatgatttactgctatggcagtttagatatttttcttatcacaggatttctgcaatactctgacatgatatctctaatctcatctccaggttaggtcttgtggctacaatcaaggtaaacattctgactgttactttccatgatatattgggtgaactacccctattttttcaaagttgcgcttgcttggcagtgtacatacttgatagtataatgcctgcatgcacacaacagacttgaaagtttatataaaattcatcaggctgcttccatgctgcacgattccatgttatgtggcatgacttgtttactctatagtcagcttttggaaatattaaccgctgcttctttggacatatttcatttgctacgaacagtaacacgatgctggttgcttgtagctgtataatgactgtgttgtcttttctttctgaaggaccgagccaatgaaatatataagaaggtggaagatctcaagtctatcaggggaagaaatcaagatgccatattagctgcctgtttgtatattgcttgtagacaagaggatcggcctagaactgtaaaaggtacagtttgttctttgctgaatgcatttatctgaatgcgttctgaatgcatttatctgatgcgttcttgtttgatgtgatggcttattgcagaaatatgttcggtcgctaatggagcaacaaagaaagagataggccgagcaaaggaatttatcgtgaagcaactggaagttgaaatgggtcaatctatggagatgggaaccatccatgctggagatttcctggtctgtagtttgccatgtattctaatgagtccttgtctgaattgattgagtgaactcttgaataaactgataaaacctgcagaggcgtttctgttcaactcttgggatgaacaatcaagctgttaaagcagcccaggaagcagttcagcgttcagaggaacttgatataaggtttgacattttggattcattatgaaccattctgatgatcaatagatcctttgtcatggaagttattttatccgttttagcttcagtgtttatcacctctaaatcactgatgcttagatcaatgcattgactagaggaactaatcagataaacgagttgcaaatacagctatcagcaaatctatattcttaaagcaagtagcatacatatcctgtacagtccatacatacaacctcattatccccatttatgtattgggaaggggcagggctgcaggagagctagtttttgactattagacacaaactttccttattagtcaaattccaagtgtgcatcatgacttattatattcacacctccgtgcaaacctatgctgtgcaggaggagtcctatttccattgcggctgctgtcatttacatgataacccaactctcagatgataagaagcctctgaaaggtttggaacacagacccgttctatgtttaacttgcaactgtttaactcgttaataacaccgtgaaaatgttgcagacatatccttggctactggtgtggcagaaggtaccatcagaaattcatacaaggatctgtatccctatgcttcaaggctcatcccaaacacctatgccaaggaggaagacctgaagaatctgtgcacaccataggaaatttttttcttttcttttttgtcacataacatggaaattagatttgccagagaggagtaatgttgtccttggatgtgagttttactggcccatgtatcactgcacctaattttatgtgcatggacctgttagaacaaagttatctcgaatcgaagctaagttatatgcaaagcttatttaggaatggcaaaatttcatgcattaccttgtgagcaactttttaaattgttgattgataacgaccaaaacctacggaggagcgataagtttcacaaactaaaatgatctgcacgccacatatataaaattttgcaagtggtatcatgttcatgaattgccaggtagtggtgtattcgtatatatttttttatcggaactgcagatcttgtagggaaaaacaaaagggaagtgaatcttgaaagagctttgcagttcatgccatactgccaaggctcgttgcatactgccgaggatcgtgccgcatgatcgatgcatacaagggaaaaaaggagatcccttccctctgcgttggcacttggtagctcctgtgctgaagcagcggagcctttttcttgtcttgtcagccaccaattctccaaatgcagaaatgctgcgaggtgcggaggacgcgctcgttgtgccagccgcccagcggcgcgcgcgcgcggcgatcgaccagctgcgacgcacagagtgcagtggcgcaccacggccgccgtcgagcgcgggcggtgggatttggcaatgccgcccatggcgcgggcgtccacccgtttgacgccgacgcggtcgccgtatctttccttccctcccaacttgctgacttgcaccttgtttagattttgatacatggtgtcgagttgtcgaccggagagggtggagtattgacaaatgttgatgtacagtgatggttcgtttgaaaatatcattcgagactcaaatgaatgaataaaatattgaatggttgataagttctttttagataaaaaaagctttctaagaaataccgataatttttttaccgtgataatatatataatctgtagaaaaagaagggccctaagagcggtcaacagttaacacctctaaaaaaacagttgatacacaccaaacacgcaattgcccccaattcaaacgggtgtcttgtgcctacgcttagaaatcaatcatctaaaacttagctgactggatctggtttttccaccataagtagtttagttactgggttgtttttattgtgtaaatattgaaaactggtattttgttgtgtgaacactgttcaggctttcttgcagggccagtaaggtgtggaggatcaacgatcctacggcaacatcgattattatgctcaacaccacaacattccttgccttccacagatgtcgggtaacaccacatatagcagcaatttttcacgtgttattggtcactcactcactaacaaataataggctctcgtaacgccagccaggtctatgagaaaaaacaacacagtggcatcttgcattattccctcgtgtgccaaaacaagcacggtgattgaacacgaagtatctctatcaagcaatatggtgtggtagccgtctcgctgcctctgggtcatttatttctacagaagggttacatcaggctgcaactttcttggaagtcaccgagttgataatagtggcaaaatccggaccctgcaaaacggaatgttgcgtaatgaaatacaatacacaattacacaatagcgggttcattggtttaagaacacggcaatcaacaggctgtatttcaggatatgatgttaatttatcataccttcaaagaggcaccaccaacaaggaagccgtcaatatcttctttctttgctagctcggcacaattggctgcatttacagaacctgtaccagaacgaatcataaaatcagtgaggcatattgccacatcctagctggcatcaaattaataatggtgcaaatattctctgaagtcacaagccttagcaggtactgataccactagatcgggcttctagatatttaccacaaacaacatatttcaaggaataaccaggctttcaattgcttatataagagaaaaatagaaaaatccattttgttagatgctgttgttaaggacattcataacagagtgtttcataatatatcaatgttcctaaattctgccttccaataatcaatttcatggggtgaagagaggagaaacacagtgaaactcatccaagtgataagaaaccgacctccatatataattcgaatgccggaagcaacctcaggtgacacgttggttttcaaccaatcacgaacagcagcatgaacttcctgagcttgctcaggagtagcaactttcccggttccaatagcccaaacaggctcatatgcaattactacatccgcccagtttgtaatactgtctgaaagcaacatgttgatacatgaatcttgtcttcagatgatgtaggctcatcaaccattattaatttaactcaagatgaagaattgtcacctgcaaaagccttcatctgcttaaaacagacgtcaaaagttttccctgcttctctctcttccaacagctcccctatgcaggcaataacctttacattttgactcaaggcatatgcagccttcttcccaataaactgcatttataaacatggtatgtcacaatcccaatcagaactactgcatgtcaacagcaatcatgcatctcaaaggtgccttcagaatgttacaggctaacagcatggacaagtggacaagtgagagaactaccaatccagtagcatctgtgtatatagcgcttacctgatcatcttcaccaatgacatgtctacgctctgaatgcccaagaataacccattggcagccaatgtccaccaattgctccgcactatagacattttaggtgaaacatataaaaactccagtgtgaaaacaagaaacaaaaaattatctttttgcgcttgcttaaaattcaaagctaccataatcccgtaaaaaacatcgaacagaccgccaccatttatcatcaatttacacatggttctgacgccatgtaatgcattatactaaagaaaagaaaattgcaacatgtttttagctttacctgatctctccagtgtatgctcctccttttccaatccaaacattctgagcagatacctcaatacgatcagttagtgagttcttaacctgatcaatataaatgaatggtggtgcaaccacaacatctgcagtattgccacagcaagttaattgaaggtagaaaaagatagacagtggaagctaaaaagaattccggaggatggatttggatgaaaaagaaggcatgaaagaaccaatcaaatacacacatctaacacagtgtgtatagagaggaagagaatcatgcatagatgaataaaacgtgcttaccaacatcaggttcaagtgtagcagcattcaattcagtcacaagcttgctgacagagtccttcgttccattctaaattgagggacaagaaattatatcatcagaaccaatcatactgatagtaacatatctgaccaaaaagtcgggaaacatgtcttgatatagttagcataagctctcgataaaaagtgaagcaacatataataccgagatgattctccaaaaggaaaaatgagcaactgaatcagctcgtcctaaggatggcctaaagaagatgctactatctttatttttggacaagatactgatgcacactttcttaccctcggaccactagaactaatttattttggacaagatactgatgcacacactttcttatccttggagcactagaaccaatccctgtctacgtaacagtagttgctcgactccatgaaatttgggcaaatgagaaagccagggactgagaagatgaagtctgaaaaaaattatacatttttgcatataagatgcatattccccaagagaactgcttaagccaaaaacgactacatcttgtggcaccaaaagcgactccatatctagcaaacacgaccaggtgtggtgtagatcacgatgtattgatgacgacaaaaaatcccattcattccgctcatctttggaatgtcctaggcggcaaccacaaggcgccaacgactcaagatcacgaaggtgcagcagcagcagaatctccatccatcatcgctctgctcataggtaccccgtgcgtctgcaaaagttgattgatgaggaggagcggatacttacgcacttccagttgcctccaacgaagaactgcaaggacagcagcagcagcagaaagaaagaagcagcaagtcgtcagccacgagcacaaaagggcaacgaagggaagtgtaattaaacgatagcaggaaggaggatggatggcaaccttgccggatccggccatggcgacgacgcgctgggcgcggcggcgggagcacccgaggcggagctgctgcggatgcgccggggcggcggcggcgacgcctgcgcggcggaggtcggcgaggcgggagaggtgggaggacgcgagggacgacggcgccgccattctctctctccaatccaacccaacccaatccaatccccttcgtcgcgcgctgcggttggtgagagcggagctcgcgagctgaggtgaggtgaggtggtgatgatgcgggcagcggcgcagccaccaccaaccgcggaggaagggggaagagaggggagagcgacccgtgcggaggtggagggccacgcggctttgtatggccgcgcgcccacgcgcgccttatcggcccacggatagggcgcccagggccgtggcctccgccacgtcgcctggtatttcctgggccggcccgaccgcgacagcccaagcaacactccacaaggaatgttccagaatctctcttatgctttgtttagttcctggtccaaaatattttttaaagtatacggacacatattaaatcgaacgtagattaataataaaataaattatagattttgtctgtaaactgcaaaacaaatttattaaatctaattaattcattattagcaaatatttactgtagcaccacattgtcaaatcatgatgtaattaggctcaaaagattcttctcgtgatttacatgtaaactgtataattggtttttttccgatcacatttaatgcttatgtatgtgtctaaatatttgatacgacgaaaaaattaaaagttttttaaaaaaatgaatctaaacgcggccttagcttccctcctccgctccactgactgtaaattggaaggttttttaaaaaaatgaatctaaacacgggcttagcttccctcctccgctccactgactgtaggcccatgtaactggggcccacacttcgtgacgtgacgtaacgtgaccactcactctccgtggggaccagcgaggccctcgcagagttgcacacgtacgggtagaggagaaaatgcgcgtatcacatgacactgacaagtggagtctagtgtaatacttcctctatattttaatatatgacgctgttgatattttatccaacgtttgaccattcgtcttatataaaatatttatgtaattatcatttattttattgtgacttgattcgtcattaaatatttttaaaatatgatataaatattttcatatttacaaaaaaatttaaataaaacgaatggttaaacgttggttgaaaaatcaataatgttatatattaaaatatggagagagtacttaccccgacgtgtcagccaaaaatacctttcatcccgtttataaaaaatccgtagttataaaatccaaaaagcaaattaatatcactatctccacttcagtcgttttaatctttttagttctaatcaaatttataaaaaagtaatatttttacaaaaaatataaaaatattaatatccaatttaataaaataaattgatactataaatattacaataattttctataaatttagttaatattttaaaaaatagctttaataaggtcaaaactacttcagaacggagggggtattattgagaagctagaaaaaaaatacagtgttctaaaaaaaaaagaaaaacaaattcagcctttattttcatcggcttctcagactcggtctcgacttcagactagtctgtctgaacgaggtcgagtcggaggagttgcatcgctagcttaacccgaccgctttttaaatcgaaatcccgcagttaaatcagagatttatgcagacaaaagaaaaacacacacacagcaattactattctccaacccaacacgccccccgcaccgccttccgtcctcataaacgcgagtgggtttaaactcgagttgtttttttgttcgttaatcctcgccccctctttctctctaatctccgccaaggcgatggcggattcgaaggggagcggcggcgccgccggcgacaagcccggcgccgacgcgagccccgccacgaatccggccccgccagctgccgccgtggccgtcgccgctgcggccgcggacgccggaggggacgacgacgtggccgcggccgcggaggcg

SEQ ID NO: 66617 - DNA, 3503 bp, Oryza sativa
gtagaagcatcagcaaagacaattgattcagtcttggatgcctttttgagggaggagaaccaatctttatcaccggtcatgtgccacgaacaaccggaatccacaatccacacgttctccttccttgccaccaaagcctacacacaagtagacgtcgaagcctcagtactggggttagatgataataaaaatttaggaatccagtactgagacacacgaccagaagatccaataggcatatatccacgtgcaaaatcaattttagaattttcaaaaaaattcctccgaggccggtctgaccgaggtacagtggccggtctgaccgggggccggtctgaccgcctctgtaccgccggtctgaccggtgcccggtctgatcgaggctgttcagccggtctgaccggtcgccagtctgaccgcgggacccactgcggtctgaccggtttcttcgagggaaaaccagatttttgccactttgattttgcaaaagcaatctctctctcctttttctgtttatgagctaatctgaaacaaaaatcaacaatatgtccatcttttccacaaaaagaacaagtatatttttcacgttgtttagacacattgttagagctagaagatttagcaacacaagcagaaacaggaggttttgcatgcacaacattggattttgaagaagatgcactcatagtagacatgataccagcagatttaaacacagttttatttgtatcaggtttaatcaaaatctcaccacttctagcaccaacacctaacacaacaggaggatgtctagagttatgagcataaggatcaaaacctaaaccacagttatttgtgctaacctttgattgatcctaaatcatgttgaggttctttttaccatcagaaaatcttagcaaagaatttttcaaataagaaacctctttttccaaattaacacaattttcacaatctaccattacacctttgcttttccgacatttggggcaagaaagcacttcattgtttttcacaacatcttccatgtactcaacatgacctaaagcatcttttagtttcatgttattcaaattacatgttgagcaatccaaaacatcatgatgttgttttaactttttagcagaaatcatgttaaacatcaaactagcataaaaagcaatttgatatttttgcaacaactttttagttaaaaacaactcatccaaagtgcgtgtgtgcagagcaaaactacaagcaagagaaggtctatttttcaaatcatgtgcagcattaacatctctaatttttgaaatctcattcattaaaacctcacaattttcacaatcatcatcattaggaataagagattttaatctatcaatttcagatttaagagatttaatgataaactcctgttttttatacatcttctcacactttttattttttgcactcaaaatattaatagcttcctcaaaagcactcacctcattgtcttcatactctgtgtcagattcaccacgcgccatgaagcaaacatcggagacgttctttcccttgtcatcatctccactttcaccatctacatcacttagtggctcgaaagcggcgcaaacttgttgaaaagccttcctaagattctccatcttcctcccttggttagaacccttcgacttgtagttgttgggcttgttgttgttggtcttctcaccatctttgccttctcttttgcctctcccaagcttaggacaatgcgaacgaagatgatcaattgaaccacattcaaagcaacgatttggaccacctcttttcctgttcctggcattattcatagctcaagcaattcggttagcaaccaaagccaaatcctcctcctcgatttgttcgagttgatcatcggatgtggcattaaaagcagcaagaaaagaaggcatagatgaagaagcatcaacaaccaaagaggaagaagaagaaaccaaagcactcgatttagaatcaactttgcgagaaagaatattcatctcatgtgttttcaatttagtataaagtgaatccaaagtcaaagtagacatgttaacagactcctgaatagatgtaactttcatctcccaaatagacatgtcgagaccattcaaaaagtgacaagaaatctcagattgtggataattaacatcataagaagaatcaacagatctaagatcactcaaaattttattaaacctagaaagatagtcatctaaagcttctccatgtttcatctcaaacttaatgtactcctttttaaaaagatctcgacgaagctctttaatgttatttgttccttgatgaaaattcttcaaagcattccaaatctcatgagcagtttcaagatgtgcaacacgatcataatgagaacgagaaatcccactcaaaaaaatgttgcgagctttgcaattttgttcaaaagcagttttttcagcagcagtattaataacttcaggaatcacataagcatgagaaacttttctccaaatatcataatctttagccataatgtaagactgcatcctactacaccaatgagtaaaatccgttccatcgaaaacatgaggcttagttgaaaacctagcgggagtagccatgacaaaaactttagatcgataaaaatccaaagaagaaaacaaggctctgataccaattgtaggatcgtaaagggcctttcccaccccaaaagctagccattgaggtgaggggctcccccacttatatcttaggtcctttacccttccacaaccaatgttggactattcaacaatctcccccttcacacattggtgtccctcagcccttcaccgccccttcaccgtatccgggccccaccggcccatggtccatcaggtatacgggccccgcagacacccacggtccatcaagccttcacacgtgtccatcgggccagagatgttaacctagccaggctctgataccaattgtaggatcgaatcacaagaactaagccaaccagagggggggtgaatggttggtatacccaaaaaccgaaaacttttagcggaaataaaagttaccctcgaaatcgatggatcgcagtctgaccgaagtagttgagccggtctgactgcctgatgaacgtcggtctgaccgatgtagatcgatcggtcgaaccaccgaaaacacctaccgccgactcctgtcgccgccggtctgaccgccgtgtgcccgccggtcggaccgccgcgatgccgccggtctgaccgccggtgtgccgccggttagaccaccgaaacccggtaaacacaaatcgaagaactcttaaagtggatgacgactttattgattctctctgtgtttacaaagtgcaccaacagcactccttacaaaaattttgactaaactcgaaaccctaactcaaaactcaactctattgctttttaaagtgatacaaggaagcctcacgctccccctttaattaaacattaagtaagcaagcctaaagccacgaaccaaactcatacgggctgcaggaa

SEQ ID NO: 66618 - DNA, 8487 bp, Oryza sativa
gtgaaaaccaattatctccaaaaccacttcgtgattaattccaaatacaaaaccaataatgtccaatgcccaattgttcatcacagaataataatcaaaaacacctttgattttacagcacgcttaattcaacacttcccggcttcctgtaatgtttgtatagccaccaaagcaagggctgtgtttagatccaaactttagtccttttctatcacatcaacctgtcatacacacacaatttttcagtcagatcatttccaatttcaaccaaaatctaaactttgcgctgaactaaacacatccaagaattctccaacggggaaaatttctgggattaatcaagttcagaaacggggcagccaggtatggagattgtcaagaaacaagcacggatggacgatcgctgcctgtttttggtttcttttcactattcatgtcctcagtcctcgagcaggtgcaccattgtccccagggccatggcaatgtgccaaattgccaatgcttgtcatgaatatgacaacgctagctagctcagcggaccacggctagaagcacagtggcaacatcgccaccagtgtcgtggtcgttcgccgcccacagttggcaataccactgcattttagtagcctttcatgcatgttctgcctaattcgtgatcgaagaatcatgtactatataataacgtatagattatatatttatatgtaggggtagggaaaataaacagtttaatccaagaaaactataatagcacgtactagtagaaattatgttatcttcctattgtttgacataaaatgtactatctctgttttacaattacttcttgttctaattttattctaagtcaaatatttttattttcaatcatcatttttttatatattatgaaaatatttctcattatacgttaataacataaatcttacaatattaaactataaattaatgtttgacttaggatgaaagacacagtactctaaaatggaccagtagcgtgaatgtctcggtcagaataaatatgtgaaccctgtaaaattttcacgtaaaagtaatataccatgtatgcatatgtagtagtaatatatactgaaattttttttaacatttttgatagataaagttatgcaccataatgtctttgattttttttttcaaattgtttgagtacgattgaattatagaaaaatatagcaacacctaaaacactaaattaatttatgaatttgacattggatatattttgataatatattagttttgtgctagaaatgatgctatatttttctataaacttgatgaaacttaaaatttctaactagaaaaaataatcaaaacgatgtatagtatgaaacgaaggtagcagtatattttcatacccgtacatgagtacaacagctatttaaatgggagaaaatcttcccttttcaatcaatcataaaaaagatcaccaaaatccctcccccaaagaaaacacacacagtacaatccaaatcacaatcgacgtcctaatcgcacgcgcttttaatctcgattaaactactgaacgtaaatagcacaactatccattccctcccccagccaaagctatagcatagagcgacctttcgatcgttccctataaatcaccacccctcctcgtcgcctccctttcgctgcttacatgcaaaaaaactcccataaacccctcctcttcgagaaaatccctttttgttcaaccacgacgcgaattcccaagcaacccccccacacccagctgagtagctgacgcagcaccagcagtcgcggggaaagggacacgtctcgccgccccagcttcccgcctccctcccatcccgccgccgcggacgcgtccaagccacagcaacagcaaccactccgacgaacacctcgcctgcgcgatggtggcggcggcgctggacgcgatggcggggacgaggtgggggaggtggctggggctcgtgacggcggtgtgggtgcagtgcatctccggcaacaactacaccttctccaactactcccactccatcaagacgctcatgggcctcacccagctgcagctcaacggcctctccgtcgccaaggacgtcggcaaggcgttcggcctcctcgccggcctcgcctccgaccgcgtccccacctggcttctcctcgccgtcggctccctcgagggcctcctcggctacggcgcgcagtggctcgtcgtgtcccgggccgtcgcgccgctgccctactggcagatgtgcgtcttcctctgcctcggcgggaacagcacgacgtggatgaacaccgccgtgctcgtcacctgcatccgcaacttccgccggagcagggggccggtgtccgggttgctcaagggctatgtggggctcagcacggcgatcttcaccgacgtctgctccgcgctcttcgccgacgacccggcctcgttcctcgtcatgctcgccgtcgtgccggccgcggtgtgcgcggtcgccatggtgttcctccgcgagggggaggttggcggcggcggcgcggacgggcgggaggaggaggaggaggatgggtggtgcttcgccgcaatcaacacgctcgccgtcgccatcgcgctgtacctcctcgccgccgacctcaccggcgtcgggggaggcggcggggtcgtgtcggccgtcttcgtggccgtcctccttgtgctcctcgcgtcccccgccgcggtgccggcgcacgtggcgtggaagtcctggatgaagacgcggaagctcgcgaacgccgacgtcgaggaggcggaggagtgcgcgtccgccccgctcctcgtggcgaaggcgacggcggcggcggcggcggaggcgcgcggccccggcgagaagccggtgctcggggaggagcacacgatcgcgcaggcgctcatgtcgctggacttctggctcatgttcgcgtcgttcctgatgggcgtcggcacggggctcgccgtgatgaacaacctggggcagatgggcgtcgccatgggctactccgacgtctccctcttcgtctccatgaccagcatctggggattcttcggccgcatcgcctccgggaccatctccgagcacttcatcaagttcgtctccttctcccatccctttccccttccatctccgtacacaaaattgaaccgcaaaatccccagcgcttattattccaaaaaaaaaaatccccagcgcttactgtcgccatagatccgtagctccgtagcacggattaggtgtggcattttctttcgctagagttggaatcttggagcccactagcccgccattggtgatggatgggtgctgcaaccatgtcggcatccgtagtggtggtgcccaggttggagcaaggcgagcatttccaagacagagtcaagatggtcaatagaatttcagatattgcaacttgcccactttaattgtagtactatagtatgatcattatactaagctgtaggattcccagattccctcggatacatctgcctaggaataggatggatcaagttgacagactgagagaacgagagagcttagttgggattggggaaaatggaggttttggttctagttgggaatgggggaactgaagggtttggttcttgattcctttggaaggatggcttacactaatctgcaatataattagcaattgtagagacaaataatcatctttaggtatctgcacctgctggttagaatggtgataagatagcagtagcacaagttgtgtttaagctgtaccccgtagtacttatctgcaggtactatccatggagaattggtagtcctatgctttcagtggtcactacctaagtacctaactgcagtccatactatatggttactcaattcacatgtatagagtacatgttacctttctgtgttagtggtcatgtgtgcatagcacatcatgtacagctggtgtttccattaagaactgttatcggattatcaacattggcttccttttcttttttggatcaacctattctggaagagcaattcgacatattattagtctgaccaaatttatgtaaaactagggagtcaatgtctacaacttaatgtgtccacttcgtagtcttaatccaatgttcatttcatttctgtatgcgtttccctttcctcaaatattttgctgagcttctgaacgtgacaaaatttcaggacaagagcaattccacgccccttgtggaatgcagcttcgcaaatcctgatggccgtgggctatgttgtgatggcagttggtatgccaggctccctcttcgtcggctccgttgtggttggcatctgctacggtgtccgcctggcggtcaccgtgccaacagcatctgaactgttcggtctcaagtactacggcctcatctacaacatcctcattctcaacttaccactcggctccttcctcttctctggccttcttgctggcctcctctacgacgcgcaggccaccaaggtacccggtggtggcaacacctgtgttggtgcgcactgctaccgcctcgtgttcgtggtcatggcgattgcctgcgtcgtcgggttcggtttggatgtcttgctgtgcttcaggaccaagagggtgtatgccaagatccatgagagcaagaggcagagcaggtcggcagttgtgcagagggtaagctagccaaaacctacagctatgagaaaaatggtacagattcgcgcaattgcatcaagattcaatgattcaacgagtgcaggttctgtaaattttgtgcaaataagaggatcccatgtcttgattctttggaattagatggatggatccattcaatcggtatagtttaactgccacggaggtttctaggggctgattcgagcaatgtttgccctgtgtgtgtaattcagtactagtactgactactactgactgagaggctgcagattgtggagttgtctgatccctcggtgtaatcagtttagtcagtgtatccttgaggaaatgtattctcggttttagcctgtacgatgaattgttgtgcaattagcctgttggcatataaattcagatcaattcaagccattctttttggaacattgttaagtactctatttattttgagcatgaatggatgtactcagttactcagagtctgaaactagaaaccaatcaaccatcgaggaattggaatattggatgaaagaaaactaatctactgggttatatctccaaagttagaaatggcgaacctgccggccgccgtcgccgtcgccgactccacccaagcgagatcgtcgctgtgccgccgctggcgaggaaccaatcggtgctggtgcgggtgacggcgacgcacccaatctcggatgcttgcgcagaggaggatctggagcacttggctggggatcgccgccagcaaagggaaggggaaaaactgcctggagcctgctggaccgtaggcttcaatctgggccgtccaatgcagcggatgtggggagcacgaatcttggaatacttatggaaagagccccatgtacttgggaacaaaatgtgttgaaagttgaaactataattatctgtagttcgtaaaagaatcattctttggtctatggatttgcttttttgtgattcacttgagttaggatacaccaagcttcaagaagataattaattttattcttttgattaccacctttatggactgatccgtgtttgcttgtttgtttcgtgtgttgttgttcagtaactaaattcttgcagctcgcgtgcccatttctaaggaaaggaaaatccttcaacctgggcctaagaattgctaattctgctcctagccaataatcacctggttatgcaagaaacagctcgatattgtagtaatttatcagacggttcttaatgaaaccatagtacttcaagcgattcaggtgtacttgatgcttgagaacctgttccccatcttgatgttatgaggctttgagctgcatttgcatacagaagtaggaaacagaaaagctcatttccaagtcagtaccccatagtagcaaaactcatctggttgtcagattactaaattccaccattttactggatttatctagccattgttcttcagttcaacaagcaatcaagcatgtctgaatttcattgcaaaagcaaaaatatcttgtttctccatctggatattaacttgatcggtcttttgtcaacatttgtgtagagctgattttctaatatgattagtaccagtggatgctgacagatgaagggcacagttctgaaggtagtcaccataccttaatggcttaatatcacgtccccgtcgaaatctttcagatctgtttgggcctgtttggttgctcgcctcaaatcctgacaatgtatacacatgttctaaatatctatccagcctcactttttctttccttcattccaagattttacatctggcatttgtggccgtaaatgcacatgttgaaacggagcacaccgttgaaatttccttccagatgctttcagcagatttattgacctggcggcaaggatatgtcagttgttgaacagtctatagaatatttcagagaatccgattattaacagacgaaggaagtataattctgattatattcgaacggcatttttggggaaaagaaaaagaaaagtaagatttgcagaaagggttttattgtcactgctagggaagacttgttttcatttcatcaaagcagatatttttgtcacattcttgactaatacacgtatagctatatttcaagccaaaagccatctacggtaacactagcttaaactatcatattcctactgacttacctgaattattttggtagcatcagtttacacaagagatcaataggtccacgaaagccagcaggtgcagaggataagtaaaatcctgctgcctaaaaagaaagaaaaatgcacagcttccaccatttagcatatgcagattcagcgaaagcattttgaacctacaggtcctgtaaattcagaactaatgtatgattcatgtcttgattctctgaagaagatgatggatttactcaaacggaatagttcagaacgacatcgcgtcaattcagttcatgaagtaaaggtgcatagttttcaaggaggccctcgtactattcgtattatcatttacattcacaaggagtagttctgggcttctgggccgtcggtccgttatgagcgtccgaaatttatcttacctggtgaacgaacaagttacgtgtattttacaataggacccctatagttcatcctatttgtattttgaaatagaggactcaaaagagaaagtttcttccaagtcccgtgccgaaatcgcatcggaaacaatccaccccatgcctacgggagggaggcaggctagcgtcgcgtgtttgattggtgggattgcatagtcgcggattgggcgggaccgcgggagtttccgatcaaggctgaggagataggcggtagaaacctcgaaggtgaatctctctgtctatatgtgttatccaatccacatttgttttgatcagatctagatgttgagaaacagtagcgaggctcctgttctttttttgccgggtcagccaaaggttggccgaccaatttcattaagaaaggaggaaataaagttaaaacaacttagttacaacgacaacaaattgtcgcgctagaacgagcgaagcacgcccagcagaaacagcaaaacaaaggaaaggagcaaacgctcaaaacttccggctgattactcactaatgagggaaaagatcccggctgctttccaaacttcaatttcctccctgatgtcctgcacaagctgctgtgctgttctggacacattttggaaaatccttgcgttcctctccttccacacaatccaacaaatcagcatgaacaagcaatcaaaatcgctcctgtagctcaaccgacagcgtgatctgaccgtcagccaccaatctgacagtggcgtcgccatctccgctggcagggggaaatccacaccaagccaccccctgattcgccgccatacctccgtcgtgaaagcacaatccaccagtaaatgatggccgtcctcgctgttttgtcgacataactgacaaagatcctcgtgaggccagtttcgcttggcgagattatccgctgtcaagcatttacctttgagtgccaaccacatgaagaaacggactctcgacggagtcctagattgccacagcagttcaccaaaaggacagtcctccttggctaaaaagaaaagattgtatgctgaagaggctgaataaagaccatcagcagccatcttccatcgaatggagtcagcactgttgtccagagttacctcccgcatttcatcccaaagctgaaagaactccccaagggcttcagtcgacaaggagcctagaagatccctcgtccatctatggtcgaccaatgcttgacataagtgaaaagggtcggccatctccaagcaaagcaacctttcccagaccaatctacagtccaaaaccgtgtatcttgaccactccc

SEQ ID NO: 66619 - DNA, 11820 bp, Oryza sativa
agcttgtcgaggataggctgcagtccagccttcgtgggtttcctggtacccaggggtagaccgagataggtaatcgggaagttctccactcgacatgagagcgtctcttcaatcaagctcagctgatcggcagagcagtggatcggtgtgttcgcactcttggagaaattggtcttgaggcctgttgcatcaccgaataggcccaagattgccttgatcactagagcctctctggccgtaggccgaaaaaacaacacggcatcgtcagcatagactgagatagaaggtaaattctgtcttgctgagagggggaaagaagatgcatggttcttgcttgatccaccaaagcttgaagggaatccattaccagtacaaatagcaacggcgataatggatcgccttgcctcagcccccgagccggtttgaaggggttcgatgctactccgttgatcaggatgctcgtcttctctgtaacgaagatcatagaaagccaccgcctccagctcggcccaaaaccccgaaatttcaacatggacagtaggaagcaccaagataccgtgtcgaaggccttggaaatgtcgagcttcaagagaatcatctcctccttccgtttgtgaaactgttgcactaaacccttgacaaagacataattctcatgtatacttctacccttaatgaatgcagtttgcgagaagggaaccaattcatccagtcttggggccagcctcctagccatgacttttgttgctagcttgctgaagctgtgcacaaggcttatcggccgatagtcctttaggagagttggggcttctttctttggcaaaagagtaatcacagccgaattgagcaaatctaagttttggctactacctgagcagaatttgtcaagtgcttgcatcagctctggtttgatcacgtcccagcaagtctggtagaaaagccccgtaaaaccatccggcccaggagatttctcattcggcatactccggatagctgcccaaacctcatcttcagtgaaaggattgtctagctcaatcatatctcctctcctcaactgagtatgctgaaaaagaatctcccttttgtcactctcccctgagctcatcaccatctcgaagtattctcgggccaaagcttgcatatcttgttgagatgtggcgcatctcccatcgtgttccaagattgggatcaacaacttccttcttctagctttaatcttcatgtggaagaaggcagtgcctgcatccccttccctcaagtttcttacccgagccctttgtctcagccgaattctttccaatgatgccaactccaaacatctccccttgcagccagcccctaaggcggcgctccaagtccgatagcaagcgagattcctgcgccacatccagacgcaaaatcacttcgttcgcaatttggatttgaagcctgaacttactgattcttctttgcccccacttggtgagtttcttgcacagccgcgccaacttgacatgcaaaatcgagtaagggtcatcagactgaacttcctgctgccagctctccatgaccgcttctaagaaaccatccaacttcgtccagtaggattcaaacctgaatcgtctggttctttcccctgcaacaccgcaactaagtagcaatgggcaatgatctgagttggaggaactcaaagcctgaagatgcgcttccggaaagcactcttcccactgggttagacgagcaatctgtccaatttaaccagcgtcggctgctgctgctcattactccatgtgtatcgcctcccgaaaagatacatgtccctcaattcgagctcgttcagcttgttcctgaaggcattcatcaaccttctgttaattctgctattgctcttgtccatcgcagccgcaatgaggttaaaatcaccagtgatcatccattctccctgacaactgttcctcaccatcgacaattcctccagaaacagcagcttgtctgcatccccttgtggtccatagactgacgttaggaaccaggaacgctcgcccaggatccaacgaagttgcaccgtgattgaccactgtcctatatgcactacattcccctggaaagccgcccccttccatgctataattacccccccgcgagtctgctccgccggcaacgcagcgaagccatcaaatctaagccacaggagtcaaacaccaccgccgaatccaccacctcaagcttagattcttggaaacatacaaccgacaccccactcgacatcacagactcccgcacaagggctctcttgtcagcattattgaggccccttacattccacccaagtaaactaaaagaaagagaggaggttgacatggaaacagatagaacaccagcccacaccgcctacttcgaccccgacgtcagacgtattccctcaagccggagacgccgccgccatgaaccagacggaggacagaaccaggctcctgttctgtcctccatgctggaaaaattttgcctgaatcagtcgtaagcatgtggattggtacatggtttatgcttttggttaccatcttaattatgcattgcattcctgtatgcagcatgaatatatacataagccaatctaatacctggtccaattttaccggtctagctaggctggtgctgatttgacaaaatagtcctagatgaaagtactttctgaagagattcaggtatatttgatgcctcaattcaacacctcatcccctcatattctaatgtgagtctttgagctgtttatatatataggccttttaggataacagatcaacagtgtaactcaccaaattcagttgtcttgcctttgaccctcagtttagttggtcactcggatttgcaagaaaaaaaatatcttgcatctctagctggatattaacatgacctcttgattcttgttggtgctgtgtagatctgattttgagagacagtcggtataagtggatgctgatatggtgaagctcatactttttaatgtggcccatgttgcttaatatcatgtccctgtcaaaaccttccatgatttttaacggctcacatttgataaacctgtaattctaaaataaaagttggtctagtgtttttttgttgtttttcagtggcacttcgccccataaagcacatgctgaaacatagcaaattgctgaagctgccttccaggtcatttcagcggatttaacttcaaggttaagataagctgattgtgttgtagacaatgacacatttcgaatatgcttgacttcttctgaacttagtagttttgtttgatttcccctgaaatggctgcaaactcttgtcggcatgaggattctgaagaatattttatacccaaatacgggatgaatactgatttcaggattctgaagaatattttatacccaaatacgggatgaatactgatttccctcaacctaatgcatatttacagtatatcaggtttcgaacctttgcactctatgcaatgaagactaagcttccacttcattaatacaagtacttttgttatattcctcattgatccataattaattctttttcgggaatatgcaaatgcaaggagcgcatctttatattaagagaaatatcaatgatccataattcctatacaactatatctcttccagaaaaggaagaaaaccagatgccactaccccctcctatacacctaactggcttattcccaccaactttacgtacaatactctggaaaatttaattaattgctaaatgtaaggaagtgaacagaatcatacagttgggtttttgcctgactgacagatcacctgcagttgctgttaggactgcacaatagcatacgcacgcaatcatagctttttattccccaataggacaataggatgaccccagagcaactactacagtgacatatgacaatggtttttctacagtgtatggtacagtttccactgtatcttccccttccatttttcttttttttttttggaatacgcaaggagcgcatcattgtattaagaagaaataaagtttacgtactccatttttcttttttgggaatacccataaggattgtgtatctttgtattatgcccttccattttgaatccagcgatgctactattactgcctagttttgcagtctggtaggggctgaacggaatctacttccttttgccttgaaaaaaactagaaaagcaagaaagataaaaaagatgctcccaagaacattgtagctgaagcagagatatatttaagcagcagatctgatccaggcatcaatgtgccaagttgagctgaggttccatgaaaagaattagagaagtttttttatatacaaaaaagaggtagaaaaggaaggctcaaatttctgtaggggcctatagtgtccatctatcagtggttcattttttgctcagagcattaatattgcccctctatcaatggcttccaaggctttttatggttgtcaattctgaatttctgattagtcacttaaagaaaggtgcaggaaacagcctggattgctatgttgtcacattctcattaaaaacaaaaacaacaactactcgtttatcaggtatctactttttcttattctaaaaaaaaactttttcatttcttacatgtaccagttgtcgtggtgaaaagtatgagatagcatgattctaaagaggagatatttcataatgcatgtctttgatcttttctttattgaagatatgttgcaatactagttcaactatgtcagactttgcaaacaaaaaaattattcgcctaccagtgaatagggatcttacatgttggaattatgtaactgtttttttcatatttttcaggattgttaattcgagcattactacaaatctagaatgaagtctgttagatgttggctctaatgcactaccatcaaatatatcaaaaagaactcgtaataatctgaggttggtgaaattctactgaagtcggcaatggttagtacttattttttcttgtaaaaaaaggtgcttggtacctttttcttttcctgaagacctcttttaagactttgctaccaatatgaaattcgtgcatttctgaactataacttggttttgtcttctctccttgcatttgttcttttcatgccatattcattctacatgtgcagtaataactttctaatttacttgtgaggtctgactgttttcactaaatctaccgtactattctgtcggtatttacttgggtggtgcttactttactgagctatctgaaaggtaactttatggtttatcaataagtaattattctcctttttcttctgatgagcatatcttcgagggccatcccaaaccttttcaagatctgtcccccgttttattttgctctgaatcaccatatcttcactttttttccccagagaactttcctctcatcatcagaaggaatctgtggttatcactcaattaacatcatcaattacgtcctagtctttttcagaaaggtgatttttctgttcattaacgcgtacaagtcaaaacccttcagccttattctgagtttctgatcacagtaactggttgcaagtgtccacggagtaatgaggaagacaggacaattgtgatgactggtagcttatgtgggaaaaatgctttctgaggacagcatgggttaagagtggactatagtcactaaagtaaaacatgattcatagcttatgtgatcacatgatttggcaccaccaggagccttaaactaagccttgttttaccagcactgtctttttgtaatggtactatccatttttgtaagcctctcttttatcaaaaaaaagaaagaagtaaaacatgatcatgaaaatgcttaaggattgtcaaaacaacaatcatcatctaactttcagaaaggtaaaagagattcattagactgataacaggtgatgaaattttactatatactttctttacttggaatacagcgtgtgacatgaatatatgtgggggcaaaaaaaataataataaaaagacaaaaatctatacacaagaagtaactaaagtagcaagtttcctgaaaggcagaaaactattgcagtcttgcagagagttcttgttgactgacacggtgacaccttaacaagtcataataccactagaagtccacagagcttcaatccttctatccacaagcaaaaggctaaagaatatcgcttcacgtcctcatcctactgctccaatcttgtttttttaaaaaaatcggaaagcaacaccggccacttcctaccgatcaagaatctccatcctcttgccacatcagggtcatctcctatccggccttttttttttgactgaaatatccggccaatttaatctttagctagctagtgtagcacaagcaaagccattactgccactgctaatgtggcttgcagcaacaacgacgtcgacgccggcgccgcgccgtcgacctcgccggtggccaagctcgccagccatgagtcgtcctccagctgcggatccttcggcctcggcgacgggtcattgctcgatttctgactgcagagatagaatgacacatgatatatatgttgatgaacaaaaagattattaaaaatgtcatcaatcaggaattcaagatgcaacctacagaagaagaatcaaggatgtttagttaatgtatgagagattagaccgtcataagacaagttaattttaccctgataaccgtgtcgcgatagtatgtgagagattccaggcttgtttttttttcccttgattttttggtgattttttgtccagttaggcatgggaagctttaagctggacagccactagcaatggcgggtgactgatgaccatacaaggtggggaaggaacaaaggcgaaggcggcaaaagaagagaggagaacaatttaaagctagctagcagagctctctctcttttctctctcacagcttatccttgtctctctctcaaccccctcactcctttctccatctcagtttgatgctccttttgtcgaaaatgcattttctaagtaatctggaagatgcccatattctccagccattatgtccgtccatgtttcagctctgggccaccgccacagctaccctcacttgatagagggaagagccctaaacttgacatttttttctccatattatgatgtatcttgcgactgttcaaccaccacaggacaaataacctatgaaaataagcctactaaagtgtatgctaggcttaacttgcctaattaaggaggtaccaaatttttacgctacaaaaatctcctatgtgagtccatacctttgaccaattgagcttgataagctgctgaagccaaggctgccatcggttggtttaatgttgatataaaccgtacgatttatgagtaatatacaaaagtaaacattttatatgtatccttaaataatttaaaacttaatatttaaaaataaactccgatgaaaaaacaacaaaaccaactctaaaactaaattttaaaatttaaattttagctgtggtctataacaaaacataggagcccaaaattcaacagtgttaatagatatttcttccgtcccagaaaaacttaacctgacacatcctaatacgataaatctagatatactctatgtccagattcatagagtatatcgtaggttgagtttttttttgggacataggcagagcacgacaatgcacacgcaaagtaaagcgaagaggtaaaaattgtaaaaaaaaaaaaagagttggccaacctgttgggattgccgggtcgaggacagaaggtgatggagtagtcggtgccggtgcaggtgaaggtcgacgtggcgtcgtcgtaggcgtagctgtacgacctagggcacgccctcttgaacatctgcgagtacaccgacgggtgacacgtgtccggattgccgtggtcgccgctgcagcagtactccggcgtgccgaacgcctcgcacgcgctccggcaagcctggccatggccggccttcagctcggcggggcaccgctggttgaggtccacgacgcacccggtcgccgggcaccccgccgccgccgcctccaccaccatgggcaggttgtacccgtccaccaggctcacgtcgtagtagtccttcccgccgccgccgccgctgcccagcgtgaactccaccagcgtcgccggcggcgtcgcccccgcgccgcggcactccacctcgccggagccgcagtcccccgtcgcgcaagtgcccttgccgtcgtcgtcgaacgtgcaccccgtccgcgcccagaacctccccgaccaccccgccggcgccgccagcgaccgcgtctcgccggcgcccagcgcgaaccccgtcgtccccagcgccgagctccccgagttcgacagcacccccggccacaccgtgccgccgcacctgttcgtgaacgtgaacgtcacgccgcccaccattaccaaccctgcacacacaccaaatccaccatgatcaacttacaaacagaacaaacccaagaaccaagaattcaattcaccattgccaatctcaataccttgaaagaatgataggatgacgaagaacacactcatgatccaagtagatcgagtgatgatccaagaagccatttgagcagcaataaattgtaaactgaaacccaattcaaatgtgcgttactgttatatgtatatatatgctggatatgcaggaaagtgatcagttatggcaagagtgaccggtatgttcttgaaattggcagtcagctaaccctaaatggcaagacggtggttagaagcttggaggaagttagatgcaagtaaactagtaatagtggccactacagcttgagtgtgcagagtggaagcaagccgagtgtaggcttgtttgcttacacacctagcctatttatacagctagcagtgacgtcagcaatgatatgcaaaatgatgataccaagaattactacttcccctctcgtttcacttattccattgccttttgttttctttgccttttcccttttatttttctctctcgaaagaaaaacaaaaaggaagaaacagagtacttgggataaaaatgccccaaatgctttcttggaaaggaatggaagaggcagcagagcatatggaggtagaagacgaccgctgccattcacgaatgatgtcttgctggtgtgtgtgggggggccttcgttggttggtccttggcccatccgatgatctgatcgatcgatccttcgttttctcggcgcattagccgctgcgaaaactttggtgatcactcgccatcatcgatcgattctttggctcgttgctgcacaatgcctctgctgcgttttgggcgtggcggtcgctcgcctttgtcgtgttttttttgcctctggtttgggccagtgttggtgtgttggaattgtcggtttgcacccgatgtccaggtaggtccatggccaatgtggccaggcaagatcgttggaagaacgaaccgaccgatgtccagcctccgtttttgctgctgctgctgctgctgctgctgctgacgatgatgatgaaaacgaagggaaacgacaggtaatgcatggtggtcaactgaaagcaagggtcaagatcacggtaccggatcgaaaaccggtaggaacgggatttccatttttcacagaaactgttggttaaccaacaaaaaaaatcagaccaattttgtttaaaaaaggtaaattttagttgaatatttttattttgagccggcttggaagtccggttttcacgaaaactagaatgttgaacgttaagattgcttcttgctgctgtatgctggactttgtggattaccagaaacactatggtgtttagagataaattgatctactcccccctaatgcttcctttccaaactactttcttattatagtggaggcctcgatctgatccaaggtgtggagattggtgagctggagttgctgataggaaagataatggagttcagtgctgggcttcgccagagtagaacaggtgtagggtagctctagattgatgtgtagtttcttttgagggactgtggaaacgtgaagagttgtgtctttctatgtctccagccgtggctattttgatgctttcgtttctgaatgtctagtagttggtttgctgatggtgctgtgtcattttggtctgtactctgctggtaagctggaatccaagcataactctgatgattagcgttcaatataagctgggtccttgtgactttttctctaaaaaacaaaactagactgttttttgttcttttagtttggatatttcagagtttttttttaaaaaaaatctgagattacacgtttcatttttaaaaattaagggtggattgttatggctgccagctgatccaatctaattcaactaaataaataataagcctagatcaatccacacatgtccctatctaaaatcggtttatcttcgtgtcagcaccgaagaatcagtttattaccaccaacaaaaaagaacgcaaaagaaaaggaatcattttctgcagaactagctattcagagatggggaaaaaaattacaggtgatcatattactgtcacaaaggccaagcacagcggtacgtatcattttcaggacgagtcggcgttgcactaatcacatcgatggtgcagtgcagtgctggatcaatcgttagattagatagatttgctgctttctgtttgtactggaggtagcagcagctgctagatactttgaacgcctctgcaattaatccaggttggccagcagcgttaacgacgacgcagcagagattgctccagcgatcgaaagctacctgcagctttccaccgtgtaatgctagctaagtaacattaaagctcatgctaagatattcagcagtgacactgcacttacctttcatgtgaaaatgatatgttcccaacctgtaattagtcgagtagttacatgaaagcaccagttcggctctgtcggttacaaccagcttcagttaactgagatctaacagttaccttatgcagggagaaaaatctcttacatatagtgatatggatgataatgtggggattgtctgatccgaaggtcctctgccggagtagtggtgttatcggcaccgaagaagagaggagctcagttagggatcttggcacggatctgacagtggagaaatctttctcaatttttcagtcaaatgccacttagcaaatctggataatgtttcagttttgagctaaaataagatgttctgtgaaacattgttagattgatgaaatatttattggttacagtgggattttcttttccattattttgactcctacatgcaacaagaataatgttttcagatagacatgtgccagctaaataagtttagttgaatcatacgtaggtagctggtaggatcagggcataaccataatgctggtgactctacacaccactttgatcaaatccagaagaccagattaaactatatgtgcaatgctcgatctttgcataacctacgaatggacattttctttttaacaaaggtaacaatcaatcttgcagagtttcaggtatccattccatccaactaacttgacgcccattagttccagtcgtttacttactttctctgatcaatcactgcacagcaaatggcaaacggggaggagtgttcgatcgatcagaacgatttgattttcttcaggcagaagcaaaaggaagaaacagaacgacgaagaacaatcggcgcacaacctcggcagtacacaatgctgctgctgctgctgctgctgccgtgtaaagcgtacaagatgatctacacttatatcggataagagatcaggctagttctttcttcttcttcttttttcaaaacc

SEQ ID NO: 66620 - DNA, 7151 bp, Oryza sativa
  unsure (1)..(7151): unsure at all n locations
acgacctccaaacagtcaaacagtcatctgctgttgctttgacggatgatacgaatcaatccctgtgttcttggatgcatatgcatggcatatggcacaggagagaagggattaaaggctagcccttacactgtttcgctgcttttgtgtgcttgctttttctgaatgtttttttcttgccagccttgccactgtttcgcttgaccttgcacagttgcacgtagctgaagtcaatgggcaatgttggccaagtgccgttgaggtggagtccatgcggcgccaagtcatctcgactccgacgtgactgccgttcatcggttcatgtgcaaatttctctcttttgtactctttcttaaaaaaaaaaccaactctatagattttttttacataaaggattatcaaacctggcctctacagcttcgtgaggtgtacacagccaaataatcaaattcagagaatgtatgttcaaatttatttttagaattagatttttttaacaaaaggaatactttaagagtcaattttttctaatagccgaatgattttatgataactgttaaatgtacaaaagaatggatgaactatgacaattaaaaaatggatttgaaatagttgtttaagaatcgtatatgaaagtattttttatatataagaattgtatcgcttaagggcctgttcagattgccaaaaatttggcaagatagcgatattgttaaaattttggcaggatttcttatgtatttactaaatttggtaacaaagtaaacgtagatatttttttggcaactttaccaaaaaagtgatatgattgaaaatggtatcaaagtgaataagccctaaaagctgagaaagcttgctgctgaatggaattccattcctcagaaagaacacgcccgagaagggcaccaaacgactcaaatgttaagcaactgagaaaacggcggtatacgtgcccccgtacgtacacgtacgtatatacatacaaccctgtgtcattgcactaggtatattgatggtgatctcatccggcgacggctgcgtcatgtcaatgccatgtcaagcaaagggaaacgatgaaattaaagaagtcaagttgcaatattgctaaagaaaaggaagagtacactgtacacaggtgcattgcattgcatggaccggctgctggaaaaagatggggaagatttggggcactcttttcgccgagatataaagcgaccgatcgattcacgtctgccatgtcggcattgcacattgcctgccgctttgcacgtacgcatatataagccaatttcatttctagctgctgctgccgccgtcgtggtggggcctacgggctcgtcaccatgttaattttagttatctgcactatatctccttttactatttcctgcactttgacatggatttgtgacggccggagataatcttagttattagtagattctaggagtaatcggcaaaggctacgactactcgccagctgagtgcgttgcgttctctgcccctctctctctctctctctctctctctctcgcactatcactgattcatattataagtcgttttgacttttttcttagctatatttttttaagtttaatcattttttttaaatataacaatattttgaacacaaaacagatgtattatcaaaatatattaaatattagttttaataaaagtactattgtgttctttacattgctaacttttcataaacttgattaaaatttaaaaaattgaaaaaaaataaaagcaacttataatataaaacggagggagtgcaacttactcttcctaccttttaatcatctgtcatcaacggtgtttccagtatttggtaaaagtagctttggtagtgatagaagtgttctgttatctcggcaaggaggcggatcaggcgaaggtagatcccgtcggcggcagaggcntagaagtctaagaggcagaggaggattccgacgtcggtggcggccctatgggcgacggagacctaggaatccggtggagcggaagcggatccttttaactcgcgtctggtcggttagttttgattggacgatgacggatgaaggtgggcttaccggcggagcgtggcatcaactcacttgaagcaagtggatgaagatgacactagcggagttttgtagcaacaacgcactagggacggcgtcagctagacgacctccactcgtcgaatatggccgtttcagtagaggatgttaagaagtaaggatgtattgagatagtaggtttttcttttttttttctttttttttgtgtgttctcctcttcaatgtggtgtgagcctaagtgctcttgtatcatttggctgtgtatatcccttgtggatatagagaccgggttaataaaaatccattatcagaaaagaaaaaaagaagttatctgtttcctgttataccatgttcaaaatggatagactttgaactgttttattcattgtaggtccataaaactggctctaaaacagtaagcacattggaacccatttacacatgggcctttacagggacaccagctcaaattgtcatggaataagtctgttatttctccctcatatcttgctcctgattgaatcgtaccctcaaccgcaaaaccggatataatgtctcctctatcttaaaaaccggtgcaaatcgactccttcgatgatttggaaagcggtttctaccgacgtgacaggttgactgtgattgactcattgagttagcaagtggaacccacgtgtcaacgacttccacctcatctcatcttctgccatgccgtcgcagccgtggatggccaccacgggatgggggaggcaaaatagacttaagcctattgtcatacatttgagccaagtatcttgatatcctgtactcctgttgtactaccagactactgcaccagagggaaaggatcaaaggaatcagcatctgcagtctgcactgcaatgaagtaatgcagcgatgcatgctgaagttgatcagttcatcagatggaccatgccatgcaccagagtggtccaaactctgcctgcccaaccttttcagttttcaccatgcattcagattattcagagtcagccatgcgactatagtactacagtagtacgtgcccacaactgctgccgctataaaatcacaacgagaccggaaagaccctgacgttgcaactgtaccaacaactggcactgctcgagacaagcagtaaccaacaagatccatcgtgaaaggattcagagtttcagacatcgagcccagataatcagaacagatgatagtttgattcagaattcgtgaagaccatggatttgattcagcagcattcaggatttagatttctgaagagtgaagtgaagaccatgcctgacgtgtacgtacaaaataaggaaacgctcatgtgatcgactcaccgacccatctgcatacactcgttgtcccatgccctaacccacctgcttctgttctgcaattctctaatctcaaaaaaaaaaatgtttggttgccgccctgctttttttaatgaacttgatagtgcagtaataaggggtgtgtggttttaaccccaaggtttcgtatttaatcctcaacaccctcataatttcttttaaaaaaaatgttcgcaggacgtctcttccttcaaatttagggaaaaaatgtcacaggtttggttgctgcaatgtggatactacgggtgtgtttagttcgcgaaaataaattttttgggtgtcacatcatatgtttgaccggatattggaaggggttttagacaccaatgaaaaaactaatttcataactcgcctggaaaccgcaagatgaatttattaaagcctaattaatccgtcattagcacatgtgagttactgtagcactttatggctaatcatggactaattaaacttaaaagattcgtctcgcgattttcaaacaaattgtgcaattaatttttttatctatatttaatgctccatgcatgtgtcaaattaagattcgatgtgaactttttggaaaaaaaaagttaggaacttgacctaggctgtgttggaagtttggttgaaattggaacgatgtgacgaaaaagtttgaagtttgtgtgtgtaggaaagttttgatgtgatagaaaagttagaagttgaaaaaaaaattggaaattaacttttttttgtgacaggagaccaattaattacttcatcttcccaattaatcaaccaagtttttgtactagatgcggctgccattcaccgatccatggtgattgataatctatacaattcgcgaatcgcaatacggcccgaggtcaaaatgtcgggccggccggcacatggcgccatggcggatcagcacggctggccggcacgaggtgtgctccggcggatgacggcggcggcggcgatctctaccacggcagccagtggcggccgcgggcggtgcagagccacgcgagcacggcggcggccgcttggccggcgacggggaggggactgggcgccgtcagcgaggcgctgctcgacgcgtcgtagtagccgccgttgccgccgccgccgcggttgaggaaggagaccgtgtcgttgatgagaggcagccccgtccccgacgccgacggattcgtggcgccgccgcccaccgacgacttgaggctggatatcataccagagttagctttctaacgcagggttggttgatcactcattaggtttttatcacgaacacggaaaaatattacacaccaatatattagaagaaagtaataaacacaaagtaatcgacaatcggccagaagaccgttgctgagggcaagaacaaaaaggaggctaattgcacggctatggcttatacgtgtatgactttctatggcgagcatattcaacgaggcaaattatctactctctccgttttataatacaagtcgtttcatttatcaagtttataaaataaatatagtaacatttaacgaaactaattagatattgtagattttactagcttttttaaaaattttgatcaaacctaaagttttttattattttctaattaaatcaacttattataatatataaaaaaggagaaagtagttgcttgtaacttaatcagtcggcacaagacgttaataaagcctgcaattaatcatcttcaacgtagtcacgtacattggatcatgcatgatcattgaccaaccatccaacccacgttcttgtcaaatgatttgatggttggcagtggcacatgatactgcatttgatcaggctcactgaaatctgaatcgacgattcatctgttcggcttaattacctggagatgatagggcagaagacgacgaggtaactggcggtgccggaggcgcaggtgaatgtggacgtggcgtcgtcgtaggcgtagctgtaggcgcgcgggcacgcgttcttgaagaactgcgagtacgccgacggccggcacgtcgccggcgtgccgaacgcgccgttgcagcagtactccggcgtgccgaacgcctcgcacgcgctcctgcaggcgatgccggcgccgtcggcgccggcgaccttcaggtcggcggggcacggcccgttcaggtcgacgaggcaccccgtcgcgccgcacgccgcgccgccgccctggggaaccaccaccatcggcaggttggagccgtccacgaggctgacgtcgtagaagtcgttcccgccggcgccgtcgagggtgaactccgccagcgtcgcgggcggcgccgcgccgccgccgccgcactccagggcgcccgacccgcagtcgcccgtggcgcacgcgaacctgctggacccgcccgggtcggcgccgcagagcgtccgcccccagacgcggcccgaccacgccgccggcgcgtccacggcgagcgactcccccggcgccagcgcgaaccccgtcgtggccagcggcggcgacccggcgctcgacaggagccccggccacaccgtgtacgcgcacgagtttgtcagcgtgaacgtcgtgcacaatgcccctgcaacaacagcaacaacagcagcagcaacaatctcatcagaacacagctactaccacattgcacagctgatcaccaatgcaagtacgtacttgagagtgagatgagtaggagagtgacggggaggagacggcgagccgtcgccattgccggttgcagcaagctagcagcaagatggatcaaaaaaaggaaaaaacgaaacgagtgtatgtttcttgatggattcttgtggagttttcgtggtagcgatgcgattgcgcgtaatcaagcaccggggtttataagttataagagactgagagcgcttgcttggagcctcgtgatggccggtgctgtgcgcctgtccgcaggtcaacatgttatgctggctcaacgttcgagtttgcaaagaggagcggccaatcagaggctgacacgtggtgaaaccgcgagatttaaccctggtatgaagcgacagctgaaaagacttttcgtgtacgagaatgctacctagcgatcgatcgctagggatcgctaggagcgatcagatttctgattccctcccttcacctgattttcttttttggcaccacattatttttctattttagtaaatttatacacctaaagtttgtacacctcaagtttacacatctccacaaattttttttaaaaaaacaaaaagttagaaaaatttatgtatagaaatactatatataaaaaaattgaattcaaattcaaattcaaatttgaatcgggtatgtaaacttttaacttataaactttgggtctttagatgtatagaaatactatatatagaaaatatttgaattcaaattcaaatttgaatcggatataattcaaattcaaatttaaaacgggtctataaactttagatgtataaactttagatgcataaaaatactatatatataaaatatttgaattcaaattcaaatttgaaacgggtatgtaaacttttgacttataaactttgggtctataaacaactttaggtgtataaactttagatgtatagaaatactatatataaaaaatatttgaattcaaattcaaatttgaatcggatatataaacttttgactaataaacttttagtctctaaatttaattgtgtaaacatgaggtgtataaactttaggtgtataaatttactaaaatag

SEQ ID NO: 66621 - DNA, 21996 bp, Oryza sativa
atttggaataggtccctgcttttttttggagcggcgggtactactactacttggggttggggtgcgcgtcgcgtgagctggtggggagagccagcagagccgaggacggcagcagcagcagcagcagcaggcaagcaaaccgcccgcctcgtctcggtgcgtgcgggcgtttcggtcgcttccgcgcgcgatatctgcggtgttttttgggctgggtgcggggggagtcaatggacggtgtggggggtggttggcacggacggaggctgtgcaggctggattggatagttgtagcggcgacttggcgaggggaggggggagcaactgctacgctggttaggtgcggcaccacgtggatgaactcgttttgtatggagccgtgatgtccgtgccggtgatgtgcggttgctggcactctctcctgttttatggggacgtgtaggggccttttggggggggggggggtccaggcacgttccctaccaccatttttgaaaatggaaatgttaattatagagaaaagaaatgatcaaatgaggttgagactacggtagtgttgaaatgattcttatattgtgtgtgaaatatagtcgcatctattaaaacggaagcaaaagttaaatatgtttccttaaaacatcacgcataatataatgcgacatttcatatgtagagcgacatttcatatgtagagcaataaaaaaaaatatgacaatagtataatcctaggaagccatagccaggtagaaaactatagccacacgacacgtctatcaccaaaaaccgcgcgctactaataagatatgaacacgacatcataaaggaaaaagaatcttctaaacagcaccttctacaatatcaagagtgctgccgcgcctatcgtggtttttacctagagcattccatcaaatagtaggaaagatcactcgaattatctatcagagggcaatatctagaaaatgaggctgcagccaagtggacacaacgaggagagtgcagttgtaacggagtaacagacttgttggtcatcccagcactccaattggcttctgatacctccttgtttgctcccaagcacccatcaaggaatggtgacatagtggcgtttgatactgttccttaatcacacacaaaaaaagactcatttcttggacgtatggtcatggacaccacctaaactgccaccatcccggatagcaaggaataccaacaagctgcacaacttcaggggtagcagagcaacatcgttgtcatcgcgcccaattgcaagcttttcttcacggcaaaagaatgcaagtgtcgctttgccagtgtcgtcgtctcgtgcaccaaccgaacagaacgaacacgatatgggaaaaagaaaggcctcaacatggtggtacagcttgtagaaaatgatttttaggctattgttctacaccaaaaatgctcgcaatttttccctcacgaaacaaaagtgctcgcaattttcctagtgttagatcctactggtgttagatcatgtgctcacgcagctgttggtttataacttttttgacttcttgagaagaagaagaaaaaacagctgtttgatttgttcgtgtggtccactttggtgttacaaacttgcaattagtgcgagaatcaggcgacttaacagcaaacggattctgcgtttccaactaaattaaactactgaagtaacccgttatttgctgtctggaagcgagcttgaaatggtcttcatgccaagttgccaacctggtcaatgcagctaaagaaaaatggttactcacatactagtacattgctcccgttcttttctgtaagaagattaagattaagattttcgtaatatattttttaaactgctaaacggtgtgtttcgtgtgaaaactttctatatgaaagttgctctaacatagtaacatatcatattaatctgtttttcaactttgtaataattaaaactcaatcaatcatactttgataccatctcgttttacgtaaaaaacttaacctccatctctcattttcaggagaaaagaacaccaccattgttcgacaggtagtagaatcgcagaatggacttggtcagttgaagatctcctcgctcacatgccactcaccggctgaccaagtagtggtagcctgtcagccacgcacgcgcgcagctgatcgattcctcttgacactgaaccggcggcgccggtgaagatgatggcagcagtagcaaatgtagcagggacagaaatgctaccagggaatcatccaatgttcaggtactgtgggtgtttgatccctgtgaaccgaagaacagctgggagaagaaagttcaggaaatggagaagacgacgagcgatcatatcaatctgtggtcttgcttggttgtttgctgcggcggtggagaagacgacattgccatagcagatgactgaactgtgtgtctgcatagctgaactgctgaaaaaaaataaaagaaattatcggctacagtttctagatgctctcctcatcttgttggttatcggtcgcaaccaaaatttttacttaacttaagagttaattttagtttttttttaatatcgtagtatattttcactcttgaaatttaaaccatcaaggaaatgtaaaagtttcagttttgcttataaattattttttcttccttcatttctctatggcttctactacctttgtcccaatttaagtgcaattataagttttcgtgtttaacgtttggccgcctgttttatttgaaaaaatcatgaaaaaaaataaaaaaaagccacacatgaagtattattcatgttttatcatctaatataaataaaaattaactaatcatggaaaaaatttcaaataagatgcaatacaaaactacacactttttgggatggaggtagtactacctaaaaagggaaatgtaaatatcatagtttaaagggttaattggatccatgccattataattttcacggttttgaaatatgccattactattcacctatttgtaaccataccattataatttcccaagtattggagatatgcctctacataccctttcaatgcattttctaattatttaggaccaaaatacccttgtcttcttccttcctcatccctcctcatcttctcaacgagtctctccttttttttcgccgggctggcaaaacttgccggccaaagtatattaagaaagaaagcgagaatgtatattatttcctaacgccccaagaacagaactccgggagcaaaaaagcagagaaaaagctactaaaaatccctccttaaacagggccgccccaactacagatcactctattggaatcaaccccgcagctgtccaggtctcccattcatccatgatggtcacacatagattgacaggggagcttgctttcccttcaaacacacgcgcattgcgctctttccaaatcaaccaagtcaccaaaatgacacccgcatcaaatacctttctctctttcttagcaacaatcttacgagcatcacaccactaggaggagagatcagcagacggcgttgtttgaaggagaccaaggcgacctctgacaaggccccaaacctcctgagtaaaggaacagctactaaagatgtggtggcatgactcgccgctgattgagcagaggtggcaaattggggcaagatgccagcccctgcgttgaaggttgtcggcagtaaggcaagcgctcttcatcgcacaaaacataaagaatttgcatcgttccgacgcccgggatttccagatgatcttgccaagagcgcagcgagaccgtcccgtggacaaaagtgaataagccgatttgacggagaaagttcccttagagtctggacaccacctcaactcatcgcgcaccccatgatccagctgcactagtgctagaagatcccaaagcgcgaagaactccaggagggcctggacagacaggccgccccgaacgtctcctacccaagaattctcgtgcagcccttccgccaccgattttgtcttgttgcgaacataggagaagagcataagggaacgatttgcgattgagccccctcccgagagccagctatcagtctagaaggatgtttgttcaccattgcccagttgcaccatgcagccagccgcaaagcagtgcgccacttttttgtctattggctacacaaaattaacccagggcctcttaggctagacacggcagagccatggccagcgagttctcaaggcgacgcccatgagacgcaggtccttaatgccgagacccccgttctcgattggtagacagagtttatcccaggccaccaggctgcagctgcccgctgcgttttcatcccctttccataggaagccgcgacatttcttctcaatttccttgattgcccaaactggtagctccagcacagacatgaagtataacggcaacaccatcaacacatgcttgatgattgcgagccgagcgtctagagcgaggagcttcggcttccaactagccagactcttagcaagacgatccatcattggctgcaggtccgcttttcccagcttgcgcactgaaagaggaagtccaagatagacgatggggagcaaccgcaccgggcaccccagcacttcagtcacagccgcaagttgttcgtccgagcaatgtatgggcgtgatggaactttcgcgaagttcgagaccaaaccagttgcatccctcataaacctgagcaaagtgagaatggtcgaagcatcctgagtcgaaggatggaagaaaacgatggcatcatctgcgtatagcaaagcacgcagaggaaacacgccaccagcaagaggcgacagcgcgcccctattggcagcggtagcacacaaagcggcaaaggtctccatgaccagcacaaagagcagcggcgataaagggtcgccctgccttaaacctctcgccaacctgatcctttgtgtgtcacgcccattgatacatacagtagtcgacgaggagacgagaagcacggcaatacagtcgtgccatttaactccaaaaccgagatggcgaaggagctcaagcaggaattcccaggacaccgtgtcgaacgcctttgcaatgtcgagcttgagtaggatagcagggcatttcgcacggtgaagcctctgcactaccccctggacataaaggaaattctcctagatcctcctcatcttgataaaggccgactgagccgggccaacgagatcgcctatgcgagcagcaagcctagtggccaagactttagtgaacagcttgatgaaactgtggattagactaattggcctatagtcggccagctgcattgggtcttccttcttggggagcaagataatggacgccgtgttgagaaggtgaaggtgttgcgagttcgcgttcaacaccaggttcagcgccgccaccacatcctccttcacaatttcccaacatctcttgtagaaggctgcgccgaacccatccggccccggtgcgcggtcactcagcatttctagcatgactttcttggcttcatcctccaaaatctcaatttccagctcagagagatcaagggtagggagaccaaggcgtcctaggtcgagcgccaccattggtggcgagggcgagcccataatttcgaggaagtagtcatgagccatagccaatttgtcctcctctgtcaccccccaaactccgccttgctgcagcacaggaattgtcttctttcttcttctcgcgttgatcttcaagtagaagaattgggaggctgtcccactgtgcttgagatatcgcaggcgtgcccgctgccgcagccgaatgcgctccagcgccgcgagcgccaaacaccggcctttgagtgccgcacgcaaagaacgctcctcgtgggacagcagacgcaagtccatagcaccgtctagtcttagaattatctcatgcgccatcgcaagttgcaaacgcaactcgctaatacgacgctcaccccatgacttcagcgccatcgccgtcgctcgtagcttgaagtggagggaacttagggcgtttgaaccagctggcaccacatcccacgccgaccggaccacctcctcgaagccttccagatgaagccagaaagcttcaaacttgaagcgtcgcgatctgtgcaccatcgcctcacaagccagcagaagggggcaatggtcagaggccgacgagctgagcgcctgcagatgtgcgtcacggaagaagtcctcccaatcagcattcatcaagactttattgatcttggtaatggttggtcgttcttgctcactactccatgtgtagcgtcggccgaacaagtagagctcacggagctccaaagtgttcaacagacccctgaaccgattaatcaagcctctattgacattgccattgttcttgtccgactctgctgccaggaggttgaaatcacccacaatgcaccaggccccctgcacgcactgttgccccacccaggttagctcctccaggaactgaattttctgctcggtctcctggggtccatagacatttgtcaacgtccatgacgcacccccttccagattggtcacacacagcgagagcgaccatacccctttatgaagacaactcatattgaaacgatcactgcgccaggcagtgaacaacccccctctagttccctcagcagggatgaactcaaaaccatctaaaaaagagccacaagattgaacaacaagctgtcgatcaagcacggccagctttgactcttgacaacaaaagatagaagcgcgggaggatctaaccatctccgctacaagaggccttttaccagcattattcaggcctctgactttccacaccaaaagagaacacgacattgaaacaggggcttcaaagcgcaagcggagaaacagggcttcagcaaacctcgacgctctgaggagacgacagcctgacgttgcacagtgccgccaaggcttgcacatgggccggcacaagaggggacttgaagagctccaagtatttgaggatgtcagtgtcttccaccttgctctcgtcttcaaccaccctgagcttcttcatgagcacacgctgggctttggacaccgagtgctggtgtcgcccgccattaatggcggccagcctttcgctgcgtcttggagtgtgggagtatggctcaatccgccgtttggatcgagctggtgtcgcctgcggacgcgtgccgatgatcgccgctggctggggtgccacaaggtcacccagcgatggaactgcctcacccggagagagagacgcggcggccgctgggaacgcagcgctgggaagcgccagggagccatcaatgacctgcgaggtccgctccgagtgggccagggaaagcggcacccctggcgagccgtcctgagtaaggcccaaagcggcccgatgggtaggccacttgcggcctgaggttgggaggaggtggcgtttgcggtagactatttgtgggctggcgacgtgcacctcgggccacggcccaagaaccatctccagcgcccctgtagaaaggggaaccgattcccgctcaccgggcggattgaacgtgaggttcgcgccctccacaactgccagcggcgccacagccggaagaggtggcgacgatgtaaatgccactgaactcagcaaatctctggcgggttcttcgaaggatatttgcctggcaagccccacacccagggactcccttacatgtgggtccaccactagttttgctggcgctgatgctgggcgagttaatgagcccggccccatcacgaccgtctcgatggagatcagcacctcgtttggtgacgcgtgctcgaccggtgctcccaagatggtgaccgtttcaggcccttccggtgcgagcatcggtgacgagaccacgtcggagatgacatccacctccaaaccgccgagggccgtgcccggcggggatcccagagatgccaaggacgccatcgcttccggtgtgtgctcgggcggagagcccaaggcggaggccggctccatctcgactggcgttggctccggcggggaaagaaccacctgaacggaatcgcaaggacgatccagaactgctcccgagatatccgtcgacggtgccgacggtgtgacggctagcaaatgcggccccctagacgtggctcaaggggccgctgtcgttggagacccccagccgttcccgacctcggccccgcgaaacaatgaccaccgcccagaggctaaccgggccggtgccatcgatcctgccgaggaaggtgccgtaggcgcacctgcgcagagcctcgcgatcgtcgttgtaggggtcatcgggggggctgtccagcagctgctgaactgggtcaaccacttccaggacatggatcagcaggtcaaacgagaggcacctcttctctatcgggggcgccggcggtgtctgcgagactagcggctcgtgtatgtcagggtcctccatcaccggcggcatccaccattcttgcatcggctccggaatgtcgagggtgaattccttgggaattttggacgggtccaccgaccaggccagcacctccgtcatgcatgcgtcgactggcaagaacagttcgatgaactggcagtcaatcttgttgaggaactgcttgatggcttcaaactccaatgcatgcgctgggagcccctccacggccagcttgacgacaaacaggagcttggacctccgagcatgaactgagcggtgccaatgacggaaggagatcgacgccccctccacgctgaacctgccggaccaccccaggacggatgcgcagtcctcctcacgccgaaaggagatgaggaagtccgagggcctggtgacctcgatgcgaacatcttccgagggaaccctgcagcgacgccccaaagctgcgaccaccatcgccggcgagacctcccttctcccggacagcaccgacgtgaccagcgcacgcttcctcatctgctgctcaatcgcggccatcccaggggtccaggacaggactccacggcccccctgcggccgcaagaggggggtctccagctccaatgtcttcctccatcggcttggtactgacggacttaaccggggcgggcgggggcaacgcagtagggggtagcgccgtcttgctatgcaccggctgaggatgctccttgtcacctgggacagaagcgctggtgctggcggccaaatgctggggacgcttgggcgccgcagccgccggcactttccgaggaagggtggcgtcgatgtcgaccttgcagttgcgctcgatatgacctggataccagcaacgatagcaagttgggggttgactgcaggaagccttaaggtgccccagacctaggcagcgaaagcatctgccgtggagccaacgcggaatcggacggggctccggcggagtaaatgcggtggttggccgaccggcagcagaagagcctttactcctgcgcctcaccacacgccaccccgcgtcgacttcctcctgcgacagggacggacgaggagcaggcggggaccagacgacatccgcccaagatgcagcagaaagcgcaggggccttatctgggcaacggccatcggagcgagcggccgccggacgaggagttggtaggtggttggtcgccgaggctctcgcactctctcttatctctctgtcaccaccgagtctctccttttcaccgatctgtacaccggtgggctttgcctgctggtctcatctagctctaccagcgatggtgtcatgcagtgattctttcagcatgttcctgttcaagagggccaacagtgttgttgatgaatctgcaaaggtgatgcagaggaccattttttgtcctcatggcgtctgatctggtggaaattggaatggggaaggtgagggagcgatgatgccaacatgtatggcccggcgaggtggcccaagcggcgcgatgcaagcttgctgcaggtagctcgttggctggaagatgacaaacggggaaaggaagaagaagggggatgaatgaagaagacatgggtattttagtcctaaaatattagaaaatgcattgaaagggtatgtagtggcatatttttaacacttgataaattacaatggtatggttaaaaataggtgaatactaatggcatatttcaaaaccgtaaaaattattagggttaattggatccatgccactacagcgttgccaaattgaaaaaataccactactattcgtcatatcggctgggtgccactgtaattttgagaaattggatccataccactcagttgcgtttttcatccactcctgttgacgccgtctctccgcgtccgaggaccaaggacacctgctgaaaaaaatcagagaggaaaacaaaggaaaaggaaaaaaaatgaaatagctgctacggccgtgtttaagccccgtttagttcccaaaaagtttttcccaaaaacatcacatcgaatttttggacacatgcatagagcattaaatatagattaaaagaaaaactaattgcacagttagggaggaaatcgcaagacgaatctttttaggctaattagtccatgattagccacaagtgctacagtaatccacatttgctaatggcggagtaattaggctcaaaagattcgtctcgcggtttccaggcgagttatgaaattagttttttcatttgtgtctaaaaaccccttccgacattcggttaaacgtccgatgtgacattcaaaaattttcatttcgcgaactaaacatgccctgtttcccccctatttccaactttccgtcacatcatatcacatcaaaaactttcctacacatatagggtgtgtttggttgggcttttcaacctgcttttgcttttgcaaaagccaaaagccaaccaaagggctcaaaagccacagctgcttttacccaaagccagcttttggtgtagtacaaatcaaaagcagccctcccccatgctttcagctgcttttgggggaaaaaaattacccaccactgccattacacaaaaacaaattgcgtgttccttttcttttctcccatcggcatcgctcctccttctcactttgccgtcgccgccgctcctccgcgccccaccgccgccgctcctcctcgccgagacgctgccgtcgtcgctcctcctcgccgagacgccgccaccgcagctcctcctcgccgacacgccgccgccgccgccacccctctcgtcgcctccgctcctccttgccccgtcgccgccgcacctcctcgctgagatgccaccgctgccgctcctcctcaacgagccgccgtcgccgccgccgccgctgccgccgcccctctcgtcccgcgccggcccagatccgccgacgaggaggtgagggaggagaaagaggagtacgaaggggaggaggaggagatggacggcgaggtgccggtgtccccgccgcccgccgtcgaggccgactccaccgccgcccgcgtctacctcccctccggcgccaccaccgctgccaccgaggccgatgacgccgtgcgcactgccgctccccgccgccgctcgaggccgacgacgccaccgaggcctactccgccgcccaacccgacgccggcgccactcttgcccttccccgaccggcgccgcccgacgccgtccccgcccatccctaaccgacgccggccaacccgacgccagcgccgctcccgtcctttcccgaccggcgcctcctcctcccggcgccgccgccccttcgttcgccggccgtggaggaggcgcgtcctccttgccgagccgccgccgccgccgaggccgatgacgccgccgccgctgccatctccatctctccccttattttctttcgacgagtgtatggcatgtggggcccgcttgtcagcgggactagttatttcaaaagccacagctgttgaaccaaacgagctttttcaaaagccacagtccatatttcacagctacttttcaaaaagccacagcccacagctactttttcaaaagccacagctcaaccaaacacaccctcaactttttttccaaactctcaaatttctttaaccttccaactttttttaggaactaaacacacctacgatgagcagccagcatgtagtggcgttgccatccatgagcaccgcccgagcagactacccatcaacgactgctggccatcccatccgtccctgatcgcacagagctcgctggtcatcaccatcacgtcttatagaaccgcttctgcttcttggacggtgaacgccgggttggggaacatcaccatcttcttggcccatggccagttcctggggaaaaaccagattcgcagataccgatggccgctcgagcgacgaggagggcttgaacaggatgcgggactgttgttgcttgctccgtcgcttgggcgtccacgacggcattgcgcgccgccgctacttgccattgcggacctcgcgcgcgcggacgcctccgcgccggtgacaaggaggagcaggagaaggcgccggtgccgcccgtcgccgtcgccaagctatccagccgcggaagcgcccgccacctccagccaaggcgccggaagccccaccggaaaccaagcccaagatttctccggcgccgagctccctcgccgtcgccgccaccaagctccttcgtcgccgccgccaagctcccggatgaggatgaaaatggagacgctgtgagagatgagatggaaaaagtgacgggagtgccatggttctgatttttgaaattttcaagggttaattagatccatgccattaaaattttgcctgttttgaaatataccattaatatttgcgtatttgtaatgatgctattgctacttgtttctaatcttagtggtgccactgagatacgtattttgcatgtattggacaaaaatgccctcatcttctacctctctccctcttccccatcttctaccctctctatcttctcactgcgccgccatcccgccgccgcgtgctgcagcagcggggcgcgcgctgcagcttgctccaccgctgtgtcgctgctgctgccaccgcagctgctgcgccgccgcgcgccgccgctgcagctgctgccgtcgagccacatcgcgccgccgccgctgccgccaccgagccgcgtcgctccgccaccgctgcaactactgccgccgagccacgtcgcgccgccgccgctgctgtgccgccgcgccgccgtcgccgcgtcgcgtcgctccagccgccgccgtcgagccgtgtcgcccctgagaaggaagagaggagggaagagaaaggggaagaaggaagaagggggaaaggggtagtttggtccaattttatctgaaaatacatccaaggggtaagtggtatcttttggatatgtgtgaaattataatgacatatttccaaatacatgaataccttttaataacatgtatctaattaacccaatttccaacggcacccagctgatatgacgaatagtagtggtatttttttaatttgtcgaagttgcagtagtatgatccaattaaaccaaattataatggcatagatctgtgcacaaatgaaggagtgacagatcttagccttggtttttccatcggacggtgggcgtgaggcgtgagtggtggtgcgcctgtccgccccgggcagtcgcctctcgccggcggcgggcttggacggccggagataggccgcaaactcgcgaaggcgcctccgtcgcggcggcagaagcgggtggcgtcctgtcggtggtcggcgtccgggtggggggttgggggaaccctcgcggtcgcggcggcggggatggtgaagatagtgacgtacaacgtgaacgggctgcggccgcgggtggcgcagcatggctcgctccgccgcctcctcgacgccctcgacgccgacatcatctgcttccaggtccgctcaatcgctcaccccctgcctccccaccgcactccgcagcactggccgatgcctcgcaatctcatcatgtatataaaccctagctgtttgatggggtactacttcagtgattcactcactgtaggtcaccacaaatgatgtaatcgatcgcactgttatgttcagcaatacgcaaatgtgctaaattagcattgtgttgccatagccgcttgatttcatagagattcagaacgcgtaccgtttgtttatttatctctgaactgataaatgagcattgttctgtggtggaagctgcacatttgctgttaaatgtttagtcacgccaacacgtgcagtttctgtatgaactatgaagtaagttaagcccgcgattcagcagagctgactaaattaatgtgatgtatttcaggagacaaaattgtcgaggcaggacttgtcgggggatgtcatcatggctgagggatacgaggcttttatttcatgcaatcgttcatcgaaagggcgtggagcttactctggtgagtttttctggagattaaccaggaaatacccatcgactgatttggggtgggggtcttttagcaacgcactattagttgaagttgcttttcaatcattcaatctattggttaatttactttgaatgttgtgtcacgaagtgtaagtttctgtacttaactctattgtaggtgttgccacgttttgccgggtaacatcagccttttccagtcaagaggttgctttaccagtagcagctgaggaaggctttactggattgcaagagactgcaaagaacagtgaaactattggggattttgttcttgtaactcctgtggaagaggaaggtcttggtgaagtaacaaaagaagagctgctcaaggtggacaatgaaggacgttgtgtaattacagatcatggacattttggttggtctcttgttctgtccccttgaaatatagacagcataagtagcattcagcatgttgatgtttattcgttgcacatttgatttcttctctttatttgatgatatttactgcaccatttctgcagttctttttaatatatatggcccagctgttgaagaagatgatatagaacgagttcgctttaagctactattttacaagatactacaggtacttcatgtgcatctcagtcagtcagtaaattttggaggaatagtttcacgattgattgatttctgccaatgataatagcttgtttacttactctgattttatttctttttagtgcaaaatgtgcacccctcctgtgtcttccttaaataactgttaatagcttagttaaaggactgttatttatactgtcttcatctcatatcttctagagaagatgggaacatttgttggctcttgggaaaagagttttcgttgttggtgatttgaatattgcaccttcttcaatagataggtgtgatgcccaacctggattcgagaagcaaacgtaagctcatttccttttcctttttagtaagatttacttggaccgttttggaatctcaagtcaaagttttgctgaacttgcatgattttaagacatgaaaataaactgaataacctcagcactattactaaatatatcaattcgtttcataggaaaattccatttaacatgatctggtgatacttttctctgtaagaacaatctgctgttgagggctgtcaaggtcagtgaggcaacatcatatgagaagcaaaactttagcatttcaagtgaagttccatgcacaggccacgtgaacttagagctgcttctgctttcacctataatgacgtaatgcatcttgcagcactaaggctgaaagttcagtagaaattgttgataagtgaagcttgaaattttttgaacttgaccttccacttgtgatgagttcgctagtctgatgatgtgcttgataatacatcaatcatttattttatcctctctttagagtactctaacatgaagccacttgggaatgacaaattacttcattaccctttccctaattcaaggtttcggaaatggttgagatccatgctgagagaacatggaggtccattttttgatgctttccgatcaaaacaccctgaaaggtattgaaagctctctttctttgttccatgcttgtgtgcttatccaacctattttagtttttgttataattccagttactccatgcctacagggtaggtgtgtatttccctgttaatgttaatcaattttttctgaaacttaagacctactctgtatgcggcccattattgaggcttagaaagcatgccttgaatttgttaaatggaacaaatatttatcttttctctttataagattaacaactatagcagacacagaattacttgctaaccatgtaccttgatattctaaccttgctgctttttcttatgcagagtgggagcttatacctgttttaatcaaaaagttggagctgaagtatacaattatggttctagaattgatcacattctcatttctggtgcctgcttccatcactgcggttctgtggatgaccacagcatctttccctgccatgtggaagaatgtgaaattatggatcatttcagaagagggaatagcgaaaatatgtcaatgtatagaatggtcgaaagttttctttgcaggatttgcagtgacacattagaattatttactatattacattgtccacaggtggaaaggagggagaagtagtaagctagaaggatcagatcatattccagtttatattgtgctgaatgagatacctgaacttccagttcataacactccttcatcagctgctagatatcttcctgaaatccgtggacggcaacagagcataggtgagcaaccttttgtgttcctacttaagtaatataggcttttaatgtttattatagcattatagcatataacttgtgaaggcagccgctcctggccttatttgatagtttagttatgagtacatacttgcgtgcatattgaagtaatactgtttgtgtgcgcattatgctgaccaattgtattttccaacatgcagtatcattcctaaggaaaggcatgatttatgaacataaagatgccatgtccatggatagagcagatgaaagctgctgtggtggtggcttggaaaggaaagctatatataaggaagaaccaccaactgatatagccaaattttccaaaggtaacgaccttcatagtgtcatcaagcggaaaattcgtgatcaattgttaaatgaaggttcaagtggcaactcccataatagcactgcagcattactggcaacacaaagtagaaaagcttccttttcttgcagcaaggctgtgtccaacaagaaaaacaaacataacttgtcttcccaacctacgatcaagtcattttttcaacaaccaaagtcaaagccaggagatagcagtaccaatagcatagttactccaccagatactttgcatggtatggatgaattacatgatccaaagaatgactgtctgccagaaagcatccagtgtacaactccagcaaccgaagatcagggtaactcagatgtaccctgctcgctttcaacagataaatgcaatgaagcaacactggagtggcaaagaatacagcagagaatgaagatgaccctaccactttgcaaaggacaccatgaaccttgcattccaaggtctgtgaagaaaggctctaatattggtcgcctattctatgtctgtgcccgtgctcaggtatttaacttcagaatcaactgctcaattcacatccgaggaacaatcataaaggtagttcatattgacagaggatgaaaagcattggcattgtgctgtaaccaccatgtattgtctatgacagggacctgcatcaaaccaagaagcaaattgtggtcactttcagtgggccactgttaagtctaaagagaaacgccggtgactaatttctcttttatcgcataggtgtaacactcactgtaagtatttacttccatactgtacgtggtggtgctattattgggcaattttatttgtttaagtgctaacttctgtttttttccccaagtagcctggacatgtgtgtgtcacttgtttctatacacatgaaatgctgatgttcttctcgggagcaagctggtatttgagtcagcaactcggcattaatctctagttatgcattacgcaggtacataatttaattttgtgtttaatttagatggctaccatggcctcctttgttgtttacatatgttatattgtttggtcaaatgccaccttgtagctttctcgtagttttgttttctcgggtttggctagcttatgtttgcaactacccttggatgtattaattgaaaaactagctgagaagcatgaaaagaaatcaagtgaagtaaattgtgtactagcagtatattgttctgttcccactatgagaattaggcacttgaatcgtgtttctgttttctaaaaaaatgtggcctcactgagcataatttgtggcattttgttgctggtcaatttttgcccttgcacgtttgcacctatgttgttctgagctctttgggtaacacgggtctatatttgagacttgagaggatctttgggcctcttgccgatttggcccttgaggatatggctcgaaatcgaatattgtagggcattatgctagtccatgccctcatggaaagcatgatatacttgctcttacttgaataacataacaccaagcaaccaactatcgttgcatgattcatagggtttttttattatgtacgcccaacgagcatctcgtttggagcaactgaaatggatattgaattgcttctgaaacgaagcaccggctttcagttgaacttctgcaagcttcagttaacttgaaatccagttctgttctaggttaaaaataaaacacgcttaattgcagaacatgttgaaaggcttgaagctcatgtggctcaccgtgcattgtccttcgttttcgtccttttaagagcaatcgatggatggagaaaacgtacaaatccacgtgttacatggtgaataccggatagggatcgttcctattcagctagtactatattattggagagtttactataggcagctgaccgagggaaccttgacagcaaagctcccatttgtctgtagtgtgattcccgtggtaatttatcttgcaacctgaacctaaaatagaaaagtatcatgtgtaaaagatgctaattgagatgcccttggacttagagactcatcacatcctgattctattgtacagcctgccagtagaccacaataccacatggctattgcaagtttgtaacactttcacctttctctgctagtaggtgcttctgctgctgcatctctgcaatcaatcaatctatggcttgtaaatctgaatcaattaaaagctccaaccttttcccccgacatgccattccatgagcgcctggaaccttcatcttcaattcaccatgacatgttgacattataatacggcatccaaccatacaacgcaacaccatatatgacccacctcactcacctatcattgtcctcgtggcccctttcccctcactatcccgccataaaaaccatcactccctatgagtaaagaactccaaaaacgttcttgtccttagaaaaaaaaatcttgtttggccagccacacctaacgccagttcaaccaagaactcggctttgcctctgttcctccttccgagtcccaatcggaatagatcgatatcatctcctctcatctcatcttaattatctctcccatgtgtccctagacatatagtccatgcactaatcgatcgatatatctatatagttttcgagagatattttgctggttgcaattagtctcgagcttacagcgaccttccaggtcagaggtagccggattaaatccttggtttatttatagtgcttgatcgatcatgtcgtcttcctccaatagcgactccggcaagaagggcggcaaccctctggaagccatgggcgccttcttctcgtcgcaggtgaaccgccggaagctggtcaccagcgagaagcaggcgctggccacgcggctgtccgccggcggcgaggcgttccccggcagcgagcaccggccggccgaccggaagacgtggatggcggagctcgggccggagcggctgcgcgtgcaccagctggtgtggccggggacgcacgactcggcgacgaacaagatcggcatcccgttcgtgacgcgccccttcgcgcagtgccagtcgctgtcggtgtacgagcagctcgccgcgggcgcccgcgtcatcgacgtgcgcgtccaggaggagcggcgcgtctgccacggcgtgctcgcaacctactcagtcgacgtcgtgctcgacgacgtgaggaggttcctcggcgaaacggcgtcggaggtggtgatcctcgaggtgcgcaccgagttcggccacgacgacccgccggagttcggcaggtacctggtggagcagctcggcgagcacctgatcccgcaggacgaggcggtgttccacaagaccatcgccgagctcctcccgcggcggctcatctgcgtgtggaagccgcgcaagtcgccggcgcccaagcccggcgagccgctgtggagcgccggctacctcagggacaactggatcgacaccgacctgccggagaccaagttcgagagcaacgtcaagttcctcggcgagcagccgccggtggccgaccggaggttcttctaccgggtggagaacacggtgacgccgcaggccgacaacccggtgctctgcgtccggccggtcacgcggcggatccacggctacgcccgcctcttcatcgccgaggtcttcgccaagggcctcggcgacaagctgcaggtgttctccaccgacttcatcgacggcgacttcgtcgacgcctgcgccggcgtcaccaaggcccgcgtcgacggcgccgcgtgagattgcatggccgggccctgtagtaattagaggggtcgccgcgtttagaggatttgcttcgtttcgccggtgtcgcagcgtacgtacagattagtttgtgttgttcgtgttagacacgtgatttatgaatgatttattatcatgcatgtgttgggcgttcgtgtgtgatttaattgttgaaatgtatatagtggtgaaattgctcgtgtacaaaggaataatcgcaaagtgctcgttttgttgtgatcgttcgtaacgagggtaatggagaggatcaaattggtatttgattgtgttccctctatttctttttgtgcgttagatgaatgaattaattcgttaatgttacttcgagttggagacggttttgaattatttatgtttaccagtaacttatatgaacctgcgttataatagagcttcatgtgaaccatgaaaatggatagttttcctttttaccgctaagatcatgtgacttaacagaaaatcttaataactcattgtaccgcgtttcgaaaaaagaatatcaatcagcaatgaattgataaaacgggagggttttatctcgcttattggactataagccccaattgtcctaatcaacaaatcaattgaaactgtttttaaagtagaaatcaaagagtacacatgctctctttatccatggtgaccgcgacatgtcaactaacacgactgaatccaaaataaaataaaaaaaatacaggtcagcactatctgaatttgctgggattccagaaggtccagttacatagcctacaatagcccacttatttctgaaggcttcagttctgtttacttgggccgacactatgtacaggccttgcttgtgtctattcacatgggcctcagactaactaatcatgcaataagttcatctaagatcccttaacttgtcaacaaatctgattttcgtccctcaaccagaaaaccatacacaacgggtccctcaactattaaaaccggtgcagatgaggtccctcagcggttttggatgacgtggagcctacgtggttaatttaactcggtcttcatctgacgtggcgctgatgtggcgcttacgttgcaattcaatccggaaaaataataaaactcgtgggacccacatgtcagtttcacacataaattaataaaaatggtggggcccacgtgggccccacatgtcattctcacccctcttct

SEQ ID NO: 66622 - DNA, 14659 bp, Oryza sativa
tgggcgtaagaggaaggggcggtgggagttggccctagctgcggcagacggcaggacaggagctgcacaaccgaggccccgccggcgccgactccttcttgatgtcgccggcgccgccaaggctgaggaggtggacgcggtggtggtggaggaggaggaggaccgcggcgcggcgcggttccatgagcggaggctggtggtggtgtttgtgctgccatcccagccgatgtgcgccacgtgctggcggtggtggtccgccgcgccgccaccctcgccgccgccgcctagacacgcacacagcatcactaataccaaactcctaaatcaccccacaaaaaacaatcgacaagatcgagcagaagtgaagaataagcatccaagactccaaacaacgaaccttggggcttcttgccgctcttgccgcctccatcgacgacgtccacgctggatccattgcggcaggtggaggagaagaggatcacgatgaaccggtccatccgccgctgctccttgccactattgctcatggctagctagccactgctagctaagctgatactatcttggaatcaaatcgcttgccgctttggctgaacctgtactggtatgggggtcttgacccttgctcaaaaaaaaaatcttggaatcaaatcaatgtctgctcctcgccggcgtgcgctgcgatagcggccagatgctgagggacgggagcagcacctccgcggccttggcgactggtgccgcgggagcggcggcggagcctctctccgcggccgatgcatgctggctcccctcggcagcggcggcggctctgggggcgtcctccgccatggctgcgggtaagtgggagagggagggatctatggcgtggagagaggagagaccgagagagagaaaagaagctccgccgccccttcctcttccgcccacagccgccggagccatgcctccgctgccgcgccgctccctcctctcccgccggccgccatgccccactgcctctccgttgcgcctggagagaggatatgggagagagatggagggaaatggggagagagagaggaggaagaagagggatgagaatgacaagtgggcccactttttttttattattttgtgtgtggaattgacatgtgggtcccatgggttttattattttttccggatcaaattgctcgacgtaggtgccacgtcagccaaaaccgcctccaaaaccgccgagtgacgttatctgcaccggttttgatagctgagagacccgttgtgtctggttttttggttgagggacgaaaatcggattcgttgataagttaagggacctcagatgaacttattccactaatcatcgactgcatggacatgggcttggaagaaaagttgggcttacagaacataggcccggttggtttcttctcacgtgcagtgctgagtgctctagccagctcggaaggtttggcgtactgctggattgcatggtgcgaaacgatatgaatttttgttggccttggcaacccaaattcagcgggcgcgttgctgtagagtgtagagttgtattgcacggttcaaatccatcgaacgtctgtattccggagataatgcctatcgacagctttgtgcagatggagaccagttggcaacagaaagacaaatttgcactggagtagtaaccagtacacaccgaactgcatgcacgccaaattgtccaggcttcttcgttcacacgattcttcgttcacgaacgcaataataaccatggagtacaagctcggatgtgttggtaatgctacgtgtttcaaatcaaaggcctgctgtagttttcaattttttttttctaaaaacatcacatcaaatctttaaacacatgcatcgagcattaaatatagataaaaacataaactaattatacagtttgcataaaaatcacgagatgaatcttttaagcctaattagttcatgattagccataaatgctacagtaatccacatttgctaattacggtttaattaggctcaaaagattcgtctcgcggttttcagatgaattgtaaaattaaattttttattcgtatccgaaaaccccatccaaaaattttcttttcgcgggtagtgttcgatcgccccatgcgatttccctgagatttccagagtcaccacatttaggaaccgagatacactgacagtgatgcgatcgaaaaaaaaaattcaacgcagaattgcaatgcacagcgctgggctggctgctacctctccccaacctacctagagatgcacgcaccgtattactccccccagcccagcacgcagattggttacctcctcgacgcctcgcgtcggctgacgcctgacagctagccaccatccagccagccaacgcgacttcgcgggcgattgcgcattcgcggcgcggcctcgcgcacggaagaaacagcccaaacaaacagctagtatctcgcccatctccccgcgtccgcgtgcacgctgcggcgtacgtcgcgtgcgcacacgggaatttcccttccgctacacaggcgcgacgacgaattgaagcatccgcgcggtccacttccccgtttgttgcttcccccacctggccatgcacgcgtgccgcgtacggtgcgcgcgcgcgctacagcctcgttaaaacccgcgtcgttctcacacacacttccaccatctccatcagtgtgcaccaccacgagagcggtggctatgcagccatgcgggcgccgtctcctcggcgccggcaccgcctcgccgccgccgctgccgggcttgggttcggcttcggcccactcgatggaccgcgcgcagcgggcgcacatggtgcgggcgctgggggtgaccaccacggtgctcttcgtcgccagcgtctcctacatcgcgctcaccgcgctctacgcctgcttctgcgacggcggcgggcggcgacggcgagaagacggcgggtcgtcgtcggtgcgccccgagccgtccgaggagaccaagcgcgcgctcgacgggatcccggtgcacgtggtccagatgccgccccgcgacggcggcggcggcggcgccgacgaggagggcggcagcggcgactgcgcggtgtgcctggcggagtacgccgccggggacgaggtgcgcgtgctgccggcgtgcgggcatgggttccacagggagtgcgtcgaccggtggctgctcacgcgcgcgcccacctgccccgtctgccgcgcacccgtcgtcgcgcgcgtcgagggcccggacgacgacgccaaggaggattactgcggcgacggcgagagcgtcgagaggcacggcggcggcggcggcgacattggcttcctgtccgtcgccggcgagtcccgcgtgcttcctgcgatttgattttgctacgagtactcatcagctgtaatagggtacttagtaggtgtttagctcaattttgctagctgtggacaaacgtagcttagtaggatgattcgagtttgtttattggcgagagcaataacgatcatacgagtagtttcactttcagggttacaagttcatgtgcgatcaatctggttatttagttattataccttcttaaaatttctgacctgaatttgtaggaagtactgtagtatgcttgttttgcttcatactcctagctagtaaccactgattgttatggttttcagcaatctgcaatcatcgtcagagtctcagacattcagacatcagtcacctgcacaagaaatctttcgtacatacaccgtcgtcagcctacaacaaagtagaaaaatttgcagagagaaatcagtggcagagaatgttaacaatgtttaggtctgtgatttgcagacaaacaacgtgcggtcgagaaccaagcggatggagtccagcacatcatcggtcgacattcctcacaactgaattagcttagctagctactgtaggacaccgttcgttacttcagcatcaaattcagcaacagtgcaacaccttgtagaattcagaaaatatgacctgtctgttgtttttttttttaaaaggaacatctgttggtttgataaaacttgaggattttcatttcattaacagggatatacatagtacatttgcaagaacacaaaacattattataatccctacttacactctggcaacaacaacaatgtcacacaaattgtctttctacgaacatgacatgctttcttgctacaaatttgacaaatcactgacaaggaaagaaacaccataaaaatcttcaagaaagggggtaaaatttagaagccaaatccaagtgcaatcagtagagaaaccaagccggaggtgacgacgacggcggcgtgcgctcctcttggccgctcgccggagctgtcctccaatggctgccccgcgccgttcagcacctggtgctgtccaaacgcgccctgctgctgcccctgccccccgatcgggagcccccccgccgccgcgccatggccagcgctcggcgccagcgcgtccggcaccgcggcggcctccggcggcggcgacgctcccagtggcaggtggtgcggcgaaccgtgctgctgcggcatgccgccgccggcgggcgcagcaggcgggagtgctatgccacctggtgcgccggaaggtgtcttgccgtgcggcaatggcggggagagagcaggcacgtcgacgggtggcaatggcgtgtgaggaacaaatgccgtcggagccggcggtggcgacgagtacagcggctggtcaggagagacagggtacgtgtcggccggcggtggtggtggcagcggcaagtccggcgtggcgggtgtcgcgtcagctggcggcggcggcagcaatggctggtcaggcatagtgtcaaccggtggctggtcgggcgaggcgggcagcgacgtgtcaaccggtggcgcgagctggtctccgaaagacaggtccgagctcccggcgccggcgagggtcgacgccggcggcgtcagaagcttcgctgtggttgtggtcgacggcggcgggagcacgtccatcgtcggcgacggcgagaccggcgcggccgcgccgcactgctgccccgtccacggctcgccgctcgcctgccacaccgacacgccgtccttgctcacgatcctcatgtcgccgccgtcgtcaaggctcagcgttcccggctcggcgtcgatcccggtgtcccagagagagtgcccgccggcgaagagctcgagccccaccggcgagaacgccaggtcgcacgcgtcggcgccgccgacaagggtgcactccgactcccacacgctgccaccaccgccggcgccgccgccagcctgctggatttggacgtagcacgcgtcggcgcccgggccaccggcggagctgtccacggcgcggcggaggtacgcggcgtacgacccagacggcgaggtgaggaaaggctgcgcgctctggccgacgtccacggcgggcgcgacggtggcgatcacctgctgctcggtggttcttgatatgtagcttttgggagaggcggccatggcggcggcgagccgcatcacgagcaggaggacagcaagtgaagaagacatggtgaaaatggtggtgaggtgtgaggagcttggcaatggagggggtagggttttaatggaggcaagaggaggatttggtgcagcttttttgtggagcaactctcaggtgtagtggtagtaggagaaaggtgtgcattgcatggagatggatggagtagagggaatctgaagttttaatccaagattaattagcccaagtttcagttagagattgtagtgtagttggggtcatttggtcatgttcatttgttcaacagatccaacaggttgcattaggtggaatgcagccaaactttttcagtctgtactctgtctaacactctaattcaggataactttgttaataggtattgataccttcccaaaaaataaatggaaaactactggttatatcagttcaaaagggacgtactactactactcaagttatgtattgtgattttcttcgcatttcagaagagtagaatgtccatgaacagttaaatgagaaaaaaaagacagcgtgcactaaatcacatatcatcgaaatgtgaatacactataactaaacacatgcgtaagctatttgaaaccatacacatctcaagagaagataatctgaaatgcaatctcccatactcccacgcaaacggatatccaaaacgagtatgaaaacattcacagctagttgatttgaacattagttcagttacatggaattggcgttccacaaaatggtaaaaagcatacagttagagtgtgaattctttccaaacactaatgatctttggcacaaccgtacaattactgtaataactgttgcagaaatccaaagtagaaacatgcgcaggttcaaggctctcaatttctgctgtatattattatgatttttaatctccatggatcgtgtaacgctcccacttcttggtaggatcatagatctgcaagacaggctagttgttactccaaagaatatctatgccttgtacaagaatgaaaggataaaaaggtgaatgtccaacctcccatcttgatgcaggaaatatatgtttgtttttctcataccagtgtctctctacgacttttcccgcatgagactacagtcataaagcatgaggtagaaacttagaatgcaacattgggaactacaaatacaagatatcggtagacatgttacctcgtccttttcttttgttgcatcagcaatggtccgcacatcctcatgaacatcaaagtggaaaagctgagaaagaaaggacagaaaaacaagtgtcagcaaatgattaactcaggtcatcaatattcgtctggacaaacagaaaaatatcctgtccgcagaagaaccgaagttctatgttgtgacatccatgtcttaaaataaagtgattatacatatgaatgaattatatataagctatcaacatattttatcaaaacaaataccacaggagtactaacaaatcatgcattaccggtccactcttgccccttgctttgttgataatcaactcatagaagctatgttgctgttaccaaaacaacaaacatgggattaaaataagagtaaaaaaatacataaacaacaatgcaattgacaaggtaacaaacataagctttgcatacatgagggataataagatcttccttcacataaagaagattctcaactgatgttgtccgcacttcacggaactcaggggcaagctgctgctgaacagcccttaggaattctccaatggagtcacctttacggacctgccaggtatataggtgttgtttcaatcatatggtccacatgttcagaacaatcaaaagaggaacacctttttcaatggttagaaattacctggataactctcctatgcccagtgccatcccagtaactgtaagtaattgtcagaggttcatctgacacacgaggcattttgctaatcagttaggatgcaaaaattactcacaagggaaaaatagagtgaaatgattaaacactaatggtaattaatgctataagcttgtggcaatacttttaatcagttcctgctcacgcgaccattgtttcttcaaacgctctcgctctgcttgttcctctgcttctctctccctgatggatcattcttagcaaccagcttgcaggttaaacaacacatggaaacaaataatcgatcatcacagaaagataatcataaactaaaagaatacctgtcaggaagaaaacttgtctcaacagtagggtccttcccaagtttgacaggaccatgtttcttttgaggttcttctgtaaaacaatttaaagcataatgtccatacttgctttacaggtaaggtaacttcacaaacttaaacaaatcaagattcaggacacacacacaaaaaaaggacagtacaaacacaaaccccatggcactaaactgccaattcataacgtaaacaatagagagagaatgttcattctgaatgaaaccctgcccaggacccaatctttgcttagatgctttgactaaattagtttgtcgagttgattcatttaagggacgtcacatgagatgttcaaacattaacaaaaaagttagaacatggtaatacaaaataggatatcacaagaccctagaaaggttaagaggaccatacgattctcaaattcatcctcatcacttccattctcaatctcatcacagaaagataaccgtggatctcccctcactctcctctttttccgcttttgcatttgcaattcttcttccctgaaaacaaaaaataaataaactattttgatatacacatataaggtaatggcacaaattatgatagactaggactccaatctcactcttgttgcaacttttgaagcttctccttctcttcttcctcaattttggtccgtatattaaccctctgttcagccacatggatgaaacattagatggtgaaaattcactttttgacagaatggtaagaaatatatctggatattaccttctcgacatactgctcccttgtaactaaaccgactgtttccttcttaaacgcagtctcaagaatctgaaagtcatagtccatactgttaggtgttagcttctaaaacacagataaaaaatatataaatttctgttgtgcctttagaaaatgagataattcagaaccatgccaattgtgaagcatatatggggggaaatgttttttcttttaagtttaaaagacaaaatataacagaagtggttcaatacaaaagctattctgcagcaaatcacatagctgtagcaatccaacatagaactacagaagtatagataacatccacatcctaatcaaattaaacaagagagataagacaagtatcgaccaagagtattacaaatgacaatttcacatcacaccaccagagaacaagcgcttaaaaacctaggatgacaagtacaacaaaatatgtgaaggcatggtaagaaaaatgtaaggacaaccagttctagtgagagacaaactagtttcgcgagtgcacgcgcacacaaatacggagatcagtagtaggtcactgagcctcacgggcaagcgaattttcctacctacgcgtgtgccctagaaggtagaagcctagtccgattcatatgatggcggatggccatacctcggaggtgctggagccgaactggagcaggccgggctggccatcggaggacttgttcttgagctcctcgatcttgcggcgctccgcctcccgctgcttctccagccgccggatcttcacggcgtcctgagccgtgccgacgtacccgtccccgaaccccgacatctcgtcacccccgccgctcttcctcggtcagacgagggattccagagattccagagaaactcgcagccgacgcgcggccgccgcggaaggtggagacggcaaccggcggtgggattgctcgccgccgccgagagcggaaggaatagggatttggggagggggaaactgctcgctgccctcgcgcttacttgggctgggccttaccgacttacaatttgagggagtattagcttagttgggaagttgggccacgtttcatagaggcccactagacaagtgcggcccgatggatagtctgccctcgagctgccgttttcctattaattatttttttttaaaaaaaaggaaaatgatacatagaaagttcttacagacttttcataaacatgatatgtcattgatgttgcatgttactacatccgtcccaaaatatagtaacttttggttataaatctggacacacaattgtctagattcataggtaaaaatgcttacattttggagtatttatatcttgatactctattttataactactgactaaatgaaacgaacttttttttggctgaatcaattcttagtaagattttgagaaaacaaagttttagtacaactcagcaagtcagaaacaatgttactgaaagtcttagacacttgagatttttgttgcaagagttttgtaaaaaaaaagaagaagaagaaggtacagtacgtagtaatgctggaagaaaaacacttttttttataatggaagaaagacgaagaaattaaacaaacaaggtttttatatgaccaaaccaaacaagttttaaattgctataaattgttgaaaaccaaacaaatcatgatgttacacaagcatgattcgaccgagaataaatgaaacccaacataagtttgggactttaacacaaacaactccagaaacatagttcgacgacccatgcaagaattgcatgcacaacaacatcaatggagcaaagctccctaaggctcacagagccacacgccgagtcaggaaacgacatggctaaattattcgttgaaacggaaatgatgcagacgaaatcttcggcaccaaatggattgacgacgaacaatccagcttcttgatgattaagcttgcttcttcttcatcccacctccacgcttcttgctaccgccacctgagctccccggagcatctgcaacacgcacgatcgagacggcaaaaactgcgttaggattgcacatttgtacacggtgatcacgagcaaaaccaagcacgatcgattaattacctgccggcggcggtggctgctgggcgcgagaggcggcggcggtcttactcttgtccatcctgttcttgcgacgctccctggcctccagctccaccctgtcgcggccaccacctgccaccgcaaacatgggtccaccagttctcctgctgctgccgatcatctcccatggcatatcgtcgaccgtagcctcgatcgcgcggcgctgcacgaggtactcctcgaacgcccccgccggcgcggcgggcaccagtcgcgcccgcgctggcccagtcggtggacgaaccagcaccggccaggaaggcagcccggacggcagcgccggaggcgcggctggggcggcggcagcagcagcaggaggagtaggcgcgcgcggcgtagcagcagcaggtggagaagtgggcgctcgccgcgcacgaagatgaggagcaggcaagcgcagtgaaagaggagcggtgggcgcgcacggcatagcatacgacaagctcacgccaccatagctgaagctgtagcggccgatggtcgttggcatggtccacccacgaggtgcagcaggaggaggagtagccacgggcggcgcacgaagatgaggagcaggtgcgtggagtgcaagaggagcagtggacgcgcgcggcgcagcggacgacgagctcgcgccgctgtcgctgaagctgtagcgggcggtggtcggtgacacggtccacccgcgcggtgcagcaacaggaggagctggtgcggatgacgcacgaggatggggaacagatacacgcagtgcacgaagatgaggcgcaagcgcgcgcagtgcaagaggagcactgggcatgcgcggcacagtagatggcgagcttgcgctgtcgggcggcgtagcaacaggaggagcaatcatgggcggcgcagtagcaggaggagcagtcacgggcggcgtatgaactgaaggggcaggcgagggcagcgtagaaactggaggagcaggcgcgggtggcgtaggaacaggaggagcaggcatgtgccgcacacgaagatgaggtgctggtgagcgcagtgcaagagaagtagtgggcacatgtggcgtactagatgacgagctcactccatcatagtcgaaactgtaccgggcggtggtcagtgacacaataaacccaggcggcacatcagcaggaggagcaggcgcatgtggcgtaggaacaggaggggcgggcacgaacggtgtaggaacagtaggagcggacgcgcgtgacacatgaagatgaggtgcaagcgcgcgcagtgcaagagaagtagtgtgcatgcgtggcgtagcagacaacaagcttgctccatcgtagccgaagctggggcgggtggtggtcggtgagacagtaaacctgggtggcacatcagcaggaggaccaggtgcgggcggcgtaggaacaagacgggtaggcgtgggcggcataggaacaggagttgcaggcgcgggtggtgtaggagcaggaggagcaagcgtgcgcggcgcacgaagatgaggtgcaggcgcgcgtagtgcaagagaaatagtgcgcatgcgtggcgtagcaaacgacgagctcgctccatcatagccgaggctgtggcaggtggtggtcggtgacacagtaaacccgggcggcacatcagcaggaggagcaggagtggcaggcgtgggcggcgtaggaacatgaaaggtaggcgcgggtggcgtaggagcaggaggagcaagcgtgcacgatggcgcacgaagatgaggtgcaggcgcgcgtagtgaaagagaagtagagcgcacgcgtggcatagtagacgacgagctcgctccatcatagccgaagttgtggcagatggtggtcgatgacacagtaaacctgggtggcacatcggcaggaggagtaggcgcgggcggtgtaggaacaggaggagcaggcgcgggcggcataggaacatgagttgcaagcgcgggtggcgtaggaacagggggagcaagcccgcacggcgcacgaagatgaggtggcgcgcgcagtgcaagagaagcagtgggcgcacgcggcatagcagacgacgagctcgctccaccgtagctgaagctatagcgggcagtggtcggtgacactgtcaacccgaccagcgcaacagtagaaggagtaggcacgggcagtgcaggaacataaggagtagtctcgggcggtgcagaatgagcaatgggtgtgagcggcgcagcagtcgacgagctcgcaccaccatcgccgaagcggtcgttgtcggtggtcggtgatacggtccacccaccgtgtggcacaacaagatgaggagcaggcgcgggcggtgcaggaacaagaggagcaggtacagacggcacgacaagaagaagaagaggagtaggcccccgcgtgatagtaggagcagcgggcgcagtagaggatgagctcgcaccgccgtaaccatagccaaagcggtagcggccggtgcccgacgacacggtccacctgcacgggggcacaggccacacgaatgtggtggcgatgggcgtcatcgacggccccgcgggccggcgcgcggtgaaactaaggacgggcggtggcggtgcaggcacttgtgattcttcggaagtgaagctggtgtcaatgatgtggtagctctcgccgtcagggaggagtgacgggacgatgcggctccagggattgcggctgggcaggcgcctctaggccgggatggcgtgttgggtcggaggctgctgggctgccgccccgccaccaccgccgagaagccggtcctggctggcaaggcgaatgggccggatcgccatggcagcggcgatggcgtaggggatgatgaggtggcgaggtggaaggccttgacgggccgggctctcgttggcatctccttgctgggccgggttctcgttggcgtctcccatggtaggcaggtcaggtcggcggatttcaccaccttcctccgttcgaatcttgcagacaaaacctgtgtggggaaaaaaattgaaaaaatggcattggcgatggcaccacacaaaacatacatgaacctgcaaaaacctgtaataaatcgctagaatttcacagagatctgataatcacaagcttacaagaacgtctaaacctcctgtaaaccaccaagtcccatgtagatctgattagaaaaagcttacaacaaagtctagatctttagatggtggatttcaggatttcaaaagcaagaaacaagtttttttctctctctactctacggtattcaaagctatgtacttctaagaacagaaactagattagaatttgtgacaagcgagagggaacttacctctctccaatctacggtattcaaagctatgtacttttaagaacagaaaacatattagaatttgtgacaagcgagaaggaacttacctctctacaaatctacggtatgcaaagctatgtacttctaagaacagaaaccagattagaatttgtgagaaaaacaagagggaacttaccaggttgcaggaagcttatttcttcatgtatctgatttccttcaatctgtgtgtagtttttacagaatgggggcttagttttatagtcaaatttcagtgcttcaccctgtctttgtgaacgcgttctatacactgtctcttgtttctttctaaacataaccaattctttatctgtgtgaaatatgttgcaccggtacaaaaaactactccaagcaaaaggaaatgttttatagtatatcacaattgtatcctctaaaataggtgagatatattgagatatgaacacagatgtttcaactttagccgaatctcagtggtactgatatattgagacatgaacacagatgttttttgaaacccaaaaaaaaaggtatgaacacggaaagtgactgccaaccagtacagctgcatccaaccgcccactgctactactgatttggccataataacattactaccaaatatacaaatcttcctggacttatttggtggagcatttatttcagaacatatctggcatcagcaactaattcatatctaagtatggaggttctcatttatttttacagatatatgaggaggtatatatctgtaaaaatat

SEQ ID NO: 66623 - DNA, 1308 bp, Oryza sativa
tccaccaattaagtccaggaagatttgtatatttcagaagtctaggaatatatatatatatatatatatatatatatagtaaatttgtttggtgctccatggtgcccgggcactattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatatatataattagttaggtatgtaatcatggattgtgaaataaagttaaatttgagttgttttgttgataagtataggtatgaatcaaattattataactaggtatatactcacaatttgaaaattttgaaaaatttgagtaattttgtgcattagataccatggtgcccgggcaccatggtgccccatataagtgtcctatatatatatatatatatatatatatatatatatatatatatatatatatatatatatatatatatatatatatatatatatatacccttatatttcagaagtctttgatagagtaaactaaatgtgtgaaattcagctatcgacaatgtcaactctatcttagacttctaaaatataagggtatagatatctcctagtataaatcaagagatataaacctacgccactcaaagacttgagaaaaactcaaaaaaatataaattaatttctaatcatgtactacccatgtagtattagttttggcacttcgagctcccttcatagagggatctctctcaaggaatgaggtgtatatgtctttctaaaaatgggagaaaacctcataagtatatccaagtataagggtggcaattgagtttatatgtttaaatctcagcatgaagatctacgagattcggccgaaatggaaatttatacaactagcttccatgcgaggacatgacctgacatgtttgacagaataattatgatttactagaaagaaatttccttgcttggagtagttctcgctatcgttgcaacttatttacacggataaaatagtgtttgtgttcaaaaagaaagaagaaacaatgcataggactcgtttacctagatacatgggcttagggttatcattgagaaccgacgggagaagctttgcaaaagcacagtcccgggagtggccttggggccaagtatgccatcctctcaatgcgtggtcatttccttagtagcccaaagtgcgagagtggattctaagctctagaggacatcccctcatcattcacatgtc

SEQ ID NO: 66624 - DNA, 1648 bp, Oryza sativa
agtggacagacctgagaaccaacttataatatagataagcggataacccagcgcacttataacctagatctagtggtcggtgcgtgcggaagacaaggccatcatccatgtacaagaaggaaaatacagccccacataggatcgtatggatgtcaaatcaaccatgtaagaacatatcatgccacacatggggaagaatgataccttggttgccatcctaacatcatcaactgagatctagtgggtgatgcatggggaagacgggctcatcatccatgtgcgagaaggaaaagctagccccgcccaagatcatgtggattccaaataagcaaagtaagaacacatcatgccgagataaggaagaatgataccttggccgccaacatagatcgactagctgatgagtggggaagatgagccgccatccttgcacggggaaggaaaactggatcctgtacgaggaaggggagcgacatcagcaaccacctaaacgttgtccgcgcaaaggccccagtcccaaatcctagatctaggcaaccaacaactagggaaggcactgtagaatgtagcgttaggtagcgacgatggcaacgattggcttgatggtgttggaaggacggcgattcgctctcttgatgtcatattggtgctagaagaacgaatgtgagcaccagatctaggggaatgaaagttaggtagagtgcggcggaggggtggtggtggatggaggggaagaagtggcatcttctacccattttagggtttagcaatggatttatataggcagggatggtacattagctttggcccaattaggcccaatagacggggatggtaaaatggttggttgttggctttcatttgttaaacgtccccgtccccagtggcaaataaaaattgtcaaacccaaacccaatagtgacatttggatggacagtggaaagaggaagggatattatggcatataaagtggtggtttaagataggataggatatactttaccattccaatgttcaaatacatatggtttggtatagagataaaatatttattggacgaaaatacccttcctgactatctggttgtggcaatcacacgacatttttgtcatcgccacccattccgacctaaactcaccttccccaatattggttggaaatgaaccgtccatatcctgttcttatatccacttcttttcccaatcacctaaaaaacatggaaatgatttcttttcaagaaacatcaatgtatcaaaattttcctctggttccaattatcaccttttttttttcattgatttcctttctcatcgagactcacttttctcaatatactttaagggtctttgaagcacaatattcaggaaatggatgaatagaaaacaaattacaagaattggaggatggcataacatatgaaaaatatagaaacaaccatttaaatagactataggaaaggaatcggataagaaaggtagactcgggaaaaaaaatgaagttaaagcttttgctaacttttcttcaaaatctacatgcatttactcgtcattgcttaaaaatttcattgaatttggaaatgcccaatcctctgtttcaatgagccgaataggaaaagttcctacatgatttaaatcttatataactcatg

SEQ ID NO: 66625 - DNA, 14546 bp, Oryza sativa
  unsure (1)..(14546): unsure at all n locations
aaaaaggctcaagaaaagaaaaggttaaaaaacttctcttggttattttgtgttaaaggttatttgagaaagagtgataaatgcaataggtctatgtgtttagtgtttattcttcaacctatgtgcttgttaagatgttgcattataaatcatatgaaatcatgaattttgattgttgattcaagcttaattgtaaaatctttggttcatggttatactttaatacatgcttgttttgttatagatgggtttatcttctttttattgcaacacatgacttgatatgctatatgtatgctaagctcttgaacattaataaacataattcctatgcttgatgaaatcattgtcaaaagggggagaagtaatgtgaaatttttggattttttggagtagcaaagtgaatttttgagaagagcatgttgttggttcaattgggaatttctttcttttaaaaagggggagaagttttcttttcgatttttgagcacgatgtgtacatttgtacgaagtgtgctttttaccaccaaatatcaaaacatttttatgagtttgccaatgtgttcatcaagggggagattgtaaaatcaaaggtgtttttgattattattctgtgatgaacaattgggcattggacattattggttttgtatttggaattaatcacgaagtggttttggagatgattggttttcacaggtgaaatctgcggcattaacattttatgtggaccggtcagaccgggctctggtagccggtcagaccggcgtgtatcgcgcggtcagaccggcgcgacccgcggtctgaccggccgacactgtgttggtttcggtttcgggttgtttatttggatatccgagtttattccatgattatgacttctagatggatactatacgtatgtaatactattgtttgctgctaatgagtcaagttggagatagcttggtctcggaatatggtttctttgtttgttccatgtgtaggtgactcgatgtctcgagaaagtatttgcggtgatggacagggagtcggcttggggataagacgacgtccttggtggtcagagatcatgcgggatacttaggctagagttgatgcacgtggttgatggagtttccatatggcatacgatggagttattgtgtgagtatgggatgcggagtcgaatttggaaggagtccaaatttggtacgattggttatgtaaagtttctttcttgtactagtgggtttcctaaggtgtttaggactcctagtatgagtttggttcgtggctttaggctgcctacctcatgtataaatagagggggagcgtgaggcttccctgtatcgctttagagagtaatagagttgagttttgagttagggtttcgagtttagtcgaaatttttgtaaggagtgctgttggtgcactttgtaaatacagagagaatcaataaagtcgtcatccactttaagagttcttcgatttgtgtttaccgggttttggcggtctaaccggcggcacaccggcggtcagaccggtggcatcacggcggtccgaccggcgggcacacggcggtcagaccggcggcgacaggagtcggcggtaggtgttttcggcggttcgaccgatcgatctacatcggtcagaccgacgttcatcaggcagtcagactggctcaactacttcagtcagactgcgatccatcgatttcgagggtaacttttatttccgctaaaagttttcggtttttgggtataccaaccattcacccccctctggttggcttagttcttgtgattcgatcctacacgtgcaagtctgaataagtaagttagatctgtataattttctgcctaattaatcttctcattggtcattacttaatgctttgaatctttggggggaaagtttgcctgcgcaagaaacgttgcatatctatatgtacaggcaacctaccctgcatcctcctgttgaagtcctgattcctgaatgataggtactgcacaacagtatgatgccattaagtacgacaaattggcgagcaatttgtgattaaaccattggttttatggaaagttgcaaaagaaaactggttgctgcttctccggttccggtaacagcctaacagggtcgcttcattaggtttgaagcgtcaaatgataagctttattattcttcgctttcactttctacatcgcaaacattgctggatagaatattgtgcacaattccaatcgaagtacagaaaatcacattaaatcgctcgtttgccataagaaaaacaaaacaaaaaggacggtaatcttacttcaccatttttttctcttttggtgacgtaaacacgcgccgtactcatgcgtgtgccgtaacatactcccttcgtcccagaaaaagcaaaccctgggtttgcgtgtccaactttgactgtccgtcttatatgaaatatttttataatttatatttttattgttgttagatgataaaacatgattaatattttatgcgtgacttgtctttttaattttttttaaaaaaaattcaaataagacgaacggtcaaacgttggacacggaaaccagggtttgtctttttttaggacggagggagtatgttggaagacacccactaacgttcagtcgtatacaatactactatgttggagtacgtaatcagtatttgaactcttgtagattataaatcgctcaactttaacaggttaaaagtaaccgagcaaatgttaggcatcaccactgctgtcgacggacctggtcatgcttgtgcctaggtgcaaaaggtgaaaatttagcttgcgggtgtttagatccaggagcgtaaagtttttgcttgtcatgtcgggtattatatagaatatcgtatagggtgtttgggcactaataaaaaactaattacagaatctgtcaataaaccacgaaacgaatttattaagtctaattaacccgtcattagcacatgtttactgtagcaccacattgtcaaatcatttaccaattggcttaaaaagattcgtctcataaattagtcgcaaactatgcaattagttttttttagcctatatttaatactccatgcaagtgttaaacgtttaatgtgataggatgtaaaattttagagtatgctcttattctttaatcttttatgaactgtggacattttgacatttttggttgcttacgccgacatttttctctgtgttttcccttttccgcacctgacccggtgtgagctgcacgttacgtttgctacgctgtaccccccccgggtctgtacgtacacggggcacgcgctcccgaagaaaacgccaactttgccaactctccgggccgtcaaaccggtcagacccaggagacgcgaaatcctgcgttgggcggccatgggtttttccgggcaaaaacaccggtcgatcggtctcgccgccgcgccgccgcccccgccccgcgtgcgcgtgaatgattagacgagtggcccgggaagcgagccatggtttcgcagggggaaaaaaacggtcagtttcgccgcgcggcgtgcatgattagccgcgaaccagccgactatcggccatgggtttttccgggtttcgctgtgcgcgtgcatgattagccgcgcgaaccaggcggcgggcgcgcggaggcggggaggaaacggccggcgcgggttgttctcatgcctggggtgccgacgtgcggcgtgaattcgaccgcgtttttgtacgcttcctcgcggagatttctgtgtcggatcgtgccgttttggcgacgtacactccactcgtgtcacacccctggcacagttggcacgggtcgtacaacactgccacgaacatttttcacagtgtgcgcgaaacagaaacagaggggaaaacctgcaagttaacgtgtttttatactacttggaaaattagaggatttttaggcgtcctcgaagtaaatcggacatggagtaattcggattcagatcagattgaggaccggccaaaagctaccgatccagcgttgtctgtctcgtaggactgttcaggcttcaacagagtttcttataaatatctaatctttgaaaatatacgagcagcaaagtttcataaagagagaaagcgagtgaacaccgtcttgagaaaacgaacaaaagcgagtgaacagcgagtgacagggacggggaggcaaggcaagtacggcaggacagaacaggaatacaggatattgcagagattacagccggggtaggcaccatcatttttctgaagaacgaaaccggcctttcggtgtctgaacagcccggatgaaaggatcatcaacgatgatgcaggctccagcagtcataaatcataggagtaccggagtaaacatggtccggatgaggtccagatagtaaggctgtgtttagatttaaagtttggatccaaacttcagtccttttccatcatattaacctatcatacacacacaatttttcagtcacatcatctctaattttaatcaaaatacaaactttgcgctgaaataaacacagcctaaaagtacttcaagtacttcactctacatggtgatggacaggcccacttgtaaattgcagtacgtaaatcagtgtacgaacttttggcaacttgagacgcttttcatgcacaccaaatcagtagcagtgtcacaccaaaaccaatactcaaatgtgaaaaatgcttcgaaattcactgcagtagtttttttttctcttttaaaaaaccggagtagtttttctagtgttccccaaatcagtaggagtactacctagtgaaaaacaaaacttactgttcctaactttaacctttaagactgtgtttagatctaaaatttggatccaaacttcagtacttttctatcacattaacctgtcatacacacataacttttcagtcacatcatctctaatttcaactaaaatctaaactttggatccaactaaacacagcttaagattcgccttgtattttaaataaacattttggtggctgcagtctgcaagagccgacgctcctggactcggaatcgcatcaaaccagagaatcctgcacatcggttgccgaccaccgcgacaaaacacatgcaaatcgcagtggaaaaaggataagaaaaccacatcaaaatgacaggcagaccattagaacccaatcagcgagagaattcgtcgtcgaaagctgctgattactgcaaaacccgcagcttagcgcttgacgcctactggatggatcgacgacgactactccaacttgtctccaaccattcagaagatgccgattgcgatacgtacggaagcacatggtggtcgcgttctccgtactcctatcctactactccctctgtcaaaaaaaaaaaaggcaaaccctgagtttccgtatctaactttgacggtccgttttatatgaattttttttataattcgtatttttattgttgttagatgataaaacatgattaatattttatacgtgacttgtctttttaattttttttataatatttttaaataagacggacggttaaacattggacacagagtcttttcgacggagggagaattcgcgttcggctatcagcatcaccagcgcgccagcagcttgcaggccttatcatatcagatcgcgacgcgtcatgataagccgcctgaaacttcctcccgttttgttcttgtccttaatttttactgtagcatggaggaaacaacggtgtttttttcttcttctgacagtacatgtgaactgtttgtgacagctgcaattttgttgtactgatgacaagatgctgccgtggaattcacgtgttagggccagagcaaggagtatgcattaatagtactgtttattagcgatcttttcttttctgattttacattttgaatttcgttggcacttttccctagctatggcttctaaacgatcgtttgctagtagtacaaaagttttcttggagcatataatttttttctatggtaaattttcagctttgtactgattcatttatttattataaagaccagattatacatcagtcaaataatttcagttctctcaaacaggctttgtagaaaatgtgtttgacattctgcatttcatactatacattccctagaacttcgcggcgcagcaacaatatttgaaacgctagattacttgtaccgtgctactcttcgagccaaatgtcgacgtatttgctggaccatggttggcgagacaaagtcctcgacaactaggaggttgtctcgttgatggagcatctttcgctcatcagcagggttatcttctctttaattattcatactagagatcaatacacttgaatagtgtaccttgtgggagatagatttttttgtccctcaagacaatatcccctcttttgtgtatgatgtgaaacttaacaacgaattatacgatctattccaagttaaacttgttatttttgtttttacttgtgtaaattgaatttaaatttacatgtttgtgaaataacatattacataatgatctatcttactaaattctttcaattttttataacattttaaacgacaaaaaaaaagtgagagaatatcctctccctgatgtactacaatccaaacaacacttcgctctcaatacatcttgagtcatgatgggaaaagcgaatgatcgcatcactttttggagttttggtgcacttttcgtatatctcagaatgtgttgcttcactccaaatcagtttgacgtgtttttttgggggtaaattaatatggttatagaagggataatcgtgatagcgttttcgatcaattcgtaggatttttgacatttgatttggcaagcaggcaaatcaaaatcgccattcaagataaggtgcatagtacaagtggtgaccaagaagaacaggtgggcttgtcatgcctatgcgtcgttcttatcctctaaaactcgagcttaaatttggtcaggcatggtttgaaacgaagctcgttatgtactccacgctctcttcgtgttaaaaaaaaaacttttatctatgaagctagagagactcttgtccaagtctatggcagattttggcagtttgtgaaatcttgtcatataccatgagcatttagtcgttgtttgagtaataacatcatctctagtttaaattgtgtagattcgtttacagcacgtgagtaaactcacgatcgaggtaatcgattcgagtttgttaagagaagctgagaacgctggtcaaatttgagcttgttaagagcacctgagaatcgactgcgtgtgaattttgagtttgtctacgggcaaatatatttgcgccttcgccgttagtttgcttatttaccttatcctcgctggccgctgcgacacggtttgacgacgtcacatcagcaccgtgctccacgtcggcctcgcgatttactgggtcccactttcagtgtctcgtctggccaccttcctcctctccgagactccgatcacacgtgaagcgagagggatgccgcggcgacggcggcgatggacgcagcggccaccggtgggaacgagagcccttgccgctgcttaattattcgggggatcatgtggtcggcgagcccttctgcattaacttggatctatagtagaacatattgtccatcgatcgtcatagctaattttagtttttttcccgaggagataaaaattaaggaattgctatatatcattcgtcagaaatttgggaatgaaatcttatatattttggaccattggatctgtgcctagattcgtgcatcgacttcttgtccaactttgacgaactccccttctcatgtgtcggtgacaccccaatcgagaaagagataaatcgataaagctgacggttggtttgaggtgggtggctcaccaaggaacacagtcagttatatttcacaattagatgatcggcatcctatttatacctgcaatatgtttttttatttattattattaagtaatttttagaaagccctatattttattatgattaaagttgtacaaaatcacaagtattatgacttgtgacacataaaccatgtattatggatttaaaagtttcacaaacttcacatttgtgcatgtttagtacaaatttacctgaattctaaaacatagagtgtatgcaatatttttaattaatcaagattttattaaaggtggtgttttagaaacatactagtaatcgtgcacgtgcaatgcacgtttccaacatataaaaacactcaaaatatgtcattttcctgcaatatatgtcatttataatctttgtccttcaacagacaccagaaagttatggcacctcacaaaagggaaaatgaaccttctgctgcagcctacataacacatttaagtggcaaacatgtaagcatatcagttaatgctaatgacctctgaagcaaaggacatacttatgggcacatatccttttacaattgaagtaaaatgaagcactgcaagattcaaagagctgctcactccacctagagagaatttgatctttatgcatacatagatggaaaaagaaataattgactaaacctggtgttctgaatgaatttcagactacaaacttgtatgtataacttgatgaatagaagctagcaacttccagaatttagcacagagaagaaaagactgtaatcaaatggattctggaattgaaatgctgccagagttaagtgaataatcagttggaactaacccaatattcagaccataggaggaaaatatcagatattcagagttattaatctagcaagaaagtgcagtggcagtgtgctgaagatcactatagaataaataatggttttaggctgtaccttactcagctcttctgaagatcacctttccctgaaatgattacagtatgcagttaaaacttaaaaccagtaattaattcttcacagggtacacaattttcggccatcaaatccattccatatgcgccaactaccattctgaattcctgatacttctattacacatgtttaattcttaaccttgctttagctttatccacttgaaaacttatactatcttgttctgctaccaaccacccggaggaagctctaccatgtattatatccaaaagactacaaaaaccaaaagaattgagtttattttatcgtcccacgcagaacgaaaaacttaatcacaacagagtttcatcgagcaccatgtacaggaatgaatgaacgaatatgaatgaagttgtcggctgaggaaaaaggtagtgttagaccttaattagaagcatcaatctcctgagatggcatggcggatggagaggaggcaaagccatgataaaggaagaggaacatccctgctttcatatggctggagcagcagatggtgagggtctgaggccgatgccatcccgccggagcttaccaccctcttcgtcagacctggtgcctgcaacaacagtgagctgcttctggctcccggcatcgacgtctcccacagctcgttcttcaaccgcgccgacgccccaggcgcccacggtgcccctgccggcttcctcgacactttcgacgtcgccatcaacggcgcgctccgcgccgctcctgccgcggcttcaccggctttcctcctgccgaacctcaacgatgacgcgactgcgactctccacgcccaagccgtcgccgttctgaaccacgaccgcagattcgggtggcgctgccatggaaggtggagaagaaccgggggtggagccgtcggcatcggcgactacagaggaaccgacagcgaggtggagcagaagtcagcgaggacggagggagtgggtggttaagccgtggtgcacttccgacgggggcgccgaggcaacgggtggttggtgcatgtgtcccagcctccggtggcagcagcggcctcaaccctcagatctggggcggcacagaggaagttacatgccagaagccggcggcgacaagaagcagcatggcggagatggaggctggtgataaaaagaacagcgaatggtggaggccgtggcaatgtgaaacaatgtggacagcaaaatctggagatggaatcaacaaatggaccattacctcgctagctcccttgaggcttcttccattgtcaagatccaaatcaacaacagcccccccaaccttccaattgagccattgaggagtgaaacgacggccgacatgcaacgaaacggagcggccaagatacactacgaactccaccacggccggctagcttctgatctggccactgccacgacgccacaccagcacacgctctcgtgaaaccctaggcccctctcccgcaggtgtggccttccccgacaccgagccttcacgcgacggcggaagagatgaccggcggcctgcggccactacttattaggggaggatgtgcgcactggtattcaatgcgcgaggaggcgcatcatccggtgtcattgctctgtgcgcgggaataacgcggcaagcggtggcggggatagcgctcgaggcggtgttactgcgaaaggggttctcgcgctcgcccggtgggatgaggaatcggtgatttcaccgctacacagagggtggggacatggggattgatttcacctgtaggattgctagtcacaacttctcctttttatattagtatagatagaccataaaacctgtgattatttgccacgcttcataatacatgtggttttgtgcaaatttaaccataaaatatggagtggagttttctgaaacttttttaaaaaaataaagaaaagaaaaagctactaatccaaaccgtaaagaagacggggaatacgagaaatatctccaaacatatacgctgaaaaacaagaaaccgacgcagacttggatcgatgcgatttcagcagccgtcgtcgttgattcggattcggggagtaaccgcgcaagagcagcgacgatgaggttcggtttccgtctccgatttcccttggggttccatccccttcaaatttaacgcgacccttcactccccgtcgcatcgcatcttggctgactcgtcccgaaaatcttgagcgaccgagttaccggcggcggagatggtggtggctgacaatggcaagtgggcgctggagaaggctcgggcgctgcaagatttggaggaggaattcaaccaacagattgcaaggattctcagctgctaccagctacctgaccacatcaggctggatctccatgagcagcaccgcaatgactacaaggtgcctgacgatctccggctcaagttcgtgaatgccgttttcgaggggaaatccgggatgcttgatcaagacgaggaactcagggttcaggctcggaaggaatccgagaagttttgggtggaggcggcgggggcggcgaagaaggcgcaagcactacaagacatggaagagagaaacaggcaattgttctttaagcattatcctggcgtgcaagacatgcctgaccacattagggagtactgcttcaggaaattcatggaagatgccagggatgaggtagaggtcagattcgggatacgtaatcacgaaatgcgactcaggatccgagcttgggaggaatcgcagcagtttctgatcaagacaatggccgatgggcgggcagccaagaaagtgcagaccttgcaagatgaggagaagagatatgttcagggtgttaagaaaacttttgacagcgaaaacatatctgagtacttccaacaggctttcttccagcaaggcctacttgataatatccggctgcttttcatagatgatatagaggaganattcaatatgccagtgacgaagagaaacctaagggttacatttcggaggattacacaaggtgaaaggcgcaggccttacaagatttggaggacaaattcaacccacagactgcaaggattctcaagcgttatgacctacccgagcacatcaggctggatctccaggagcaacactacaacaactacaaggtgcctgacaatctccggatcaagttcataaatgctgttttcaatggaaatccccggatacttgatcacaagagggagctcaaggtccaggctcgcaaagaagcagaaaagttttggatcgaggcggcggcgacagcgaagaaggcacaagcactacaagatttggaagagagatacaagcaacaatttattaagcctagttatgacagggaagacatatctgagcacatgcaggagtatttcctcagggaaagaaagataactgacaaggcctatctcgagtacaagaataatgtagaggataaattcgcgatacgtaaccacgaaatgcaattgaagtttctagcctgggagaaaacacagcagtttcggattaagatgatggctgatgagcgggcggcgaagaaggtgaaggccctgcaagatatggaggagagatatgttcaagattatatcaacaaggttgaaagactagatgtacctgactacatcaagcagggcgttatccaggaatacaaggtacctgacggtacccgactacgttacataaattatatcgaggagaaattcaggatgcttgatgaccaagaggaacgtaaggttcacatttgggagaatttcaaaaagttgaagatccctctcacaataaagtctcccatcactgtcgctatcatgttctcgattggcatcatgatcttgttctccggcttccttgtccccaagatgcccaaatcgttgaagatcatgtgttgggcgacttcaattgtcatctgctttgcggccgtgctcagctacgataatgaaagctcgaagaccactgccccaactgaaatgcatgatctggaaaatcctccaagtatttaatactgaataatgccatttaactggcatacagttccatccctgtgtaatctattgttagataggaaatagtgctatttaacagatcggttagtaataagaacttgttagtaataagaagtcatctgagaactcgttccatccctatgtggaaaaacaagttcttttttatttggaaggtaaacaagttctttgttctagtgctttaagtctagctgtttacagtcttgtgcttgaaattttagacttcagtgtatttctatatgctatgagcctgttaatgacatactatcagactgatgaaagatgttttgatagagcagaaaatttatctgaatatccaatcaccggatcatgaattctgatagtacatctttcttgttttctgtaattatctaagcacacccactattatacaatgctgcgaggttggatagtcagattagttttcttcactatcaaaacatagtttgatcagagaagggaagtttttcagaaaaccacaagtcaaacttgatgaggcacagtaagtccagacttatgagacttgtttacagtcaattgattatttgttatcttgattgatatacttcaatagtaactttggtaaagtataaagaaatggtacatttcctgggctactttatcaaccaactccgaatcttttctttagatcagttgtagtaaagaagagttaatgtattcatttcacaatctgcatcctttgttttgcagccacatagaagacatagcatgtggtgctggaagctttttgatgttttcaattgtttttgacaaatttaaatgctgggtttaaaaaattcagtttaccttccatcttcatggttcaaagaaattactaccccctccatttcatattataagtcgctttgatttttttttttaagtttgaccaagtttatagaataatatagtagcatttccaacacaaacaaacataatatcaaaatatattcaaggttagatttaatgaaactaattttgtgttctagatgtcgctaaatttttctttaaacttggtcgagcttaaaaaaaattaactaggaaaaaagtcaaagcgacatactccctccgtcccataaaaaacccaatccttatgtccagattcaaaccaagaattggattttttatgggacggagggggtataatatgaaacagagggagtacatgtttgcaatgaatcattatgataaaataataaacatttctgttacattcaattggttataactttttgttttttgtaatcctcagttggactggtgaagagactaaggaactccagtatgctggcactattgcaagagtgtgcaacaaagtgcttcctatttcaagtattacaacacattaactcttaatgctgctgtcaaacattttctctgtaacactcaaaattttcagcaaccatcttgatatcatcttcttgttttaggcagttaaagctgcttcagatgctgaatcaggaggagtgcacttaagtggtggttcagctatgacactagaaaataagcagcaattattttgtttcttcatccttcaggcatttaaaacctaatgttattgtgcattatgcatgtttattctcctgatcgagccactcttttgctgagaatggctgccattgaaatgattacccaacttgcattacagcgtttttctaaacgtgaaggtactaatatgatgtcttatcatctgtgagaaagcgtgtttaaattcgtgaaaatattttcaaataatgtg

SEQ ID NO: 66626 - DNA, 2498 bp, Oryza sativa
ttctattttttgatcaaaatataaaagggactacgaaagaggaaaacaacctccaggttaattttaaaaccatgttttaaaatcataaattggttgcagctcaaataacccatgggtattagtgaggtgattaccgccacgtgaaccctgtgtttagctttacaatgattgtactgcagctgtaagcagtgatgtgttcttgcgcatgcaggagtataatcttgcgtgtggcctaacgactaaagattgactatacaggagtataaaaggaaggattcctgtggaatgaaagtgtcacaaccaccaccactttttatcctctgttgaaatataattaagaaaggaagaaagaaacttatgattaaacagctgactaaagtgtgatctttaaaattggcagaaagcgagcgtgatggtgaacgtcacggtacatcatattgggaggaacgcaatatattaggtgttgtgggtggaagtgtctttgctgtatagaatcgtcatcgatgagtacaatgttattactgaattgaatcgtctcatttcaccaagtgtaagggcaatgcattattattccgttctaaggagagaaggagtaagcaatttaattttctctcgcactctctcgtaagaagagaagcaataaactttaaaaaaaaaatacaataagactgagttagggagagcagcttgccttagtttttttggtggcgcaaaatataagcgattaccaaatgattaatcgagtattaattattaaaggtttcataaataaatttatcttatttttaaaaagaaacctctacatagaaaacttttgcgtgaaacagattgtttattagttcggaaaacgtgctcacgttgaacaaggaatttttttcagcgcaataactcagcctatgggtgggtttgacttgaacatttagctagagcaaattgtttcatgtaaatgagacatgtcattaacgaataattaattaagtaaacatgaaaaattgatttgcttatttttttaaaaaagcttataaatatactacctccgttccaaaataagtgcagccatatatattcgtgtttagcattttgaccgttcgtcttatttgaaaattttatgaaaaaattaaaaaaaatagtcacacataaagtactaccaatgttttatcatgtaataacaataaaaatactaattataaattttttccaaataagacgaacggtcaaacgttagacatgaacagtgctaaaactgtacttattttaggacggagggagtattatgaaacaaaccatttagcaatttaggaaatgtgcttacgagacataagaaaatttgcttggccaagtagctcaatcaaacttggcctaaatttaagtttagcctatgtccttcaactaacatctcaccactttcttgccacacttcgcccccaatatgatatcccaaaaaaaaatgaaatcccatcgtcgtcaacatagtagaatacacttcttccattctaaaataaacaaaatcttggtacatatatgacatattctagcactatgaatctgaactatccaaactatccagactcatagtactgagatgtgccatattctatactagttttatttattttaggatgaaggaagtagagctctaccatggaccgagagttgctcgaacttgatcggagaagctaccgtctattttggtggtcaatcctgagtggaatggggaaatagggttcgagattcgaggatggagaatgtatatatcactagtcttttaactcaagtacctagatgagtcaacgaaatcaccacgtcggtgatcaacgtggtgcaccctaaaacgggtgcccgaacatggatatctattatatttggtgatggacattactagaaaatattttttttacaaaccgtcaaaacggattatttcaggcggccattcaccccgcttgtacttcaaggcttacgaaaatacgtcatttttataggcggccatcggtcccgcctataaaaatgattttcgctggcgatctctccatcttcgcaggcactagatccacctgcctaaaaaacattctcggtgaaaaaaaaaatcccccgccaccactccccacccgccgccgtcctccccttctgactagatctagggttagggttttgggtggaagagagagaaggagagggaggggaggagtggggtggggaatcgtgtagccatcgaccgccggccgctgccgccctccctcctccggtcaaatctaggagggagggaggaaggaaggggaggggagtgctgcctccgtcgccgcctgcagtggctggccaccactgtcgctctcctccttaggccagatctgggagggaggggaggggaccgctgcctgtggtggctgccgccactttcgcccccctcctctagccatatctgtttgcccccctcctctagccaaatttgggagctaggtgattttatagtctatttaaaaaaaataaaatcgtggggggga

SEQ ID NO: 66627 - DNA, 26635 bp, Oryza sativa
cccctctccttctccccctcttccctataaatatcccccctcccccattctctccactccatctccctcttcggctcccctctcccctctccactgcgccgccgttcccgtgccgctgcgccgccgttcccgtgccgccgcgccgccgttcccgtgccgccgcgccgccgttcccgtgccgccgcgccgccgttcccgtgccgccgcgccgccgttcccgcgccgccgtgccgtcgctcctgtgccaccgtgccgccgcttctgtgccgccgtacgccaccgtcgccaccgccgtcgtcgccgctgctgccgtcgctgagccgccctccttccccctcgcgtccaccgccgccaccgctcgggtaggagggagagccgagagaaagagaggaagaagaaaagaaaccgagggagggagaagccaaggaagagagaaaggagccgggagggagagaagaaagggaaaaagaaagagaggagagaaagaaaagaaaaggaaaagagagaaaaagagaaaaagaaaagggaaaagagaagagaaaagaaaaaggaaagggagaaaaaggaaaaggaaataaataggaaattagagggagtttggggaagtttagaaaatttaaaataattagaatttaattatagattaattatagtcgtagaattgcaaaatttaatataaattatggattattcttggtaatttctataggaaatcaattcgcggtagtaatttagatgtaattaataactaaacaaatagttgaattcttatagattattatagattatttttgggtaatccctataagtaatcgattcacggtagaaattcggatttaatcgctaggaattttagacgtatattatatttaatcgtttagtcatagactaaattaaattgtataatatttctaggatttcgtccaatatttagctcgtaatagaaatttctaacctattatatacaatgctcggggagagtaaattattgacaacgaaataattatacccgcaaagtagtttaaatcgaaattgggtttgccgtagtttgcacatagtaaagttaataaaaaggaatcgactttcgcattcgactttcatttggatttatttggatttttatttgaattctaaccgaattcaaatcaatttttgcacgtaacaatagagcccgagggagttgcggatccaagcgaaggccaagacccgcaagactttgagcaaggcaagtcatcactattccttgaacatgttgatcctaattgcaaaattgttttgtttacaaataaaattgcatgcaatgatgaacatcctacttgtgattatgccatgccttgattattgctaacccttaaatctttgtaaccatgtttacgtatgagtccctagtcaactatgacaattgcttagaaatgctactctagaatcatgcatactcatatttatcaaatgctatatgcttggggcaattacctttgggaaggtaattgagatgcggcatgtggagacataagcgccacattgccattatgttgatgacatgatttgtgaaaggagaaataaaatttaacaattgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacctctgagtgaggcaggtgcgctacattgggacagccgttgaggtagggccgagaggcgtgccctccatcggtgtcgccattggtaggactgccatgagtgtgtaagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcaaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattatacttagctagactctaaattctttaacttgtgtgggatgggatattgcatgatgatttttatgctgatggagccacttcctgagaggcgggaatgtggacgtcctcagaaaaccataacgattcaatggcgggaagctatccttgggatcacaatggatggtggacagaaccgtcattgtttaatatgaacactggtattaaaacgtgatcaatctatgctaggtcttaggcttgtgaaaagaattacaaaatttgctttgcgcaaaagaaccatagccatcctttgaattcctctgtcatgtgcatcattgctgtggtggcttgctgagtacggttggtactcatccttgcaaatataaaatttatcagaagcggaagatgaagcctcggaggatccctatgcctactatcaggagggagatgaagacgaaggcgtccagtaggtcttagtacggtcgttgcctgtggcaatggcatgccgctgcctgaattccgctgccttatctatttctgcttttggatgtattccggaccgctcggtccgatgatttaagactatgcctgcgggcctataatgtaataattcgtattagacactcgtgtatgtgcacttggtattccagctatgaatccgtgtgtaccaaactacttgatccagggaaatggtactgtttacacgattgattcctgttataaaaacgggggtctacacgccggtcgcgtcatcggcagacaaccgtgctcccacgatgcatctgcctccggtggagtggaggtaggtatgacccatctcgtcggatggtcatttggaaagcagccatggcaaatctccgcccattaatgagggagtaacaggagatccccggtgtcaggcgagagacggcgctgagcctcactcaaggacaagttgtgatttagtttccaggcgaaggtgcaagccaagttttggtcaaaaaagggtaggtccccacccaacaagaaaagtaggtagaattggtgaatgtagtatccccttgagatataaaaggaggaccttgcccaccaaagagaaagaaaaaaaaaaagaaaaaaaaggaggcgagaggggttctggagcctgaactctctggctctcggctctctgtaaatccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcagtgctatataacttgcaattggctgatttttactgttggaaagtagccgatagagttaaatctcgttattaatttagattatattgtatatctactatctcttagagattttcatcatcttgcctagatcttatacttatctttatgcttaatgctgcatcggttgggttcgatctattaagtaatatccataattataaatatctagtttgttttatgattgtcaatagagatagtgtcggagttccagccgatcttacctgatttagctatttatatctcatatgcttgattgttatgctaaatctgccttttatattaaaatcttattgcattaaagtatattaggcttcttgtttgatatttttttgcttgttttgatatcttagtataaagtggtatcagagtattagccgatacacgctagatctatttggtcagctatgctataaacatctatataatctttgcttcaatgtatgtttcgacttaagtgatttatactgtctctgcatgacgaccgatctatcccaatcacttagtttaaacatatatcgaaggaaagattacatgtcattaatatctacagacgatcgagtagatttagttttatcttattcatttattactgccgatcgattccaacatgacatcggctcgaagataaatgatatgtcatcggcaactagccgatcggctatcatttatggatttaatcgtggttttttttgtctttctttcttgttgattgcaggatcaaatcaactggcacgctcacgaacctaaaagcaagattttggacctacatatgagttaagcagatctccaggccagtgtgtgtttttcacatcaacagaatcttttaagcctaattactccatgatttgacaatgtggcgctacagtaaatatttgctaatgacggattaattaggcttaataaattcatctcgcagtttacaagcagaatatgtaatttgttttgttattaaatctacgtttaatacttcaaatttatgtccgtatattcaatatgacacgccaaaactttttaccctgaacagggccttaccctactcatcactgcactgttctccgtattgggaagcctcagctatggtgacaccatcctcaatgagaggaggaggaggatgaacctaggccagcacaccatgtttcaaccttaaattaccaaatctggttgcacgaaaatataagcgtaaagataacatcaataaacatgatattaaggtttgtgccaaacatttgatgacatcaagtgcaagtgcaacggagacagcaaggcaatgagaaattgagaagtctagtattttgctagttgcttactagtataccttactctctttctgaacttttctttaaaatgttctataaaagtttattttaaaaatcatattaattcaatttaaaatattttaagctaatacttaattaatcatgtgctaatctgccactccgttttgcatgtcgagaggaagaattttcaacactcaaaagaacacaacctaattctctccacgctttcctgtgctctttctcggttattaatattttctcaatcctataatttttttaaaaaaaaacaggcatttaaaactatccgctaaggatttaactcaatactaaaatggaaatataatccattctaaacatagaattcgagcagaggcctttcaataatcttgagcatagcctggctagcgagtccataaacagtcactgacaagtgggccccaagtagagcgtggccacgaccaaagctctgctccccccttccagcccgtctccaaccagccgcctcccccccaacgccaaccacccgcacacgcaaaatcccccaactccagcaacaaccaaaaagtcgccgtcgccgtcgcctctcctcgccgtcgccgcccatccccccccccctctcgctttcccctcccctcccctccaccgaccagccgccatcccgacctgctccctgccgcggcggtctctcgacgaccgtttccgtccctacttgctcatggtggtggccgcgccgtgctcgtcgtgagggggatgatgcgccgccgcgcgacgatcggggccatggggccctccgcagccgcgctgagggccgccgccgtggtggggctggttgtggcggtcgggctcgcgctcccgccgctggccgcggcgctgcggccgctcagggagcgcgtcgcgtccgcaggggccgcctcctcctccggatcgtggggcgatgaggtgaggacaccgaggcgcgattgggaggtttcctccccacaccatttctgtcgcgggggtttaggcgaattcggtcccgacggggtagtgcaattgaagagaagaggccggggggagttggggagagatatatgctttgctctgcgctaaatttggtactccatgggtttaatttcgtagagggcttattttggtgccttgtttccttgcagtacaaacaattcgatggaaacagataactagtgttgaatttggaaaggtactgcaaaaccaaaatcggcgtctaggtttacaagtcaaattaggctattctgttcttggtaggcaccttgaattggatatgctggcatcccaactgactgtacgtttgtacctacatagacaccaggtgtagttggagtaagagtctactaggcgtctataagcccttgggaatatgaagaaggggcactcgaacagctcgcacttcaagtggtttctttcatttctaacttggttgttatctgatcatgcccttgagcttgtctgtttatcacttttatctacaactacgaattctacttgtatgtctgcagttgagcttattactcattatctctatctttatgtgcttctgcagcatgcattcttcaagagggatgagaatgagataagtccgtactcatggaatatcacagggacatataaaggtaacttctgggtcatagttacacttacacactcgatgttctacctgcttctttagctgaacatttgtatcactacagcatgtgctatagtgatatgttgtctttcgcttgccatacattttattgccgctgcatgtgtttggatgatctactgttgtaggtattccaggaattaagtatgtgctatttgctcttggaatattatttgaaacatgggaactgccctctattccctggagttcagtactgtacctgcattttaggtgctggaatgatttaattttagtgctaccaatttttctttcgaagattataagttaatgatatgctattcaaaccatatgatataatttgatcatgccttatcttctttgcacttacttcttttgtttcatgatattccttgtgcctaatattaattcactgctgttgcttgcttgtcataatgcttagagctttcttggatcttaggttaggacgttcagccccaaattgaaatgtttgatactttgattttcctgctgtgtatctagttagtaacaggagtcttttaacaatttgtggtagattttctattatgggtccatatctatgctttaagatagttactgtggccaaaaagtggaataacatatgtgcttttgaaaatccacctcgtcactgcttgccaatcctagcaactgtggtctttccttcctgtccaaacagttgtatcatacaccatgtctatacttgtgtgcgtttgagtgttacacacattgttctcttaaatataattgtaaatataaataaagtgcacatatgacgcctttttttaaaaaaaaaaatagttaccttatgttgtgctagtgctatgcataggataccgttgcttcattacagtgttaatgtgcttcatgaaataacatcaccaatttgttgttcaggaagttggaactttgctggttccacaaatggttcttctaggtttcttgagtttacaaaattgaagggcgatgcggttttggaactattaagtacaccgacaaagataagcggggtgcactatgttcaggtaatgcagttccccaccccaccaggtacatgaggccattctagtttactttcatttataagtccagttgagctgatgtcacatcctggcctcccacacccttcaaatagtccctgttgagccattcctacattggtgtaactcctttatccctgtagcctaaacttaattctttcccccgcccccttcatctcaatcaacttgaagcttgtaatcccacctttttgggactttttgaagagatttaatttcaggtgggctgatcacagtttttcgtggagtcataaaataataataaaaaagaagttacacagtcctttgcatgtccgatacaatttttgtggtcatcatgatcattttcttcttcattcgtggctcctctgttcactcttttaccttgggatggcagggatctgttacattccatgatgttctagacaatgctcatgatcgtggagttgctcagataaggttagaaggcgtgtacatatggccttttcggcaacttcggatggttgcaaacaggtgcatatttaattttattttctttgtactaaggagctttattatacggttttatgttatgccttcctgcttctggattatattatgttctgttaattttgtacaagagaactatattattaatatgttctattgccaagcactccaataaacctgcattatgttacttaatgcaagcttagctactattacaaattcattcaaattccttggttatcctgacagatacttttttttttctgttagctagtgctaatgtttaattgtggtgtcacattgatttatattaattacaacgagggcgacattacatcacctttttgtagggtggcatatttatttgtttttggtgtcagttctgttttggagtattctgtagtggcacatgtaaatcttgtccttctaccatatgatctaatgcatatgtactatactgtccagtggtgcagatggcgagccacttcaagaagaggattacttcttatcaaatccatatcatttggtaagaagcatagttcttttttctttattgacttttcacagaatgtcttccagtagtttcctcttaccaaatgccaccatccagttttccttgtgtactttctctttagatatgcatgtagtcccatgacatttacattcattatgatagtaaaagaaccccactctttaagctaatgtacacgcctatgacaatgcacttgctaaatttgtatcagctgcggattttctcctctcaagtgttccaagaaacctctgaagagaagaaccggaggaagaattgtaagattttgacttgtacattgaatactacctacaacctcatgtggttttgatatgcgtgacctcttccttatcagctcttacttacgacatggagaagcattgtagcgtcgaaatagctgctaaggtggtccgtgtgtcctctaacctaaatggtattgaatttctttgtgaaattcttaaactcatttctcattggttagtttgttgtgcatcaccaaaagctgcatgctcatatttcaagttttcagtttgtgattgcctttcctttcattcttcaatgacatctaaacagcgtctgtaaatgcttcttttcaactagagggagagcatgagaaataccgtttggagggattgatggagagtacagcagtggatgatgatggagagtgtttctcaccgatcttattaaatgcaacatcattgaatgttgaagtttattacaacaaagcagtcaattatacactgatggtcacttttgtatcctttgtgactcttcaactttctttgttctgattttttattggtatgtactgtactctatgtgaattccttaattgagtataccagatctccttcctccaagttttgttactgattagacaaatggaacatagcaacacccaatctgtatgtattcattttccttttcagaatatgtcagtacaatttggacctcttgcttttcataacctcaaagattccagttttgaggtagtttatatcattttgcagggagctgccaaggtttcaattctaatgatagggcaacaagctatcatggatgcatatctttgtctactgcatctgactgctgggatattggttggtgagtcttttgaatcctaaaatatcagatgtcttttttgtctattattttctgataagtgccaactgctagtatcacccactctttctttgctggtaaaagttgggtccttgtgccacttgttctgacatatgctgttgctatgttccaacttgcatgaagttcaagtgtttctgagcaattagctgtaaaataaaatgtcttccagtagtaatgcgaaaataattatgttcattgattttttttctctattaaatttaaattccactttgattaatggttattccatttacaatggtattttctgttgaagtcttgaagggttgaatagcaatgcaatataatggcaatctgagccaaacacaaaatgaacatgttatggttacatatgctacttatcaaatagagatcgtggataaaaatgatccaccgttgaacctgctactgatcaccagttaaataccatcaacataccccaagattgggcccagcatgcatgcatggtctgaatttgccaacccactcaaacaagtcctgtaatttcactaatttgtaaacccctaggccattaatctgaaatgctgttagtcacaatattaactaagtggaaacctttaagcttttcgtgcggcctgatgcttataatgttttaaattctgcatatcttcaaaatttattggtggtattaacattttaattgcttgtttgaattatctacagagtctctctttaacgcattcgcaacggctgctttcttcaagtttgtcgtattttctatatttgagatgcgatatctccttgccatatggaaagccagtagaccattgaacagtggagaaggctgggaagtaatgaggagagaattgtctgttctttacagccgcttttgtaagttctccattttcatctggtttctccattgtcttaaaaaccagtcagtaggtcatctcttccagccaacatttattatgcacaagagcatgaatctgcgtaaactttagaactttacatgggcatgtaatctggatcacaagaagattgagttcctagcagtctagcacccatgccgatcattgttcaattagtaagatgtcatgtgctcaccatagttgacttggcaagatagctcctgtgctgaccccatttctcagtcattcttatttatggttctacacatttacctttcatttgaatttatttatgataagtgatacctaatgtgtaagtgagtgggcaaagcacccttatgtgctatttgcctatttgttgaagcctttgagtatgttgttctgttggaaccattaggatgaatatttttgttgcttgttgaaacagcctatttttccattgtagtatcagtatgttggtaagatgtcaaattagttgacactttccacctttacatcagtgtttagcacttttagcttttattttacaaaatataatgttcaatttgcgttgtgttattcagatggcattcttttgggagggatccttctcatgtatgagttgcacaattttctgcgcccacttcttttcctgatgtactccttttgggttcctcaaattgtcacaaatgtcatccgggatacaagaaaacccctgcaccctcagtatattttaggcatgacgatcactcgccttgctattccactgtatatatttggttgccctagcaatttcatgcgcattgagcctgacaagacatggtgcatagctgtgacaatattcatgggtatccaagcggcagtgctcctgctccagcactattttggttcacgctgctttattcctcaccaggtaattactacatggtctttcctaaatcctcatacacagttgatctgttgatctttcctacacgcactctagttgccattcatggcattaaattccatgcctcccaagttttttttttccttctatgcttgctgtattatgcactgtagtacttccattcctcagattggaacaatttgttctacctgtatcacactatcattaataaattgtcatgggtacaattttcagattctccctgagaaatactgctaccacaggaaggtagaggataacacaaatcagcccattgattgtgttatttgcatgactacaatcgaccttacccaaagaacaagtgaatacatggtaattatgaaatcttgttgcctgtgactaactgtgatgtcatagataactttggctgaacgtgtgctgccttctccttcaggtggcaccttgtgagcatatattccactcaggctgtttgcaacgttggatggatatcaagatggagtgcccaacttgcaggcgctccttgccgccagcttagatgagcactactttgtaccatatagttaacaagtaggtagctcagcatattcaaggtattacaaactcaactccttttcccttttatccgtaaaagtggctttatacatctgcagcttgacggtttgtctgtttcgatgcatttttaggtgggaattgaggtgcaataagacgagttgcaaccatgggtggtttctcgaagatagctgtagaaaatctgttacgcttttaatctcaagtgatctctgtgttgtacacaaatcattgtaccaattctcccacggaggaaaaaaaaattttacttatgcagtattctcgctcggcatgctgcgttcttatgtcttcttcagatctgtccttgttttgattatgtaagcattgcacaaaaggtattctcacactgcaaaacgaactacggtgttccaacttctgcgatctgcggtaatgcgccgccacccatgccgttgaggtgtgtgcccctgctgttccggcgtttgttgtcgggtgtgctgtaccccgttgaggtgtgcccatgtttaaacgcaggcagtcgagaccaacacgacgagacaggaatgctgcaattggagaaagaatatgaggcccctttcaaatggaggaaaaataaaggaattgaaatcctacactattcatatctttgattcgtaggaacgagaaaagaaaaaacgtaggaaaccttcctattcctacgattttagaggaaaaacgtaggaaatttaacatctattctaacctcttggaaaattttctctgagtctatctcttggaaaatttcctctgagtctaactctcttatctaattcttgtgttttttctgcggtctaattaaacggttattcctatgtgtgtttccggtattttgtaatcctctgttttatactttatgttaaaatcatgtgtttttcctattcttccgttttttcaaccttgcgattcaatggggccctggaagggaaaaggagagcaaaatgcaagatactgcagtggacgagaggtcacaatgcattgaaatcgaacttattcacaatgcacttcaatcatgtttttctttttctttcgtacactagctaaagacctgtgcgttataaaagaatattataaaagataaaacaaaagcaaaaactttatagcataactagtcgatttaacatataatgcaaagacatccatactaaaatgtgttgctagatcacctctttttatcctctttgtcaatttccctaagccataaagtcggataatacaagattggatgcttataattcatctgtggtagtagatgaatttaaaggttttgtatgtgattcctttaaaatttctagaattagcatttttatggctattcatatgttacggagatctcatgcttatgttctgacatgtaagtttgtggtgttgaagacaaactcggacaccacaaaaatcattctaagtagtaaagataagagcacttcaatttcctatagagattgagaaaatttaatttcaaactggacataaaggatagtccaccttaccagttgcaacagtgccaccgccaattcttttaccccttgccagtagtactatgtgccattggtctcttgtgattaacaatcggaagagaaaaaaaaactctaggtttgcttctctgtgctcatgttgacaagttttactttgaaactagtactatctccgtttctccgttacaaaatataaatatttttaagattgtcacatgtattaagaaaatatgtgtaaatgattggttgaaaaggaaacgtaggtaaaggataatggttacgattcgttgagaagtaagtaggtggagaagtaattttattttaatataaaataccgtgctagaaatagctacttcatttgttccaaaatataacaacttttaaccctctggatttgtcacaaaatgtaacaacttctccaccaacattctcttcctaaccaatcacaaccctctagcattcactttttctacctacctccactactcatccaatcacaaccctccaccattcacttttacctactttcttaataatcgtgttcaactttaaaacgtcttatattttgggacggatggagtatattttggaacgaagatatcaatggagtaacggaacagaagaattactgcaattggccgagtttagtttcaaattttttcttcaaacttttaactttttcatcacattaaaacttttttacacacatgaacttccaacttttccgttacaccgttttaattttaaccaaacttctaattttggtttgaactaaacatgcccttggactctctacgggaaatttcactcacctcaacgaggccactggatctcaatcgatagctggagcatccaataccgctactccagcgtagtggtagggacaaatcgccgcaacaaccgggcgcactttcccactttcggtccccccccccccccccccacccgtcgtcgataccgcccgccgggacggtgcaataaacgttacagtgagctggaaggacatgctgcattgcattgctgcccggctgcccgtgatcttagtttcgcaccgattggctaaggttgatttgctcccgatgatttctccacgaggccgtagtactacgagcagtagctgtgtaccccgacaagatgcaacccttttttttctttttcttttttttcgcgcgcctattcatttgttgggtgaccagattttttctatccttacatttacaactaacggattacaaaagaaaataataaatacatatttacttacacaatatttatattaaaattatagtgcacttacctgtcatatcaactaaatttacaaatgtaattttagttatataggactgtaattctatattttaaagaaaataactaatacatatttacttacacaataatttttatcaaaattacattgcacttacatgtcatatcaactgaatttgcaaatataattgtgttatataaaactgtagttttatattttatttcatcaaaccaaactaacacgcatggttgcatccgttcatattccttatctggttatagtgttggttgtgtgtccaataaaaatgctactaggtggttcgtgcaggcgtgcacggtagggacgcatcacagccgttaaattaagtcatgcccaagcgatccaacggaagcaaattctagtgatttccacaaaaaaaaaaaatctgtcgcgtgatgtttaacaaaatcgttcagaaaaagagaaaaacggccgcgcaatttctggcgacttcgagtttgaggctttgagccaaagctcgcaatattctgggcttctgtcgagtacgagctcgaatcgaatagctcgccaggggcagggcagctggttgcctggttcttgtccagggcgcggtgtcgcctccaccaacggctgcaccgcggttctatcggcaccgtcgtcgtagcccgcatcgacgttggtagtccaacacctcctcctcccaagttgcctcgatctatctacaacaccgaccaccaaacattatctgttctgaaacaccgaccaccaaacaccgacctccctagttgacagcggaagttcggcggcgacccccactcctttcttcctccaaccggcggccttcctccctaggccggacactgacaagctcctctccctctccgtcaagttgctgcgtggtttggaacagggataacgatgggctcaacagcgctgaatggggacgaaaacgaggttagccgcctcctcatcttcttcctctaccaccttgttgtcgaggtcgctagatccactttaggggtggcaacgcatctcgtggtggtggcctcgccgacgaccgccaccacccttgcatgaggtgtgggggtgttgcacggggccacgcctcttccaacacgccactcgcctcatgcctcagctccgccctgacatatgcctgcgtaatttctgatgaaaaacccgtgtctttattttagctccgtggtctttagattgggagcgcggatgtgtgcgtggcgtgaaatctccgacgtgaacggtcgggggtgaacgccatgtaagtatactgtgaatggccttagcccttggtccggacattcattcctgcgcgctgataaccaattcccagatgattattgttatcctctcctcgggtggctcgtgcgtgggtcgggagcacgaacgtgcacggtgcactcctctcactatccctcccgtaccccaactaaaaaatgataaaaggaggttaacctgtgaccacatcatctgcacagctcaagtctccattactaatcataaaagcaccccgtatttgtctgtcgctaatcacgaatattctaatactacactcggttttagctctcgaaatcagagttttcaggcagcttgttgtttctctgcctcgagagaaaagaaaaaaaaagagaaatcttgggagtgccaaagcggaggagaaaggctcgtactttgaaggggagggaggagcgcaatgcagcgcggatctctcggcgtgctgcggctgcggctgtggctgtggctgctcgcggtctccgcatcaaccgctgttcttgcggcggatcctagcaaaggtgagctttcttgcttgattcttgtttgccttttttagctttgaaaagctcagtttcctgggtcttcctgctgaaatgtttgctaaatgcagcccaaaccagcgaccgtttttagtctgtggaatgaaacaatttcgtctacagaatgagaaattcctggctattttaccccttctttccttccctttttggatcttgaaatgcgaatcgtgtcttgggaggatgtaagcggcgaggtgggttcccccagtttgagtttttgggtccaatgctgcatttcttgagtcttggccaaaattaggcgctgttgtttggtttcaatcaagcaaatttgtgggaatatccttctatttttaagcatttcttgtattttgggggcactgcattgttcacggaaaaaaaagattgattttgaccccttctgagatactactacttatgatatttctgttcccttatcgagttcatccattttggagttcatccattttgggagtactactcccaaggagtccagttttctttgcgagttcgcatgtgctatttgatagtttccattttgctaggacaaatcttgctcaagctatgactgaataggaagtaggaactactcccatttctgtatatttgtactttcacggtttaatgaactcagataatatttgctgtagttgcttgattgattgttcttgtctagcatgacatagctgtgtgccgtaattcaagtatcttgttttcagagccattcaccatccgcataagctgtgggagttttgatgatatccggacagctcctaccaacacattgtggtacagagactttggttatactggtggcagatttgcaaatgctacacggccgagcttcataattcctccgctgaaaacgctccggcatttccctctgtctgatggtcctgaaaattgctactacatcaacaatgttcccaatgggcactatcaagttaggcttttctttgctcttgtggctgatcctaatcttgacagcgagccgattttcgatgtttccgtcgagggtactctatttagttctttgctgttgggttggagcagtgaggatgagaagacatttgcagaagctttggtttttgtccaggactcaagcctgtcaatttgcttccacagcactggtcatggtgatccatcgatactttctatcgaagttctccaaatagatgacaatgcctataaatttggtccttcatgggggaaaggtacaatacttagaactgccaaaaggttgacatgtggttctggcaaaccagcattcgacgaagatctaaatggtattcactggggtggggacagattctggttaggggtgaaaactttgtcttccagttctgacgaccagccgatatcaactgagaacgttatagcagaaacattacttgcaccaaatttttatcctcaaagcatctaccagtctgctattgtgggtactgacaggcaaccaagcctatcctttgaaatggatgttactccaaacaggaattattctgtgtggcttcactttgcagagattgagaatggaataactgcggaagaggaaagggtgtttgatgtacttatcaatggggatactgcattcaaggatattgatataattcgcatggcaggagaacgttttactgcccttgttctgaataaaactattgttgtcactgggacaacactaacaattgtcttgcagcctcttaaaggaacacgtgccactattagtgctattgaggtctttgagatcattctggccgaaaagaaaactttaactcaagaaggttggtgcttgataccctacaaattactttccttttgtttcaagcaaatagcaaactatggtagtggcttttttgaacattgtactgactttattttgactactgagcctttttgtgtcaaattgcgtatgaaacttttagtcccatttccatcttgtagatgattgaggccaccttagcttttcatgatgtatattgatcgatgaaaaatgtactgccaaataaagtagcttttactgaatgcaaaaaatgtattgatgtcttttttcaaagaacagaaaatgacacgcgaatcaccagagtttgctgcttatgtaatgattttcctgttttaatgctttatagtgagcgcattgcgtactgtgaagggttcgcttggtcttcctcttcgattgggctggaacggtgacccctgtgttcctcaacaacatccatggagtggagttgaatgccagtttgatgatatcaaaggccattgggtcattgatgggctgtatgttctctatatcacaaaaatcaatatttatctttattattagcttgctagaaatgccacactgattttttattcgttcaaataacataaatagaaggattccgcacggtctattttctcatttattaaatttcagtaacatgaaactaatacataataataaggtatgttctagtaagcaatattgcatacaattgcccaaccaaaaaaaaggaaggtctgaaggactaataataggacaaaatatgagaccgtgaacatatagtagttaactaaaagatagtgccaaatgacatcacttgtgaaattccacatgtattcaattatcaggtgaagattgttgcaagcatactattgctagtagttctacaacagctatcacctaatcttattgtacaataaatttaaaatgctctagaatttgattttacaatgccatgctgtcatatattcttttcagacaattattgattgtcatgtgattttcccatggatttcctaatgaactgctggtaaaccattgattcgaacaccaatcttttcatagtttggttttagtgttgtaaaagttgtgttttgatgaactaggggcttatccacaatttttggtttctgacatgcatttcaatttcaatagttatccatcaacaggaaatctttttctatcgcaagcatttaaacttaattcctgaacatgcagaggtcttgacaaccaaggtttgagaggatttataccttctgacatatctaagctacaacatctacaaagcatgtaagttggtatctaatagagacgatctgatttcatttttttgaggagcactagtatgctttgctagatcttatgataagtgcagtatctgaaaccttcacattataacagcattaattaaggactgctggaaagtattcaaaacctataaagctgtaacattgcaatggatgcattgacctacacacctgtgcaacatatatgactgttggaaagtggtcatgtccagtatcatctgaaaatctaatatgaatatgggatttttgtgaaatctaaatgacatgttctaactgccattgccataagaaagttttgcccctcttctagtctgacacaagtacaatcccattttgtcaaacagaaacttgagtggtaatagcataaagggcaacattcctgtcaccttgggtactatatcagggctgcaagtgctgtaagtgcacctcaactatattttactattatgtttcccttgattatttcaagaacattcataatatgttctcttgattaaagaaagagtatgtaaaatgtatttgtattctttgtgtttgagcttcttaaggcttgatgccaaatgttcttggaggtaacaataagggaaatttatttgtttggtcaaagcgtacctttttggtgataacacatgacctcagaatgggatattgcaatggttagatcttggcaccttgcatcatgtgcctaaaattaccgatatccctgctcctttatttttattgtgaatattcatccagcttattgcctgttctctgctgacatggaactcaaaagtgaattgtatttcatttccttatactcctgagattgaaactgcagttggaagctaatgattcagttaaatatcatttcttgattaatcctatctctgtcaaatccgcactactcttagaccaaatttaagttatatcgggaaagagcagcagttttttgtataatactaacttgataattatgtttgcagagatctgtcgtacaacgaacttaatggttctattccagatagccttggtcagctggcatcgttacagatactgtgaggacatttattatgcattttgttttgtttgggacatgctttatgcttctccctgttatcttaaaagaatagctctcatgcaggaatctgaatggcaattatctttctggaagggtaccagccagccttggaggaagacctctacacagagctagatttaagtaagcactctcttttcattttgtcactatatgtaacctggtttcaatttgccacatcctccatatacgtaatcacacataccaatctagatacatctggctggtaattgctgttaatagaagattgaatgataacaagttaagtagcttatgattgctgaatgctgatatggcagcttcacggacaatgctggactttgtggaattcccggtttacatgaatgcggcccgcatttatctgtggctgcaaagattggtatggcttttggggtactggtagctatcctatttctagttgtatttgcggcatgctggtggaagagaagacagaacattcgccgtgcgcagaaattagctgcaggtaagaagcaatcataagttgttaaaatctgaatgcagggtgtacgccttttctgaatataaaggactgattgcccatttcccccttatattactgcagcaagggaagctccttatgcaaagtctcgaacacaatttacacgggacatgcaaatggcgaagcatcaccgcccacatgaaagctctcggagcggcaacgatgaaagcactccacatttgcttccttcctagttaattgttagctatggtgatttgttgtttgctcagttgattctgctatcaggttgagttgcaaaacaaattgtacatactaggtcatgtatggtgtatagacactcgtttttggctccaacgtttatggtacaggagcattatcagttgagagaaaggaatgatccagatcaggttgtcctattgcttctgaattctgatggaccaggtggtgtactgactgaattgcaacatcttatgcttgtgcaaattagcagccagattatctcctgtactacttttaagtttgccaaatgtaaattcaggggagcacctatttactgttatataaacctgaaatctcacctggtctgtcaatctgtaaatgttgtttttttttagtttcaattgacagtaatttatttcgagtggcatactgaaaatgtgttccagaacttatacatccctgcggaacagaaaagcaacagaaggtatgcagaaccaaacactgaaaaacaagcatattactcccagtagcacaggcctgctgcatatcagcatcacatatttttatcccatcctactgatctcatgatctcatcaggatgttttttttttttacttatctttcatacctcatagaccgtgtccacaccagccatgtgtgtgtgtgtgtgtatattacacacacacacatacatacatacatatatgtgtgtgttgtgtgtgtatatatatatataagctcgccgccggcgaatcaccgggagacacctgggatgttaacccattggaggtgcaggatgatctcgccggtatcggtgttcctgagcttgaggacgatgtcctgggacaccttgccgtccttccatgtgatgtggctctccgccgcgaagcagttctcctccttgtccgggtggatcgtcttcatcaccgcgccgtcgccgagatggctgtggtcctgcttggcgatctcgacgaagtccaggatgccgaactccgcgtcgcccatgctgtcgtccttggtgaaggtgtccttgtcaaacacttcctgcgtgcaggttgatgtttcagaagggaccagaggtggcaaccaaatgcttagaagtaggcttatacaagaatcagtgcaaatttcatatattatttaacatgaaaactaccgttaaatcaaaataaacgtttgagatttgtccgcgttactctaagtaaaacttttactcccggatttaacaacgagggaatgttttaccgggagtaaaagttttacttaagatgacgtgaacaaatctcatatgccaattttttttatccaacgatagttttcaggtttacgttacattttgcactacatattttcccaacttgtaatgaaacacttgatatcttgaaggaagaagcactgaagtagtgacgaaccgagaacggaaattatcaagggtctaatcatactccctcagttctaaatataaggcataaccacacacttaacccaacgagcaagaaataattattatcaacttctagttcacgtaatgtaaataaatataatgtatgcacccaataaatcaagagatcttgagggtgaaggagagtaggtgctagctagttacatgcatatacgtatgttttatcttataaaacaattttaaaaaatagttttacgttatattatgaaatagagagagtaattaagtatctaacttatgaattgatatacttaattaatataatatacattattaaaattggataattatttatctgggtcctatgacctcgagaaggataacgtaggaacaccactggctggctgaaggtactaaaatgtgagtggaaatgctgatgaacttacaattttaacaggcagcatcatgtttgtgattgataacgtgagttcctcgttccattctgggttgatggaatgatatcttatacttgacttgactttctgcacatcgcacgaatagattagcagaaatgtcaacaaagaagcatcattgaggataaggaagacaagaataagtagcctgaatttacaccatttcactatataaaacgaattgtcgtaaccagtaacatcatacaaaacgaactatttgaaaaaaaaatttctacttggttttcctatcaataataagtactacatctatctacgacctctctatctctttactaatactccctccgtcctaaaaaaactcaagctcatactacgacgtgacacatcctagtataatgaatctagacgtactctatgtccaaattcgttgtgtcacatcctagtactaggttgtctttttttgggacggagggagtatgagatattgtagagttttgcctgtctcatcaaccgcttttcatttaaattttttaacatcttactcccaacaagtctctcacgtccaaccatccaaactccttttcttctcaatctggcttagttcttttcagcaattccaaacgacaacttcattgttttcacgaacacactactgaacttatatagaaacttatttaaaaaattaaataaatatattttctaagtttatcatacactaaagagctttctcattttgcgcgtggttggatatctcatcctagaatcacaaaggaacgggacctttatctctacaaaataacctagaatccatttacacgtaacgtagaataaaaacaggggtggagccaccgcccggctaccctggacggttgcccaggctcatcagtgaaaatgctattaaatttgtatgttgttgttgaataagttgatgaaatatttatagcaaatactagttacagtgaaatttgtttgggctcaaaaatatttctggctctgcaacactgaataaagaaaggaacttggaaattaaatgatgctcttctatattcgagggtccctgatttcttaatctgttttagcttcgccattactccgaattagctgcttcaattccgcgttggccggaaatggtgtgactgatacaacgatcagtaagtacgtactactacacgtacatatatacaggtcgattgattaccggccttaatggagagcttgtgaatcaatcccatcagggctacgtataccgctcgctcgatccaaattaatcgaaacaaaagcatgcatgtgcgatcaggatcgattaaaaaccgagacgatcgacgacattacgacaaccaatcaaaaggtaattaaggtggcactcgcctagaagagcatatgcatgaacaaggaggatccaaggaaggaaaggagaagatcgatcgatcgatcgatcagcaaacctgggagccgtggcggaggacgacgtaggggtcgctgctgtgggtgagcgggtcgcagatggccaggttgaggccccgcatgacgcgcaccttgagcaagccaagcaggcactccatcgatcgatcgaacgagatcgtctctccgggctgatcagcctcctctcgcggccgcgcgcgtcgaccttattaccggagttaaagctgaaggaagaggaggaggaggagacgacgggcgacagaaagaaacggcaggaaggcaggcttaggcaacgcaaaacttgggcgccgtggaggaagatggagaagctggacgccaacgccgggcagccagccaaaggctttttatattttcattaactacacggatgcatcatgcatatgcatgatatttctgaaaccgctccaatccacctccacgcgccggtaacgctaccaaatttaggtaatactacttgtaggaacgatctgagtgctcagattataagggtatattaggcctggttcatttggcaaaaatttttgcttctgtgtgtcatatcggatatacggacacatatttgaagtattaaacgtagtctaataacaaaacaataaattatagattccatcagtaaaccgcgagacgagtttattaagcctaattaatccgtcattagtaaatgtttactgtaccacaacattatcaaatcatagcgtaattaggcttaaaagattcgtctcgcaatttacacgcaatatgtgtaattgactttttttttgtctacatttaatactccatgcatgtgtccaaacattcgatgtgaaatttgttttaggaactaaacagggccttagcactctctccgtcccaaaaatgaacatttttggacttcgacacagtattcaggatgctattttgaccaataataactataaaataagatgttttaaataaaaagagttatacattatgatagtttgtttaatgataaatttagtaacatcaattttacatgattgatcctttttttctattaatagttaaagttaaaaatatctgactggacaccatacttaaaaatgcttatattatactccctccgttttttaatagatgacgccgttgactttttctcacatgtttgatcattcgtcttattcaaaattttatgcaaatgtataagatataaatcacacttaaagtactatgagtgataaaacaactcataacaaaataaattataattacgtaaattttttaaataagacgaatggtcaaacatgtgagaaaaaataaatgacgtcatctattaaaaaacggaggtagtaggatggagggagtacttagttactaactctatagttaggggtaattttgagaatcaccgtcgctacccgttcacccggccatggcggccgctgttccacccagtgatcactgccctcgctctcgtagttccgtcgccgttcttcccagccatccttgcccaggttcgatgccgtcatattcgtcctgcggcacaagctctagtaaaccacgatggcctagctagattatgctaacagtaaagaggatcgtgaaagacgtttttgatggattttgttcggcttttcatgatttaccgtggtaagcgaaacctaattcccgatatccgtccgactgttagctttctgccatgctaaggaggacattgacgaagcgttcatttgtcctcctccctgacggcgatatcggcggccggccggccgtgcagtgcagggcagggaagggcagggcgtctcgtgcgagcctgcgttgcggcgactcgtcaaaacatgtcttccctccgtttcaaaatgtttgacaccgttgactttttagcacgtgtttgaccgttcgtcttatttaaaaaaattttgtgaaatatgtaaaactatatgtgtacatg

SEQ ID NO: 66628 - DNA, 1098 bp, Oryza sativa
caaagaggaccttgctattttctaattactgaaagggcaaggccactcgggatcaacacatcaacatctctgaactggtctacttgtctctgcaggtaggaggaagctagctcgtaaaaataccacaacaggccctatatatctgtgctctccacttgtggcgagagagcaaaactgcaagtacttctatagttccttgcacctaatgatatgagtttatatttctgaacagaggatcaaatgataaatggggactgctaagaaaagtgcaatctttgttgcactgctgtgcactcacattcttgtgaaccatgcatgtgacagtggtaagaattctgtttatccttcttttgcatttttcctcagctagtctattgttttgttgtttagtttatcttatgatatgtgatttgttgaccatccatgtgacaatggcacagatttttgctctcccgaggactacaacagaacaactttgtccctcaaacttatttttttcttatttttttatagtttttcagcttgtggcgaccttttctttactcggactagagatgcatttacccctttacctctcagttcttcctttgattctttaataactacaattttgatatttatattgaatggaagaaagtcaagataaaaaagtcacaaaatctcataaaaatggaaaaacaattcaaattcctcagtcataccaaatattataatcattgtagaatatcagatatcaaactggatgatccaaagataataaaactcagtggaaactggatggatcattgttacgagtaattttcctgaaacaccttatttctgatatctcatatctgatctgtattgcctttacctgaagcagatgtggtatttgggtacagtgggagtactggtccagagcattgggggagcttaagtcctaatttcacaacgtgctcaaaagggacgtaccagtccccaatcaacattttgaaagatgacgcagtttacaacccaaagttggagccccttgaaatggattatactgctgcaaacactaccattgttgacaatgtcttcaatattgcggtttgatctaaaacagatggttatttgtgt

SEQ ID NO: 66629 - DNA, 1230 bp, Oryza sativa
atttcagaaataaatttcaaggccaacttgtgggtacaatcattttgtttgcactacctaacacagtagcactcacacacattttattttgttctgaagtatttaggtgtaatgacatccccggatttcataaagcttgtgaaaaacgaaagcacaaaattgcagcataactcaatattctaaaatggcaaaaatttacagttttgtagtgagctatcaatatgcatatcgaaagcctgttgtaatgaagcaagggacaaacttgacaactaacaggtttattttctaaaattgttttggctgtttaatggttacctttgcaagaatataacggggtcgactgccaatccctctcacaatctccactagggctgagctcactttgtaattaatttctaagctttcttcaggagctgcaagataaaaattacaatcttgttaggagatcaaactactttaagaaaaatatataaaataacaaaacatatttttcctggcgtaaaaacaactgttgtcaggtaagtcagataacagtaacatgtcatgaattgtcattgctttaaaagaaggtaaaatagctgtcctcataagtactactccctccgtttcaggttataagactttctagcattgtccacattcatatagatattaatgaatctagacaacatatatgtttagattcattaacatatatataaataagggcaatgctagaaagtcttataatatgaaacggatgaagtattttttaacactgagttaggtacttcattgagcctccagggataccaaaataaaaatttaagtagtaaacatgttttaaaaaactgagctagacatttttactatagcacaaaattttcaggaacaaaaaaaaaactaatttggttaagatttggtcattacaaaggttgcaaataataggtgttagttctaaataagcttatttcttgcacttttagattatccatatccctagattgacaaattctggtctgtcttttggtacagttaatcttggttaatgccaacaacataagaaaaaccgatagtgaagtatctccaacagaatgttgagagaacatgataatatttcttggatcttacgtgcttatcttgataatcaaacctctacactgcacaccttgctcacaaaattcgccaaatggatgtgtctcaaggcattagcgataagtcaagatttaactcagcatttcaatctcgaat

SEQ ID NO: 66630 - DNA, 25042 bp, Oryza sativa
ggaatgtccacaggaggcaacccggttggccgttgtgtgattcgaaaagctaagttccaaaaacttcccaaaagaaagtccacgtgccgcatcagacatcactactctttgtgttgctggagggattccatctttaggtttgcacctgaggcacctgtgccacatccatatcttcccatcattctccccaggtaaccttacagaggcaagatttctaacactgattgtgagactgccttgtcgatgggtgtagcatcgaacatgagattctgcaggttccttgcaagattcacagcacgaaatctgccagcgaagaccatataaattaataaggtaataaaaggtttttttaaaaaaaaagaatagaaggaggaaaaatgctgcacctgattaaataaatcttcgcggaaatatctaccgagtggcttatcaaaattaccgtagaactttatgcgaaagagctgcgattgcttgcatacaacccctctctgaggacatgcgattgacaaggacactaaaatgctttgtggattatcagatgttgggaaatattcaatgtggttttcattatggtcacgtacagctaatcctgcatgttcttcatctgatgtattttgccaaccattatccaagtcactttcaactctatgaaaacgtggtcccattggtgagcttttggatgtctgaacaataatgtctgaaggtggtacacaacccttatcaagggaggatcttggagaacgaggatatataccattagtgacaccgatgtactctgcctgatttaagttaggtcccagaaaagatttatccgcagatagcgggttttcagaatcattaaggcaatttgcaggcatgttgcacccattatctgaagttttctgaccaacaatttgaaaatcgttaaaatcctgaagacagtaacttgaggaacagttcccaccatccacatgattctcaagtggaagagctgaaatatctgaagggatctttggtagtgttgcaccctcatctgcaagatatgaggtctcaagtgataggtgataggctgcaaatagtgcaaactgtagagcaagtttaaccctccttaactcttcgtgggatgtgcctcttagaaggatctagtaaaaaaacaaggtggtttgattatgtaagtcacaaaacaaagcatgaagccttacatgatcatggcaatttacaataggtaatcaatatgtaactttgatgatcattgagtcaacaacgaacagtatgatgcttaccgtgcagcccaaccgtcttggacaaccatcaaaaaacatcagtgtcttggcagacttcttgtttgcattctttggtgatgaagactctgaaactcgttcaatccagaatgtttggcactgtccaagccttaccgaagtaacattttcaatggatgaagcaatttgagcacctgtgcagcgtgatatcctttctagaagtgatctcttgacattcagaactaaagagatatcttttgcaagaagctgttgagcatatagtggcacgcttttttcaacgagcaaaacatgaggtcgttgggcctctatttttgcaactgcaatcttaaggtattccttttcctgtaaaatcataatttagagttcatcatttacatgttgagagcaatcagataatcaccttaactagaaaatgaatgatgtgtaacctgttcaagaatgctgtttatcgatgctagtttgttcgaagccttttggtgttccagtgctccccccaaaagaagcaatctagggttctcatgctttgacaccatgcgtttatgttttacattcttagaacaaactacacctttaatgaaagtactgcaaacagatgaataccatttagccccagcaataaaatggcaaagaaggtcatgcaattcttatatacatgttattcattaaggcatacctatcattgggattccctgatgctacacatttgactttgacatagtccgtgggatccatgctaccacctttacttgtatctggccttacaaaggtagccgcctgccatgctaatgaggatattatgtctgaccatacatccacaggatcaacgccatgaccttggagcagctgggacacaagagccctgaaatgcccatgcaaagcattccttaggaactctttatgggctatattgtgttttccttttattcccagcgaatcatcttcaccaccatgatcatggttaacacgtgtgaaggtattcgtatcaccaacatcattgccatcataatcatcatcatcgtattcaaaaaaaccattttcaaagtcatcaccctcgtcctgaggtggtggtggataccaaatgagtctgttactctcaaaatcaatcggtatcgaggtattgttctgctgttcatcaccgcaaacaggtgaatccacaaagctagaataatcgacatcttcagagccatggacagaattcaaagggtagacaggagagtggcagctcctcctggaggatggacttgtgtctcctagtcccaatcgtctcacgggactatctaccgggctcgaagtccccaatctgaaggtgtacatcctactaatacttgtgctcaccgaatctgtatccgaagtgtcctgagaaaactcactgtgcggagagaaataccgctccgagtcatcaccatcttcataaccaacactcctatacatccagcaaaccttattcagtgagaatacttttttcacgctatatcctcctggctatgcatcaaaaagctaaatttctcaccttgtcgagcatcggagaggaccaggtgacgagaggcgccgccacccggcgtacctcgacgaagacggcgtggggacgcgctccggcggggacaccgacggcccatccgtaccgtcaccacgctgctccatggcagcgcctcggcctccgttaataggccggaagccgaggtcgcagcgctcgccgcctccgccgccgccgcaatccgtcatcgcaaggtccgcagtccaagaatcgtacttctggacgacgggaactcccataaaagcagcaagaaccgcctaaaacgctaccggagtaagcccaaatcaagcacttcttgatctctctctctctctctctctatactctctataacccacaagaagaaaaaatcccacaccaaatcacagcaaaagccaaccaggcgaacgaaaaggctcacgaatcgtcagaggggaactaaaagggaccccagggagcgcctaatcctagcggttcttggcgtcggcgcagccgaggcattccgtcgaacacgtggggcgcagcaacgcagcatcgctcaatactccccaatccagcaccagctgcgcgactcgggaagcgtcggagaaggggaaatcggcggcggcggcgggtttccggcgggtagaggtggaggtgggggagggggagggggaggcaccacccatgggaggaagaaggaagctttttttgctggtgcgacaagaatgaggtagatatagagagaaaaggaaaggcgagcgggtaagacgattaaaaaaataaaattaagtttggtggggtagtagaatttttttttatggttttatccttccttttttaaaaatatatttctttccctttttttatttgtaatttaccttttcctttgctttaattggtcaaagccaatgggcaacggacttgtgttcctctcgctggaaaaatctgtgaaggcatttccttatttcatttgtcttttccatcatttcttgatatatatagaagtattaggtcgcgaatcaatttgtggatttgtgctgggtttgtttttttttctttctgttctgtatatacagattttgtatcatttgacatatcttgttccctattgagacttggctacatgtgtgtgtgttttgctttatcttgtactcttcgagtttgtgtctatggactgctgttgttcacaaataccacccatcctaatcatactgatagttttaattcaacataagaatttcattataatggagaacttttagataatgacactagttcatttttcaaatatcaatcttataagtagtactctttagaaaaaaaaggtagatggattcccttatctcaattgatttgtatattatgcaccgcaataatgcaattttgctgtggtcttatctcaaacattatgtccataataaagttttatcattactacaccatcattgctctagattacactgaattgatttagccgaacatgactaatttgtgtcgcatattagcaagcgtgccattcttccggcgcttcaactcgtgccattctcattatcgtcgtccttttgtctctaacccattttctatccacgtacctgtaaaatccctcggtagtctcattatccaaccatggtcatattgtaaaatcaaagttgaacaattagtattggatattattggttttgatatttgaaatttatttacgaagtggttttggagattattggaatttgcaggtgaataggaactgctgcttgtgatttgggtccggtcagaccggacaggtgctgccagtcagaccggccagcccgcggtctgaccggccaacactgtatcggtttcggtttcgggttgtttatttagatatccgtgattgtttcatatttatggcttctagatagatactatgcgtatgtaatactgttgtttgctactaatgagtcaagttggagatagcttggtctcggaatatagttttttttgtttaattcatgtgtaggtgacttgatgcctcaagagagtattgccggtgatagatcgggagtcggcttaggaataagacaatgtccatgacggtcagatatcatgcgggatacttagtctagagttcaatgcacgtggttgatgaagattttatatggcatacgatggaggtattgtgtgcgtataggatgcggagttgaatttggaaggagtccaaatttggtatgattggttatgcaaagtttgtttcttgtacgagaaggtttcctaggggattaggactttagtatgagtttggttcgtggctttaggctgtctacctcatatataaatagagagggagcgtgaggcttcccggtatcgcttttgagagcaattgagttgatagtttagttagggtttcgagtttagtcgagatttttgtaaggagtgctgttgttgcactttgtaaatacagagagaagcaataaagttgtcattgagagttcttcgatttgtgtttcatcggttttggcggtctaaccggcgacacaccggcggtcggactagcggcaaggcagcggtcagaccggcagcgaacctgcggtcagaccggcggcggcttcaggcgacggcagctgatctcggcggtccaaccgggcgatcaactccggtcagaccgacggctatcaagcggtcagaccgtgatccgtcgaatttcaaggtaacttttatttctgctaaaagtttgagtttttgggtataccaaccattcaccccctctctggttggcttagttctggtgtttcgatcctacacatatgaggataaggttatctagtttttttcatggcaaagtttcttacatgacacttaaagttcatggtatttattgtaggacaataaaaaaatatgtactccctctgtcctcaaatataatcatttttggaacttgacatagtcttcgagattctaccataagcaacaatatctataaaagtaagatattttaaataaaaagagttgcatattatgattgtttgtttaatgataaatctaataacatcaatttaataacatcaaattttacatgattgatcattttttttgcttttaatagtcaaagtaaaaaatatttgatttgacactatactaaaaatgcttatactactcctatgagataccactaaacatggtaattagctgttggacattaaacgtgttatatatttggttcagagagagaaacggtgtggaaagtaccaatttgcctctatgtccattgtcatgcctagaaatttagccaaaaattccagactatttcgtgtattaaatccctatccaggaatcggccagggtacacaaaacgacaaatttatatacaaacccaagcataaataaagcgtaaatacttacagaagaggcacttagtcctcatatcaaaagaaaacggcagcagcggaaaaagacgatcctagcggggcttcagctccactccacaggcaaaactcaactagggtctgaaccttgatcctctaacttcatcttcggctcaggagcactacacttctgaaaaggaggaataatagcaaccaacgtacttagcaagccacaccaatgatacatgtatgcaagggaatacaaggatggtttgtggctatttgcataaaggcagatgtaaaacatttattgttgaaaatagtaaaaacagttgattaattaaggcaagattatatctccactgaacaaagctaccccacgttgaacaagcccaaccaacccacctgaactacactagttcattaggtcaagttattaagggcgtaagattaatcacggtgattctgggcaatcacccataaccgcgggcacggctcttcgaatagatttattttggccagaggtgtacaactgtatctacaaaacacaatccatcggcatgtcaccgtgcctgaccagacacatcaccatgtcgagtgattgtgacaagactcttcgcataactccccctgaccaatcgatgccacacctcaggtttcaccccctctccccagcaggcagcgggcagcaggcagccccccctcatgcctaggtgaatccggaagcagcaaaggctgtcacagggcccatcctaattccatcacgctcacctttgccgcagtacgtcagttagagaaaagctatactacaagtcaacaattacccattaccgcttgtggtaagcgcagtaagtcttccagtgcatcccgcgaaccggtccttaattgccatgggtgcgactagcaaaaccatgcactcatagcccaccattcagtcgcattttagttggataattacgactaatgaaacatggccgggtgtcccgagcacgcagctcgtcatgatactaagtgtctaataatgtaattatcccattatgtgagctagtggtaattaagcatggctaagcatatataattctagctaggtcaacataagtaacacaagctagtcaaattatcccccaagtttgcaaggaatggatatcaagtaatatggcacaagcgaacagataggtaatcccgtaatcccatgtaagcaaaacatgcaattttatttacaaacggtaaagcatttataaagtaggctcaatattttcatggggaatgtgtgacttgtcttgcttcttcaattcaatcctctgaactcttttcctcgcaaccatgatcttccgaaacgacagaaactacgcgctggcacgcaaaacgaggaaaaactctaataaaaaccaagtaaacagtatacataaaaagtaaaccaacatgcagagctcaattttagatgaattttgcaagttgaatggcccaatttggagttcgtaggaattagttatgaattctagaagttttgagccatttatatgaacttctataattattactcgaattattgcgcaattagtacgatttatgacgtcagccgagggaaagaggcggcgtcgacaagcgggccccacccatcggtgactcaaggcagcgggcgcaccacgtggcgaccacgtggcggccacggtggacaagcgggcagagtggcgccgacgtggcgccacaaagacaccaacacgggccagcaccgggaggccacgtggacggcccagattcacctgaagtgaatcgggttgccatgggcgagcgaggtggcaaggctcaccggcatagcggccgggagatggtggcgcctggcccgatggtcgccgacgacgactaccggcacggcggcacgcgcgggaggcagccgagagaggggataagggaggggagacgaaggggtgctcaccgagcgcacaaggcaaggaggcggcgcgggtggacggccaacggcgaggagaggcggcgaccggggaagagcgtggcgcggcgaagccagcgatgcgggcggcgcgtcgcggcggcagccggggtgatggcaaacggcggccggaggcggtaaaaggggcggccggtagggtggtgtggcatggagggggtttcggcgacggattgagggcgcgaaggggaggccggagtgcgacgtcatgcggcgaagccggcggtggtggcggcacaacgcgacggtggctagagcggcgaggagcggtggttggaggcggtaaaaggcggcggtggctcgggtttgtggtggggaggtggttctgatggcggtttggggaaaagaggtaggggccggggtgcggcgtagagcggtgaagccgacggtgagaacggcgcggctcgcggtggctagggcggcggtagcgtgcggccggagggcttcggcgagcggcgaaggtgaggagcggcgtggggagagcgatggaaggcgcggcaagatcggggagttggggaaaaagagagagggaggtgtggtgagcatttttatagctcgagggggagaggagagggccggtgagcggcagatttggagggggagtggggcggtgtcgtggggtggtggcggctcggccggcgccgaatagcgcgggacgagtgggggataagagagtggaggtggaggggatgggcggcgtggtccaggctcgcacgggagatggcgcgaggaaggcggtgacgtgggaaggtggcggccatggcggtttcggccggaggtggaagagagagctgacaggtggggccgccgatcccacctatcggtgaagggagagagagagggaggcaaaacggacttgaggggaaagggggagctgagcgggctgtcgacccaagggaggagaggggaggccggcttgagagagagaggggcgcgcgggccgcgggagggaaagagggcttgggccagaagcgacccaaagacaaagaaggggatttatggttttttattattataattacttattgagctctgaaaattcacgggaaatttcagagaatattaaaaaatattcctagccatgatttttaaaggaaaattttaattctctcattatttcacttgattaaattgcattaatttttaatataatttctagaaatgatttatttaatgatttttaatcccgaacgaaaatcagggcgatacatccatcggcttatagggctattgggtctgactattcacactcccctgattcgatccttctcactcctctagtctgagtctgattcgaattagatctagtcaagttaaaaaaaatgaccccatgtgtaaacttatcttttccaaaaatttctctctatttacagagaatataataaaataatcattatgtatcccgtagctaactaccatattttccttattgtcctttaagtgccctgcagtaaataccgcaaattttgaatgtcctgtagtaaattttctctttctcgttatgaccataccggtctcattctcactcattttcccatgaatggaaaaaataacaaaaaaaaaccttattatatcagataatggggtcaacctagtctaaatgaatccagtttgacatcaaccggcacaaaatcaagggttaaaaccccaactggttgaaaatcatattatgtttgataagtggttggttttgcccaacatatatagtagtttccttgctaaaaattacttaaaaaacatgaatattagggaataacctaatatcaaagccttcgaacccaggtcgactagcacaccaccttgtgaagctaaccggaagactcatgggcatttctcttgctagaaattactaagtaatcgtgtacgtgtatgcacgcagtggcaaatctatactttccatatatagttagtacccactaacaattattagaagctaaatctcaacatgcaagcatgccacatcatcacccactagcaattactattctagcctatttaaaatcccatgcaagcatgccacatagtcactcactaataattactattctagtatattttaaattccatgcaagtattacacatcatctacaatattatacaatattataatatagagatcaacaagtatatgtcaaatcatctttctcacattattttctcaacatttcaactttcatcatttcgataatatttaacatatactcatctatgaatcccgcagcaaagcgtggggtatcacctagtataaactaaaaaccaggtcaagaaacacacctttcatgaattatcctcccgtcctgacaataacagcagcttaattgattgttaattatataggaacaataatatggtatcaataagttatggggataattccgaacagttactttttatagtagtaataataaagatgcattaaaccaatgattcgtacctccaacgtcctaaaatataagatatatacttcctcgtttcacaatgtaaaactttctagcattattcatatttatatagatgctaataaatctatatatataataatgtttagattcattagcatctatataaatgtgggcaatgttagaaagtcttacattgtgaaacagagggagtaattttgttcgatgggatacatcctagtactagcatgcgtactatcgaactaaaatcctttatattttgggacggatggagtattagataatgatcctacaatttagatcgaattatgtatgttttctttggtgcatctagcaaagaataaacttgtttgtttgttttatatagatgtagacatctatatgatactttaaaaaaagcaagtagctatgtttatgaagaaaaaaaagagagcgtatgggtaaaaggcccacctgtcaggcaaaaaaatatatgtaaaattaggagataacaataactagcttgataattatatgacaatgttcatattaaaatttctgttgtaacgagctgacaaatacttaccagtaaaatactagcctataagtcgcacgtttgcgcgactataacctatctattagatgtatttatatgttatttgtgttaatgggcctaaatatataataaaaattaaaaataaatacattttaaacacattttaaagtgtagctataaaattaacaggttctatatcttgatttgtgattaagaatattatctaaagaaataatttgtcacattttacaacattgactccttcagtttctaaatctaataatgtaaatacccacatcctttacacgttgagaagtatatatatagtttttatcgtaaatcttataatcacatgttaaattatcttttcaaaatttactatgtcctccacgcaacatgatttataattttaaggcataatgaataattgatagcattaggttaattagttattcatatatacactaatactcgttatttttgatacaatagaactactataaatatttattggtgattttttatgtggccaatatattttttttcattttaatacctttcttaccacatatctcattggtgttgcatgaacattgttggttatttatttatttttttctcttccgatccagcagtcctctttgttcaaatcgtgcatcgaacggttaatatttgtttgatgatgtagctcatcttgatggtattttggaattccttttcacttatgtgacggtaggaaaaaaatatgagcatttaattttgataaattatctgattacacacaacagactctatagggtacaaagcaggtgattatttacccccactgaaaaacttattcgctaattgcgtgtcaatggaaaacaaggcagatactatcgggaaatgggccggcatatcttttcattgacgtataccaaacattaaaagcatcccgaaagattggaccagtagcacatccgaaatgggccggcatatcttttcattcacaaagtcaccacgcattaagaggctttttctacgtgggtgggataacaacctcgagtaagatgttttgtgaaaatccaaattttcctagcagacacctaaccgcatgcgaaaataattatttttcacaggctagcacgttatgaggaccaactacaagatatttcggctaaaagacttccaaaagacaaaattccagaaatcctagctcgatccaatcctagtggcatagtagtcaccggtgaagccatcatcatcactaccgcagtccatcgtcgacactgcccatgcaaatgagtgccgccggatccgccgttgcagacattgccaatgccatccccaaccttcctggcagcagatctgccgttcatgaggcatgcgtccgatggattcaccgcctcccgggatgtcgcagtcgattcaccgccttccgtgcaaaggatgtgcccttcccgccatcttgccatcggaggaaagggagccgacacatagcttcaccgctagacctccttgccgatcaatccatggtcatcgctaccgccaggcggcccagaccttatctttgcttccgccagacccacctcaatacttatccaccgtcagtctatcgctttgtgagttgtgtgagaaaggatgtgaggatataaggagtgatttcatctgtgaaaattacgattttcatagtcgggcttttaagacggctgccaataaaaataatcatatttttacaagctaggaagcatatccgtaaatattaattttcatatacgggtattgagagaagactctatccattttcacatgcatgtctttatttaggtcacctataaaaatataggggttgtttggaaaaatagtttattaagtagtaacggacgtttcgccatcaacgagtacatcacctaccataaaaattagttataaatatgagtataccagtgtcaagtttagaaaagcagaccgcgccttaagaaacctaaccggcagccacaagctacaaatagtagtttcttaaaaagtaaagtataccgtcagtccttaaagttagagcgttgtgtcacttagatccacgatcttgtaaatttgatatttaggtccatgatcttgttctagtggatcagtacaggtccaaagtccgcttgaccgtattgacctaccagtcaaaactttgcacttagccccctccgcgcccgatcccaacctcactctaacccccacacttgcattgtggcgacgactctgagcgtggtgacggtgatcgtgggcactctatggtggccagagacaagatttggatggcgcgttaagccgtcagacgccagtcgatcagctgaaggcggtggcgctgtcagtagtgttgaggaagaagatggacctaaccttgcgggggaaggtgaagaggtgcctgtccatcctctttctatccccttccatttctctagttgaatctgtagtggtgaagcttggtgttttacgcaatttcaacgtttatctctgtagcagtttctaaggtttcacctagcagatgattagcggatcttgccatgctaaagctaggtatttaattagttggttggtcagttgatcttggtagtaactgacatgtaatctagggtttattatgttgcctgaaattgaatttgtgcactatagatcctacattgaagtatttctcaattgaatatacaggctgcttcacatctgcccgcctcctcttcactgatcaagccagacctctgatgatacttgacatacccctctttccaataccagaagttatatccagatccgtcattctacacataagttatatccagatccatcattctatacacatgcatcaatggcaaccactgttaggttggtcgaccagccgcatctccactgctgttaccaccgcaaccataaatcgaaagagtgaagaagaggggatatttggaggagaagtgggtcgaccggacatgaaaggggttaaatgcaaagttttggctatattggacaaccacgtagccaggtcaacggtcatacgggctttggacctacaatgattcactaaaacaaaatcattgatctaaatgttggatttacaaagatagtggatttaagtgacacgtaccatgccccaattttgaggaccggcattgtaccactactggagaaaccatctttggttgattgcaaaacccacaatggtcccggttgcttaaaaatccggactaaaaagtatttttagtcccagtttaaaaacacaataggactatgtgatctttaaaaatcaaaacgctctgtataattcctaatacttatcatcttcttccgtcctcacaaactcctctctcctctatctctttttcctctaaccttatctcttttctttctcactccttatctcccctatctatttctcagctgagcgagtgcacgaggaggactcacgagggggtgagcacacgaggaggacgccggccggccggcggcagagggtgggctggccgggcgcacgcggaggagaccgggcgcatgaggaggaggccgggcggcggccgggcacgcgaggaggaggtcgggcgaccggcggccaggcggcggccgggcgcacgaggaggtgcaccgcggagggttggtcggctaggctggggcggcgaccaggctagggattttaggatttgtgatgaatttttttgttgagaattcatgatgtattttactgtgatgtgaatatgtgatgttttttcagaatgtgtgatgtagccatctttgagaatttatgatgtatgatatgtgatttggagatgatttggggatttcacgatttggggatgattgatctgtgatatagagatgatttggagatttcacgatgatttaggaatggagtgaattcaatcttagaaacaattaaaaaaactaaaaaaccaatcgggacatgccctcttcctcttaagtcccggttggttaaccgggaacaaagatcttccatctttagtccctgttatttcacccaggactaaagatagctatctttagtattcctacagggggttacgaaccggggttaaaaaccctttctccagcaattgatggctactcctatcaatttttacttcacaagtatttgaatctaaagtttgaataaaaaacaatactggtagagttagtttactttgcagaaaacattgggcataactaaggacgctattttgatagatctaaacacaataaattaatagtatgtgataaacaatcaaaaatagatcaaaacgattataatacaatcatccgtcggaacatgcatcacgaaatataatgtacaacgcatgcaatttcacaattgaatgtgaatcaccttttcttttctaacattggacttttgaaatgaattacagaaaaactactcaacagtatcccgtacacgactattagctggcatcttatcctcttcttcttccttacctcttccccttccctctccccctctctctctgactaccaccctcatgagcacagagacgacggcggcggcttgctgtgcggggtggcgcatcgggcgtggagggcgctcggcccgctctccttcgctagtgccggggaaggcggtgccatgcggagctgctctcgccggctcaggaacgcgcgacggcgaagcggcgtgcgagctctcgtgccgccgcgctcgccgacgaggaccgcgagctcctccgtccctccgcccccacgcgacagtgctgcactgccgctgctcccctccatccatcctcctctccacaccggcggtgctgtgccgctgctcacatccattttttcgataccctgcaggtacccctcgcactccattcaactctggttgattcctccaccccccccctcctctacaccggcaatgcttcatcatcgcttgcatcccttcttcatgtgtgtttttctctttttttgcttgatgatttccttgctgattttttctccggcttatatggatagtatcaattcccctgtcccatcctcttgaatcccttcaattccacaggtaccacacaccatgcagctggtactatactggtaccaggtaccaggtatcaggtatcaggtatcgggtaccaggtatcaggtaccagcctatgctggctgctttggctgtagaggagcgatgccggggacgaggtatcacgcgcatgatatcgaggaggaatcggataggtatcgcacctttgaacgtggtaccaggtcccaggagggagcacacgtggaacctcacttatacaaaaaaaaaaaaaagagaaagggatgagtcacttaaaatatcccatagtaatcggatcccgttgtgtagctgccctcaatgaaataacatattacttacgagagaagatgtactggaataagttcaaataaaagtgcaagattaacttttctttatcatatttctaagtagtaacttattatacggagaaaaactaatgatattttctaagtagaaattaattgtggaagataggaaggagtgtagatcctctgcagtactactggtgtagtagcagtggctgacgtgtgggcctagtactgtaggcaatccctgttgaggaaggagtgctttcatggcctcgccaaggtatgacgagtgtctgaccttgaccatgtcctccaccattgcttaaattggcatcaccaaataaatcatggtgcccttagcactaaaaccggcaccaataatttaattattagcaacccgacaaacaagatgacttttaagatctttgtcgagtatctcgcaaatgatgtacttcctccgtttcacaatctaagactttctagcattgcccacattcatatagatgttaatgaatctaggcatatatatgtgtctagattaattaacatatatatgaatatagataatgctaaaaagtcttatactctgaaacggagggagttggaaaaatacctaagactcactattacatataaacaactttatatggaagaaccctaaaacttacttattacaccaaaattagccactttggtggaactgaagactctctcttattgtgtgtcttctctcgcaactcacaaagcagatcgtacaagacaaataatgccttgatgttcccttctcatctattcgcagacatagtaacatcagcaaaaaggtgccaatatgagtataaaaactgtcatgtacacttttaaccaaatcgtcaacatatatacggttcgacattattatatatacttacatgtacacctgaaagcaacttgttaatttgtttaatttggcgtcagatcgaacatgtttaagagtaatcaaggtcgtgtccatccgtagcgccgctctagggatatcattggacgatgtaggcctattttaacacattttataaatgccagagctcgatacaactagccagcgcaggattaaaaataatgttgtttttaggagtacattttgattctacactcaatacgcgccattctcacgttatcgtagtggttccgggtgtaatcttaacaagtagtattttataatttgaactttatttttaagccttaaaattgttttggtccaattttgaacttgcaactctaaaatggttcacttttcaacctttactattaaaaacagatagaaattgtgttaagcatggtcgatctaacgccaaatcaaacaagagcatttcttatggtggaaacatgtccatccagatttaagttctaaactttacacatatctcatatttacacttagtcattgtttcagtaatatacaatgtagcgccggtatggccgatctcttggaacgctgtggtgacttcgtatataggcgtttgcctttgagttgtgtgttaaaagaaaaaataacagaaattgccatcttcatcttaacccatccggttttggcttacgtggaattttcatatattgtgtgcatggcctccacacatgctgacatgcatgcataccaacaagtaataagtcagcaaattcagtcagagagaattgaaacagccggcatggcccgctcaacagttatgacagtcccttctttccattcatctctttctacaaatgcatgagttttccaaaaaaaaaaaagaaaaaaaagaagagacaaaccgaaacagtgagctcggatcgtgccccattacttaggattagggtatgaacagtagtttataattagttatattttttattatgtcatatatcacatttaataaataagccatctgtttagctatcttgaatatattcatatataactaataatgatataattctctaaacaacatatatagtgttgattgtgttataataacaattaatagctagcccataaaaacgttaactactagactaatctacttgcgtgtagaagagagaaacctctcttagcccaaaataaaatgaaattttgtcgtatagggatggaaagggaaaaaaatatgataaaaatattttggtgagaattaatggttggaaactttatatattgttcaaccatggtaagttgatagcctctataaaacaaagtatcatgctatatatgaatcgacaacaactcattttttcccctccgcactaaaaaaaattatgtcgaattttctcctagacacagacactattatttatgccgttttttacttagttcgaataagattgatggcttagatttttcggaagcatgtgaaatgatacaaaccattgacacataattaatcgaatattaattattataaatttaataaatgcatttatttgattttttaaaaggaacttctaattttttacgaaatgaactgtttagtttagtagttcgagaagtaagctcacgaaaaacgatggagcatcatagtcgagcagctgtttcgaacacaaccttaattttgtttatccacctacatgtaccaaattaagattaaggttgagaattgattttttttcattagaaggtttgtttaaaaatttatgaatttttcgtgtagcctccttacaaaacatacaaatttgtgtatctgttccaagatatctttcatgtattattcaaaaaaaatatttacgtgtcatatatgagagaggaataacttgtgcaaaagataatagaaaaaatattttatgtatagcatactccctcaatccaaaagtcacatatttctgtggtcaccaacaccaaagatcaagaaatcatatcatgcatacaaccaataagtattaagatgactgctcaggttctcgtcaataatttattctagccttatactctctccgtcccattttaagtgcagtcctagttttccgcgtccaactttaaccatccgtcttatttaaattttttttgaaaaaatttaaaaatataagtcaccagtaaagtaatattcatgttttatcattgcataacaacaaaaatactaattataaaaaaatttaaataacaccgtgtttagatcccaaatttttcttcaaacttccaactttttccataacatcaaactttcctactcacataaacttccaacttttccgtcgcatcgttccaatttcaaccaaacttccaatttttgcgtgaactaaacacagcctaagacggactatcaaaattaggcgcgaaaacttatatttacacttaaaatgggatagagggaataaaacaaaaagataatatttttattgaaatcttggatgcatgaaaattaattacaaatatgataatttctttgggaaaaactgaaaaatggaatatgcttaaaacttttgtacggagggagtataaaagatgatttacgataaaaaaaacaactaaaaagtattactccagatagggcgtacattttagcatatatacagatagtgtttccagcaaactccaaatgcactcctgtatatagtctggcttgttcctcgtgtctcgttctccattctccactccccacggctccacccgtccttcctccgagcgtcgctgggactctcactggaacacagggcccatgtagcgtgtcccagctgcacactgcacagcgtttttaggttgaacgttggatgaggtggcccccaggacagagaccggtgacgcctaaaggcgattgtttttcttcttttttatttcttttgaactgttattaaaggcgattgttggtggaagaaggccaccggattaggatagatagaccaacgcaacgaggagagacgtgcaggctggagagattgtgcatgccggagatgattggtccgtttcgagccgatcgcctatcgcgctcttgggcacagaggggccccgggccctcgaggaaggcgggagagacgggcagagacgcatgatggacggcgtcgccgccatgcgtgacgcatctgctgcactgcagtgacaccgtgaggtgagacagtgcgcggtacggtgaaacaaaaacgcgaaaccgacgggcagggagctcatatattctgcacgttgaaaattagaacctactatcatgcagtgaagattcacagataaacttcagcaattatggagccattgtttcgcttattcgtgaaataagtgaaatgtgtatttacaaaaaaaaagtaatttatatatataacttttatatacgtgttcttagtgatctacaatcaaaggctgaaaaataaacttcgatgaaaaaacctcgaaattagctccaaatttaaggttaaaaattcaaattctggcttataagtataagtataagcgaaaagatgatgccattttttctccttatatatgttggttttattgttgtctaagtatctgttttcttgtgagaattttatattaagtgattgtaacttcttcaaaacatatagcgaaatttttactccattatagaaagaaaaaagagtagcatgcggaaacgcgcaacgagccaatgcgaaaacatgcgtggtggacgcggcgtctccccgcgagaaggcaccggtgtcacggtttggtttcttcaggagaaacatgcgcggtataagatttttctgtacggggtttgttgaaagatgcgcggcaatgaattgtacgtcaagtactcgagtttttcttcagcgacttttcatgaataatgatcaactaaccgtagattaactagttgcttttattttatttatgcgtggaaaaaagctagtttcacgttaattaaggccggttttacactgtggttttggcttttgggtgatccggttaccaccacattaactagtataaaattgtttcgcctataaaaaacaattgtattataatcgtattaacaatttgccacaaatagcttatttgacattggtctggcagagtctaacctatcaaaataacaagttattaacgccccataccctctccgattttctctgttttctgaattttttcggctcctcgaagaggttaagcgtgttttgctattttgcaaaaagctcctcatgtttattaaaaatatcgcacataaccgactgacaccctgtcatgttttatccagaaaaccccttgtcttccagtgaaatacaatgtgaagaatatagctaacaacttgatgataatatcttagataagatgttgtgatgtatgggccggaatgaatcacatatgtcagtagttttgcaacttttgttatgtaggagtatatatactcccttcatcctaaaataaataaaactattacgagatgtaactcatcctactactactcaaattcagagtactaaaatatgccatattcccctactaattttatttattttggaacagaggaagtatgtgtcatcactttgtattgtatgtaatgtttttcatcatgtaggtcttttctttctgaacaggatagattataacaaatgatataaaagattacagaacatgtggttacaataactatacataacaatatatcgacctaaaacaaagaggctccacataatgtaatattttaaaaaacatgtaaccataatactgaccaactctgacatacgaaaaagcaaatgaacgaatatcgaccatcatatttgttcctccaacatagcagcaaaccagtgttgccgatcaatttagcgactcggacttaaaggctaaagccaaagccatttattcgatcatcggcaccttccaaaatctttgcataggacctcacaaaccaagttgccaataaaaaaaagaagcaaaatctcccaggcctcagtgttggcgcgatcaatgcacatctggcatgtcaagtggaagatttcgcgtcaacaatttccttctcttcctcttctccttcgcgagcagtgctgataacatgttcagattaaagcgagagcgagagagattgagcgaagaggattagattctcattgatcattggtacaaatatatatagggaatcggttatggacgctatggatggataccaccgcgttggttggaatggagtgccttgagagggcaaggagatgcgaggcactacacaactgcagtgtctaaccaccatcgggcacgagggtgtcaatcccatccaaggtattgatgagatcacccagagtttttataacataatagatctaatctccagagtttattaattaactcctaaaaactaacgagagaagggacgagaaaagtctcccatttccctcaactccggtggcagcaaggatgctcaaggtggagaaggtgggccaaattggagtggcaacaaaggtcctactaggtgtggctattacttgttgttattatatatggctatgcagaaattatatggtgtttaacaaaaggaaattttcatttcctttgcaggttatatgtctagttacatacaggttttgtacttgggctattttttagaagttgggttcacaaaatttggttgcaacggtatgtcagcactttgagtaagtggtcaagacacgttccccccccccccagaaaatagatggcgatttagcctaaggattggtttctcacaacttttcctatattctctaattgtaataaactttacggttaattggatccatgccataaaaaatatgttggtttcaaatttaccactagtattcgcgtatttgggccattataattttacacatgtttcagatatgccattacttaccccttggattcatttatgaaaaaaaaattgaaccaacctgcccctttccccttcttccttctttccctttctccttcctcctctcttccatggcgtgaaagacaggcgatagttcggcaacggcagcggtaagcatgactgacgatggacatggtcactatagccgccatctccttcctctccagcgctccttcggccaggatgtccgcgcctccctccacctcgtgccgctgctggtgtcctcctacgcagagctccacaccgacgacagcgttgccatggggccctcggtccccgccaccgatggcatcttcctccaactaccctgacgatgcggctcctccctcccctagtccctcgttacaaatacacaaagagtaatggtatatttcaaaactgacaaatttttaatggtatagatctaattaaccctaaactttatatgtatgtagggatgaaaacaaatcagaaacggaagaaacccacctctaccatttttgtttcctttttttttcagaactggaaaccccgaatacaaaaacatgatcgaatattatcaactacaaaaatgaagtgaataatgttatgaatatttatcaaaatataaaaaccacttaaactgaacttctaccttttttttctaaaacaatagataaaaaattccaaattttagcaaataacaataccactttatattataagaataacatcacaattcacataccacttcgttaaagtccaatttttcatcttttgaacaacaaatattgcctagagaaaatttcaagttcttttccgagaaattttgcggtaagtttatgacctattccactttctaacaaatagtgcctttattgtattcgttttcgtttgaggcaaaaaaaagtccgaatctgttttgttttctaaaagtttttgaaacaaaaccctaccgttacttcttgttttcaaaaacaggtccagaatctggaaactttctgaaccgttttcaaccctcatacgtgtgtgttggatcgggtgtattctagttatgcataaatcgggagggttctcaatatggttcttttttttatatataaaagactttcaaaatgatttgagttgaacaaaagttcttttatcttttaaaaactcatctcctcttttgactgggaaagcgttttgaattctcgagggggtgcccactcatttgttcaaacactatccaaatagttgttaataattctttaaaaaatttgttaacattcataacatgtacttagactactccagaaaaattaagtcaaaactcaaccccacacattgagaaatgaaatagacatattcagatgtgaatagtgtgaataatattactattcacgtcttaatcggtctttttcatttctcaatgtgtagatagaatttgaatatgatttttagtggagtggtagatgttagtatactctaagctggcaaaaacaaatttagaattttttcacaactatttgcattgaattggagagaaatatttacactaggaggtatcccctcaaggattagaatgttcttcctcttttgactacattatttgcgttggtaacagtttttattttccaattaaaaccagaatagaaaacatgtatagaaaaaaaagaatctatgtgcgcttaaaggaaaacatatgtttttccttttatgattaaacatttggacacaagaataatcgatcagcacatgaataataagtcatacaagatgggtccttttcgatttgtccaatcaattgcaagttgattctggaggaaaagaacattaaatagagtaaagaagacgtctccagtattatttccgcttttgctgaatgtatatattcaccaggataacaaaacaatggtagttaatgaaccggtcagttacaccggactaccggagacggttatatatcccggtaagtcgctgtgtatcaattatctggataatttaat

SEQ ID NO: 66631 - DNA, 3364 bp, Oryza sativa
ggtaatactatctttgcttataaatacacaacattattgactttattaaaataaactatgtaaatgtgatttattttgttgcgatttgtttcatcgttaaagatactttatgatgaatgatcaaactcatgtataaaagttaacaaggttgtatattttaaaacagtgggattactattagaatttggtaactactcaaaatttgaaagtgcccaacctattcaatgaaaaaaaatagcaatatgtaaaatttgacattgtactaggtcttaaactaaataggatcacaaagttatgttattcaactcaaaatttgttttcaagttgatataaaccgtatacacagattgagatcttttgtattagcacttgcttaaggcagagttggcattagccccaagggctctttgatagaaggaaaatcgtagtaatttcgaagggttgccatccttaggaaaaaaaatctataagggcatgttcaatggtagagacgagtatggtgtcttaaacaagattatttaagattatttatagaccgtatgtttacaatagttgatacgacaaaggctttaatgattaacttaaaaaatattccttctattaatattctttccatttttttacactcatgcaaccatatttttatattatagtgattaagagccgttgttatgcataacaatgatgtttttctctctttctttttcttccatgtcaacaagtatttctaattagcaccgctaagagaccactattgataaccattgtacatgccctaacaacatttgcaacaaaggaattgcaatagcatctcacgaactgcaattcctacgcattcgttatgcagtaaatttagcataagctcacacatcatatttcattttgttttgtttagtccaatgcacactccatttgatttcctccagattcctgtgaaccataaacatccagcgtccctttagaatcttgtagtattgtgtagcatatgactatatttctacggttttcctattcgtgcgttttaaattttttttgaatgtcttaaaaatcatatcgtccaaagatacttagggtgtgttctaaagttgttttgaaacagattattagccacacacaaaacgagaaatagatttattgagtgttaattattaaaaacttgaaaaacgagtttagcaacttctatatagaaagttttgtacaaaatgcaccgtttaacagtttgaaaaatgtgctaataaaaatcaaagaagtgccctagccgaaatgtagtttagaacatggcttaagccctctatccctttgtgagtatgattatgaatttgtgaccaccgcccctttctagtgttttgtgtatgttaggaggcacgcttctgagtatgcatatggtaaatgtgtatagcgttatgtgtatttatgtatcttctatgtaaaaaataaaacttatataagactcaacatgaaaaagaagtgcatttgggggctctgcatgattgagaaaacagagaaatagaaaatgcatagaattttgacatgcagacaagcgcaaacagaggtttgtaacacatagtaaaaatacaggaaatatcgtttggttggaccatatgaaaaacataggatttggatgagaaagatatattcataggaaactatttatgaagttgaacatcatattaaaaattatccaaaacttgtattaattgaggtatcccttactcccccgtttcaggttatatgaaaaaaaaactttggtcaaagccaaactgcttcaagtctgactaagtttatagacaaatatagtaatatttacattaccaaaatagctttattagattaataattaaacatatttttataataaatttatcttgggtcgaaagttttactatttttttgtcaaacttgaagcagtttgattttgatcaaaattaaaacatcttataacctaaaacggagggagtagaaattttataggatttagtaatttttaattctttgttttaacggaaatgctataccacgggatactgtcccaagtgcgtgggacggtatcgcctcctcccgcactatctccttgagccatgtcttctccacgtgcgtcactgctactgatggtgtgcctcatattgttgttactctgctccggtgagagctgttgctgatgcatgactcctgttgctgctgttgctttgctccggcaagatgatgaggagcgttgacgacgcctggcggggcgagacggcaagacaatgagtatgtgcacggcgagtcggcggcaagacgacatgatgatggcttcatggtcgtggtcgttgcctgctcgtcgctaccgcctgtgaccgcgccgatgcgaacgcttgatgatgtgggggtgtggacggtggaggacgcggcctcagcgatgagctccggtgtggggcatggacagtggaggacgcggccgctggcgatgagcccggcgtggggcgtggcggaggaggacacggccgctggcgacgagctctgacgtggaacatggatggcggaggatgtggccgtgccggtgacgatctccggcgtggaccgtggatgatgccgccgccggtgacaagctccgacgtgagacgtgaacggtgggatcaccggcgacgatgcttttggtgcctggctcctgatactttgcaagtatcacctaatacatggtaggaatcgccagatatctgacatgtttcacttgatacttcgcaagtatcatctgatacgtggtagaaatcgcttgatacttgacatgtttcacctgatacttcgctagtatcacctgatacgtggtaggaatcgcctgatacctgatagatttcacctgatacttcgcaagtatcatctgatacgtgctaggaatcgcctgatacctaacagatttcacctgatactttgcaagtatcacatgatacgtggtaggaatcacctgataccttataggtatcacctgatacctcagaagtatcgtctgataaaggttaggtatcatgacatgatacgtcagagatattaggacctaatacctaaccggtatcatcctgtcccaacgggattccattgtatagcagccccttgttttaaagggctatatatgagaaaaattgaaaaatctatactattggaatccctacgttttttttttcatgaaatcaaatggggcctcagattagtggtggggcgcagggtgatgcaccaaacggcagaggatccgactccaagcgtccgggatctaggaatctagccgtgtgccactactggatttttcacattttggtccttttaaaaaacttatttcgcaaatagacccctgaaaaaacttattccagaaatggtcctttttggggcgcca

SEQ ID NO: 66632 - DNA, 9987 bp, Oryza sativa
tcaaacattttgaaacggagggagtataatataaggagttttaaatcaaacatgggtatttattaaatatgttgacaagactaaatggagaaatattgtggttgattaagaagaaaatgtataaaggaaatttcaatagtgaaaagttatgcctggttaataagagaatgtaggtggatgaattgttattttttaaaaaataatttttaaagatttaaagttgttatattttagaagggatgaagtaaacaactgcatgcattttgttccacagacgacaggatcacaggaacatttccgtcggatcagtgaaatgaagaatgcgtcaaaaacaatttagcgaaaacggatggtgggcctcgctgagccaaaatcttagcccggcctacagaggccagcaatgttgggccgagacgcagaaccgatgattttgttctcttctactctttttttatcactactatagaaatggacattcaaatcgatactataaataccaaaaatgatataacatttatagtgttttttccacccacgcgctcaccagcgagagagccatcacaaaaaaccggcatctttctctccaaatagatgccggtttttaaattgaacttgcacctatttttcctgtcaaagaaagatgccggttttaaaatttagacttacaattttttttgacttttggcttagtaactttgactgagaagagaccgagagcttgttcgggtggcaagcgtcgccggtgggcacgctgcccacgagcattcgaaccccaggttcgacgctcgtgctcgcccgagggatttttcccctctttcccaggactgactttggttggtcctggctaggtaatagggtacacacgcgtgcgtgttcagtgggactgcacgttttccgtgcactgaggcctagtgcctctaatctcattcctagcgtgtgttagggacgtgcacacgtgtgtgtgcgtgtgtcgtggtgagtgtggtgtgtgtaagtgtgcgttatgagttgtacccttctaaaaaaactttcactgatgatatacatgcaaatttcagatttaggaatggctttggacttagttattttacactaaggaaggtttagacttataatttttgactgaggcatttactctttttttttttacatttctatgtgttgatatatatgtgaacgtggatgtggatggggttgtggatttgatgaaaaattcagatgtggctacgaatgtgaatgaatttgtgtgaatgtgaatgaatgtggctgtatactaatgaatggatgtgatttgagacaaattatgttacatgtgatttgtatatgaaattggaaggtcctgctatttttatttttttattgtcaacataagggtgccggtctacttgccacatgtccagttcagtcaaaaactggcacctatatgctatttataggtgctggttttcgtaagaactggcacctacactacaccagttgcggttttggtcaacagctaaaatgatctacactcacgtctaaagaactgcagatatgcaatagtcttgtcgtgggtgattacatatggataccggttcttggatgaaaactggcacctatatatttttagtcatcagtgtcggctattagatgctggtttgataaatctggcatataagaattttctcaactgccaccaatgagggttcttttagtaatgtatactcattttagttgagtttagtcccacgttggtaattgatgatgggggagcacgacttaaaaaagtggatgccgtccttacctatcagactattcttttggtttgtgtaggcccggaatctaaagttgtgggtccggttgggcctgtggtggagcaggcccaatgtgacctgggtgacccacagttggtgggctgggctgcgtactctaacaagtggtatcagttcccaaggtttggaacccgaaacaatttttatgggtcacatggtgggaaggccgggtaacaagtcttcggggtcacatgggttgatgtgacgggggagattattgggtttagtcccacatcggtaattgatgatggatgagcacgacttaaaaggtgggggtagtcctcacccatcagactgttttttgggttatgtaggcttaggaccttaagttgtggctctggtttggcctatgggggagaatgcccaatgtgacctggatggcccacggttcgtgggccgggctgcacactttaacaagtttcctcttaatcatgtagcaatgtaaattatcatttttcataaatgagatggaaggtagagttggctctaccttcttatgtgtgaaaaaaaaatatttcaggtcttttctcattgtttgcttgttagtttatcaaccacagtaaaaacttaaattttggagttctttcatcgtaatctattttacagcattaacttcccataactttttttttcaatagttttctacagcttttcaaccataaaccattagagttggccattctcaactctcataaaattttggtatcagagttgtgtgcaattaaaggtggatgaattcaatttagctgatcgatcgaccgcgccttcatactctcagacacggctctgctttgagaaagcggagctaacactttcacgtggctagctagctagcttacagtacaccatgcagcctggaaaatattagcacatcaagttaccccatatatcttggacgatatgcaagtgtcggacggaaagcaccatcacgcaaacaagctggagtaagaaacgaaccggtgctattccccttcagtcttgacgttcaattagcagacatgctgtgttcgattacagaggttgggaacacatgctctgtacacgaaaaacggagtggtctattagtacgtgattaattaagtattagctaatttttttttcaaaaatagattaatatgattttcttcaagcaactttcgtatataaactttttttaaaaaaaaacaccgtttagcaatttaaaaaacgtgcgcgcggaatacgagggagaggggttgggaacccagtgatctaaacacagcacacaagcatcaatccttgcctgaactaggactcaaagcaaacatttatgtagctatagctagctactagctactatggatcaaacgttaacgtgtgttgtctctctctatatatacacatatgtttatatgcatgcttgtgatatccggccattgctgcaagaagactacgagcaagcagtatagctagctaggaagctagcgtcgttgttgcccggccggcgccggagaagaaggagaaggagaaggcggaggtaggtcgagatcaatggcggaggcgatcgtggggccgctggtggggaggctgcaggagctggcgctggggcaggcgcgggcgctggtgggggtgaacgccgacatccagaagctcaaggacaagctcatgtggctgcaggccttcctccgggaggccgacgccaagcgccgcgccgtctccgacgaggtcaccaaggtgtgggtgctgcagacgcgggacgccgtcttcgacgccgaggacgcgctcgaccattactatctccagttggacaagtccaggtatgtcacattattagtactactgtatactacctctatttttttaagtaacatttgattatttgttttactaaaatcttttagtatgaatatgtaaaagtataagttattaaggttatagtttttcaatgataaaataagtcacaagacaacaaagtaaataacatttatattctttttaaaaaagacgaatagtcgtacgttacatgaatacattaaaaaccagagagcgtttcaaaatactaataacgttctagttttatcataagtcaaacattttcatctttataattgttaatttttaaaatttcatatagtttaacaatgtttgagttatatattatggaagtatttcctatagtgaattaaaaatataaatcttatgatgttaaactatatgaatttatcaaaattgatggctaaaaaaatgaaatgatggacttagcactacttaaaaaactattttcctgtaagagatcttatgatttttacaaacggaccgcgtaagttgccgtgtctggaaaaatcgagcggtattttcgcatatggctccttaagacggccgtatggaaaaatcgatttttttccatgcgggctcttaagagatctgcatgcaaaaaataaactcattttgtgaaaataaaatttgaaactagtttatctcactcatttgaattccgaattggatgattcattttcctaaatgttactaaaatcatgctctatcatattatcgtgttcttactgctattattttggccttttttttattgtgactttgttttatcaattaaaaatttgaattttaaaacttcaaaaaatattttgaagtagtaaataatttcaggtgaaaaaaatcatgaacataaaattgtagaactcatcaagacgtacaacttttattttgatcatttcttcatccaacaatgtgattataacattgttcacaaaatttacatatcttatctcttatagtttataaaaccaaatgagagatatgtaaattttgtgaacaatgttactatcactttgtcggatgaagaaatgactgaaataaaaggtatagatcttgatgagttatacaactttgttgttgatgactttttcagttgaaatcatttagtatttaaaaattttgtttgaagttatcatattttcaaattcaaattcaaactattcgaacaaagtcatacagaaaaatgaccaaaacaaaagttgtagatcttgataagttatacaactttgttgttgacaatttttctatttgaaatcatttactacccgaaaaattatttgaatttcttatgttttaaaattcaaattttatatagttcaatcaaacttggatgaagaaataaccaaaagcaaattggtagatctcaatgagttctacaactttgtttttgataacttttttcacatgagttcatttattattataaaattcgattcaaactttaaaaagccacatgatttttgcatgcggatggataagtgatctgcactgcatgcaaaaatatcacccatatttttttcatgagagaatccactcaataccactgagtttatcgcacttctacaatctaccactcactttgtcaagttcaataatataccatcgtgttttctttacctctattgtgtgccctcgccgtccatgagctgttagctgacatccttttgctgtattgaattttatcttaatgactaaaataccctttgactaaaaccaccagtacccaccagcttcaatgtgcactagtagtttgaacggatcatggtgaggacaacgatgctgccgaggaaaccccccgcaatggagaatgtgggcgtcgacttcccgacggatgttctggtggtcatcctatcgcagctcccgacgagctccttgtgacggtgccggctcgtgtgccggcggtggcgcgacaccgtcgacaagcgcacgctggagcgtgacgtccggaccaagatgctcaccttcgtcaagggcctcgacaatgaggcgtccgcctacatcgtcgacgaggcacgaggccgtcacaggtgcgtgtggaccagctcctgctccgtcgacatgatcggcacccgcaacggcctcatctgcgtcctggacggcgacacgggcgccgtcacggtggccaacccagcgacgcgcgtcgcagtccatgccgccgccgccgtgacaggcgtggctcttgccgtgctccccagacgcgtgcacgtcccgtgctacttcaacaagtctggcacgttcgatgccatgtaggtgtacgccctcggcggcagcgcaccgctgtcatggcagagtgtgcctaccgtaggtgccagcggccgtttccagccgggaggggtcgcctgcgtcgatggcgtggcgtactggatcaccgccggaatgcagctggttgtggccaggtcgtcactgggtactgagtggagacgggtggccggcgcatcaatggggattccggcgaccggtggcgcgtcgattgggattctagagaccggcgggcggcggcacgtcgatttggagttgggcggtcgacagcgcgtcgttggggagtcgggctgccggtggcgcgattgggagtcggcgccgcctcgctgggaagagaggaagagaatgatttaggggagagattgatttgctagggttttcacttttcagtcaacaaggatgaataaattagccaaagggtattttagtcattaagagaaaattcaatacagcaaacggatgccaactaacggcgcatggacggcgagggcacacaagagaggttaaagaaaacacgatggtatattattgaacttgacaaagtgagtggtagattgtagaagtacgataaacttagtggtactgagtggattctctcttttttcatctccctccactgtcttaatagtacgacattcctaaactcaaatgtaaataggaggagaattataccaataggaatgtcttctttccatctttctttcattgtcttaagggatgccaatgccgaaaccgtttcaccatatattctttagatgattgatgcggttacttgtagcttcaaatggcctcgcacggtccatcatgacaaagccttcactcgcccttgatcaccggatttggttcttcggtgccaagccccttgcttgcccttgaccgccgcatggtccatcgtaaccaagcatcgcttgcccttcaccgtcttgccatagtagccacttcgtatcccatatcttcaatatcttcactttgtcatcattggcatctttaggtgtaatgagatcacttgagcaacaatacctttgcaatccttgggacctatttctctcattcaactcaataaaattattatatgaataaataatgagtactaatcaacaccacaagtgtcatatactcgaatgtatactcaaatgtaaagatcccaattaaataaaagtgaatcacttggatcaagtacatgcataactaaggtatagtatttactccccctaaatgtatgcatacgaaatatttgtgtgaagcaagagtatgtataacaagatatgaaacattgagagcttatcctatacaagaatagaagacatttatcaaatatagacattaaaataaaaacataccttcatcatctccatgttctcaatgtaaagagactaaacaagatatggctcaaacaaaacattagtctcacatgcttatgtaatcacatgaaaatatcaatatgtgaacagagagaaagagtgatacatggcttgatctctattcatttcatctttgtgatttaggtccaccatcaatgaacgtttctatctcaacttatatgatgtctgggaatcacttctcacatattccgttttcatatccatatgagactagtagacaaagaaatgcttataattaacaatattagtctcatgtaattggatttatcattaatcaccaaaaccaaattaatggcacataaactttcacaaactccaattgtactaaatttggactccctccaaatttaaacttctcatcctatacgcatacaatatctccatcgtatgccatatggaatctccaacaaccacatgcattgatctttagcctaagcatcctgcaagatactccgattgtcaggacatcatcttctcccaagttaactcctgatccatctccggtaactctctctctcgaggcgtcaagactcacctacacatgaatctaacacaaaaccatatccgaatacaagttctctccaacttgactcaacattagcatacaacagtattacatatgcatagaaatcatctagaagtcataaacatgaattatccacgagtatccaaataaataacccgaaaccgaaaccgatacagagttggtcagtcaaaccgcgggctgaccagtctgaccgcgcacataacatcggtctgaccggtcccgtcagacaaaaatccctgtttaccacttgaaaacattgttcacaatcatcccagtctgaccggtgccaaaaccacttcctcaataatctccatatatcaaaacaaataatctcagatgtcaattgttcatcaggaaataagaatcaaacacactttgattttacacttgcaaccacaaagtttagccaataagtagatgtgagtctcaaaagtttaatgaaacattcatatcttaattagggtaaactttggcaacaaaatcagccatctttgttttaccaataagttccatagaatatttttccttaagttttagtacaactatagtttagtttagctttgtatgtatttatatgatacttatacatatgcttttggtctatctagattataaatttttttattttagcaactattacttagtggggatttgcgtcgaaagtagagatcaattgtcagtactggtctaatggtctaaaaaaaggatcaaccacttgattaatagatgatctaataatgaataatgcttctatgcttcaacaaagttgaatatatggtcttgttttgagatatctgctcttgatggtctagttttaaaaaaaaattgctctaatagttttatgtacatgtattcaggtacccattgtggattcgtcccaccgcaaaacttgtcacgacctttacaacacaggcacacattcgacacaagctgtctaggaaaataaaagcaatcaattcaaggcttgaggacatcattgaaaacaaacataaatacaagatcgaggaggcaaacacgaagacaactaggacatggaaagcttctacatcaatatcttacacccataaaaaattgtaagtagacagaagtaccttttgcaatatttatctacatgtattagatctctagtattatttggatttggttctttgattattcttctgtagaaataaaggcttagctattccaacttcaagtttcaaaattgtggaactttatcttttagttacattaaaatcagaaacatggagttcaatagaaaacacttgaattccaagattaagtttgagaataaaaaaaaatcaaattattggacttcaaatataaatattttaaatctcatttagcaaatggtattcctgtgttggtgctttttctgaccaacatgggttcacctaaaaatttacggtgttaacagggtcgccagccacctcggagtagaaaagctcttaacaaagatgggtttagaaaagaataaaactaactagcggaactgattcagagatcaaaccaacgtctaggctgatttagatcgatttgaaaataacaaccagtctcatgggtgaaacggaaggtttacgaggcaaaccttcaaagggtattgcactctcgcagcgaaggcggatgatatatggcgcaaatcgacaaagatggatgaaactataggataaagtaaaaatacatggctgagaagtaaatgtaaaagaacgattcgatggatggtggtcaggggtttagaatcgaaccatccattgcccttatgaagaggttggtcttgtctccgtagggccttctccacatcctattaggcttagagaataatttggactatagaaaccttggaacaaaataaggaaactaataacccacaaattgggctcgaagtcgaatctgctggtatgaccggccacataccgtcggtcaaattgggcccacaccatcggtctaatcaaccctatggcagggctcaaaccagcttcatatggcaaaccgggtcttttctatatatggctgtgttttcttattttcaatgtttggtgtctaatttaggtgttaacacttttatagggagtttttcgtaatgtaggaattaatctaaaccccactatcaagtttatctagaagcactactcaacttatatagtggacataattaacacttcatcttttgaaaccattcatttctacagttacatct

SEQ ID NO: 66633 - DNA, 2526 bp, Oryza sativa
cgtgcaccccgggctccccctcacccccgcctgcccaccgcctccgcctccgcctcctcctatcatgggccaacgcacctccgccgcctgcggccactgcgcgccgccgccgccgccgccggaggagcctcgccggtaacgccctcccccccgaaccgaggaacacccctcctcgcccccgtaaacttcgttcccttccagctgctgaccgagagtggcccccctctcgctcctccaggatggcgctgatggggccaagcgccccgcgcccgcggcggcgtcttcctcgctgggagccgcgctggtcggcttcgcgcgtagcaacttcctcccgctaggtgagttttctgcttctacgcgatctcagctagctcgtgcattgctgctgctgttgggtggacttgtgtgtgggacgcagtgtgccttacaggtagatgtagagttgcgaaatttcacggcctaacatggaacaattgaaattccaattctcataaattgtaatgcaataggagtattacctccagctagtttacttgttaatgaccctgatatttcattagacaagagaaatgctagggtagacgggtccagttaccaaattcaacaagtttctgtgaacccaattatgcactagttagttcctctgcacgtgctttttagttgctctatgttgcaaacttgcaatggagatgataccgtagatgtgtctgtgcatccctcagacaagctcaagtacatattttcttagcttgtgtgtttcttatgttaagctctaattgctgggattgctctggccctcatggatcctacactcggatgccttgctcacaaatattcactgtcaaagtacagcaccttcgggatattccttatctcaggttagtgttttaacccaattcatatatttgtggtgctatgacctcacactaatgacgtcctcttgcataggactgactctgcgaaccaaggaacttggtgcagcactagaagcttggcctgcagggctttttggacttgtatgatccagtttttgttccattacaattgtacctgtatgatctagtactattctgatctgtaaatgtatctatgctgagaatagttcttgcttgctgcattgtgatccagccatccaggatagggttgcatatcacattcatgctactgattattcaatttactttctagcatttaattatttagctgaggtcacatgctgcctgtctgatttttgttagagattcaagttcttatgttgttatcgagtgcctaaatatgtttgcttaaatatttattggtacatattttcattcttttgcaggcctcaatcttgctgtttacaccctttttggctcagtttattatgcaaattaagttcttccctcatgaatttatcactggtatgttggctctcattgtgttccccatttccctgttcctattatattatttattgttgcaatgtagtaactcatgccttcatgttatttatagcttgtttgctttgatattgacaacacatctcacagggttggctatgttttgttgcatgccaacaacattatcaagtggagtcaccttaactcaggtactaacttttcctagatttctattcactaatagcttataatgtgcatattttctcatatagccaggcattcaaatttaatcaagttctatcactgctatgcagcttgttggtggtaacactgctcttgctctcgcaatgacggctatatcaaacttactgggcattatgattgtaagcaaagctttgttgctagtttgtcttctgaaccacttaccagcattacttataactaacaacttataaacacattatcgaactaccgacttaattttgttgattcattgcaacacaatgttttgtttgatgccattaaaagtaatatatattttttagtattgaaaataacattagagaagcaagttatttttctcctgagctgaactgattatgggaggaaaatattattttagataaaaatagaaattatcttgatcagagatggttacttgattgcaatccatcatccctgtagaaccttgaagatatctataacattgcctgggccgtaggctaaaatccagcattgactatgaaacaaattatctttgagacttccaagtagcattgaacctcctaattctggcattaatcttcgtatgtattttcagataatgagcattgagcaatcaacttattgtttttagataataatcaaggatgactttttccctgttttccaaaagccaaaactcctatttctttgtaaaatatgttcatatttatttgtgaccatggaattaggtacctctttctcttgcaaagtacattggtgttggagctggggtgtctttgcccacagagaaactatttaaaagtctggttacaacccttcttatccccattattttaggaaaggtatgttgcttttcttatcttgcaaaagatagctaatatgaatgcataattatgtgcctgtcttctttctggattttata

SEQ ID NO: 66634 - DNA, 7642 bp, Oryza sativa
tattttaaactaaaataagacttgtataaaataaaatagaaaagtataaaaaatatcaatagggattgaattaaattaattagagagactctaataaatttgtaaaaaatagttattacttttcaaaaattggaacaaccattgtatgttccattgccataaccatgtttaagtgcttagatattaatggtcttccatctatcctataccctggaattatgagtttctccaattattgcatatataagatatactaaggtagcaagatgtagaagtacgtagttggttaaaaagttatatatatgctactattaacattatatttagaactcatgttgactaggtatattttaaaaaaataaattataaatcacatatataacagtgaaacgaggtgtacaatatatatctcctatgtatttattgaaacactctttctagaaaataaagaagattattgataattgcttatagtaatgaattaaatattatatagttcaaaacttacaaatatcttgtaaaaaaattatctaagcaatgtccacgaagaaaattttcaaagaaatagtacttttcaaacatagcaggtgtcatctcattgatattccaccttacaagttactcaagcgtaacttacattacattctcgtgcgaatgcgtgggctaccttcctagttgtttacatggccaacaggttagcccaattttccaagccaaccaacaatacccttatgtgtttgttttcaagctaacttcttaaaaaaaagattggctgaattcgttattaggccaattccgtcctagtttgcatgacctggtaaaatcacactaggttgttagctagtctagttttcattccttttttaggggtgggagagggggggggttgattggggtagaaattaaacccattttcatacttaggctatgttcgtaacttggggttgggaacccatctcctccacatggaaaaggaagcagtccattagcacatgattaattaagtattagctaattttttttacaaatgaattaatttgattttttaagcaactttcgtattgaaactttttgcaaaaaacaaaccgtttagtagtttgaaaagcgtacgcgcgaaaaacgagggagaggggttgggaacccagagcaccgaacacagccttaggggtaaacaaaacacctactataatacatcaagtggttgtagactttttcctttaaggaacccacgaggctctacacctaatagtttcatgttttcagatctctttgaaatatttgaaaggtacaaagagatactgctacttacaagtcagaaggcaaagaaaaaaattaactcttttagtgaactacatttgtggcacaactaggatatagttatcacttattaaaattatacgtactattactgataataacggtatacttatgatttgaccacagggaatatttgcatgagtcagacgtgccgattcatgtggaagagcgaaaaaaactagagaaagtccttcttactacacctgaagatctacatggcaaagaacacaatccagtcataatctctgtgtttggaaaaagtggtgttggcaagacaactcttgtgagaaaaatatttaaagaaataggtaagcagaagcagttcgacattccagccatggagtgttttgcaccttacctatccgctaccaatatcttacaacaaattgttcaacaactaacaacagacaaccaggattgccctagaaataaggtcctcgaaattttagaaaagaaattaaaagaaaaaaagtatttgttggtgatagatggtgaagttagtggtactgaactgaacaacattttgagtacactcccgattggtcatgcgggtagtagaatagttcatatcacagaaagtaagccagaggagccacctagcaactatcatcatgtcaccattgagttgaaaacaattgacaaaagtatatccaagaagatgttcctacaccatatggaagtacaaaatctagaccttgaaaaccatgaggatgatattatttttcagattactggagggttaccacttgcaattgctcttttatcaggtcttatgaaaaccaaggagtccactggtgagtggcagaaggtattcgaatatcttaagtccaagcaatcaaaacaaattgatgatatgctctcaatttgctttgatgatcttccacatgagctgaaatgttgcttcctgtatcttgctgcatttccagccaatgttaccattgaggcacgcaacctagtgtctatgtgggtagctgagggatttctaaggtcaaaagttggcaagtcaatggaggacattggctacttctacttgaaagagttgtcggctaggaatctagtcagtctggttcaaatggacgatgattccaatgttagcaatatgactgttaccatccaaaacaaagtccatgaatttttgcagtttgaagcacatgaggcaagcttcctagaggtacatagtggtgatgatatccccacattgacaagtgctcgtcgtctctccttgcagaattacactgataaatatgctgttctagcaaatccattgccgaagctacgatccatcttctcccagtttgagcaagagcctaaagaggaattggagaccatgacaaaaagcatccaagcatatgtatgttgttcccctcaacaaggtactatagcttctatgcagaagaagaatatcaaatctcacataaaagaactattgcatggatctgagttcctccgtgttatcaatatacaaggcattgagataggtaacaggttgacacgtgcaataggcaaagccgttcacctccaataccttggaatcacttcttgctcacttgaaaacatcccatcatccataggaaatcttacaagccttcaaacattggatgtaagggaaactaaagtccggaagctcccaaaggcattttggatgatcaagacactaaggcatgtgtttggttttatcctcaaattacccaagcaaactgtcaatttgaagcagctacatacacttgattccatagaacttgaagattttgagcaaggcttggataatacacttggagagatgatccatcttgagggcttagttatttggaaaatctcaaatggtaatgtcaaagctctgttaagtgctctaagaaagcttgagagccttaagactctaaacttacaaggtaacaatattacatcaagtgtattcaccaccttgttcttgcgtcgcctcaagtttatggttctagacggggagttggacttttcatctgatcaactgaataatgggttagccctccctaatctgactatgcttacattgaaggaaacaaaagtaactcaggagtttattaacaagctagcaaagcttccctctcttgtcacacttgcgttgtgtctaggatcctacaaggatcaggaacttgtcttcttttctaataaatttcgatgtctacagaagctcaaggttgacgtggagaaattgaagaaagtagaaataaagttgagtatgcttcccaaactcaaaaaattagaaatccagacacatgacagtcatcactatcaagagcatgaagtaactcatcaggaacacgaacagaagacagtgatctcttggaaaaaggaaaatgctattcaagttgaatgatgaagcccctctgatgagatgtcacttctcccactatgcatggctagactccgttatctgttatgacatgcttgttctttcttgtgtttccgcctatacctctctaattaatatatccatagtgttgtctatgtatggattgattataatatttgtctaacccaggtgcggtcagtgttgtcgtgtgtatatatagtaagcttgtgtaataatgtggtaaaaactgtgatgattactctgcctcaagttcatgcataattatacttagctaatgtgggttactaaaacaacaattgaaagttgtacggctagtcccttaagcataccaagaatgtaaaaatgccatgtgtgttcttttagctgagcgagcgtgaacaacggcgtcgtcaagcattggctttgcttctctttactatgcgctacccaaaatttggtcatgtagagacataaaaattaaaaacaaaatactccttttctcctcaaaacagagagaaaagatgtatagtatttctaatgcttctaacatcaaatttatagtattggcccaaatgcccatgctgcaagcgcaacgacaaacacacccatcaatgcttagtctgatgagttaagtctagcggcaccgcctcacaccctagcccgcaccatatctacatgacgacaatcagcaaaacgcctcaacaatggagggcagatctcatccaattgatctcgttcatttgtgctgcactgcaggatggatgcacgaatgcacgtgatcgattggtcaaggtgccatcaaggagatgggggcaagcatacgtgacatgacccgacgacgtacgacagtcggctggttcactaagagaggctatctgcaatgatgccaagcgtaagcggacaaaatggaaccagatttaaaactattttatcacaaaactacagattttataactttaaatagataatagtactatgatctaactctagaatatatagttctttgataacttcatcattaaatctgtattgttgtgatacatatttttaaatctgtagttttatgatcatttgagccaagtatctatattttgtgaaatttactcttttatctacgtacaatcatcattggtatacaatagatttacatttagattgatatataaagccttatcatttaacaaaatagtcctgtaataaataaatgtattatcagtctcttcagcacctgcatggaggacaagttgattctgccttcagcacagcacccgtagagcagctgacgaaacggaatatttgttggtcccacttggcattgggccacccatgcccacaaatccatgacgctgggccttccccattcctcgtgggcccaagcacagagcagtttgggccttacaagcaggcccgccacaaactttcgtttttggcctgcctaacttagcagtagtaggtccccctgacacgacgagctgacgtctcggtgcacctgatcgtgttgccgccgcagccgtcgcgttgccatgacacagcgtgcggtggcggccatggagatggagctcctccgcctgcaggcagctgctcgccggcgagatgaactgcgcgacgcggtccatgagctccacggcgctggggcgcgccggccggtacaggtggaagcagtggtcctcgccctccgactccaccagcgtcacctcgcgcccgccgccgcgaagctgggcggcgtaccggcggccgcgctcactcaggacgtccttctcggcgacggcgaccagcgcgcggcggcatggaagcgacgacacgtcctcggcgggggggtcgatccgcgggtcgtcgttgccggcggcgccgcccgtcacgtacggccagagcgcgtccagcctgcccggcgcgagcatcggcggctcatcgtcgcgccagccggccgccgccgcctcctccgacggcagccaccgcgcgccccagaagcatggctgcagcagcgccacgccctcgatgtcgacgtcgtcgccgtcggggccggcggcccgcgcggccacgttgtgcgcgatggtggcgccggcgctctcgccggcgaggaacagccgcgtggggtccgcgtagcgcgccacccaggggtcggcgagcgacgccgcccaccggagcgcggcccacccgtcggcgaacgccgcgggcaaggggtgctccggcgcgaggcggtactccacggagacgacgagcgccccggcgcgcgccgccagcgacgccgcgtaccggtggaacagccgcccgaacgcgctccccgtgacgaaggcgccgccgtggaagtatagaaccaacggaagcctcctcccttcgccgccgccgccgggaaggaacagacgcgccgacgcgccggtatcctcgtcgacgaccacgtccctcgtcgcgacgccgtccctagtagccggccgcaccgccgccgacgtcgccgtgccgtcgtcgtgggacgccgccacggcggcggtgctgcgcacgagccgctcaatgtggccgccctcgtacacgcgcaggaacgggtagaggtcgacggcgacacggccgccgccgccgccgccaatggccggagatgatctaggcgccatgcatgcacgttacgtcgcacgaatatgcttgcgaaagctgcatgcaaagtgtgctacttatactgtgctgcggtggtgggcttaccgggtcgtctaaatgttcaacgagtcatgcgtgccaatgtgcgcgtcagccgtggcgcacacagtcgggggctcaaatcacatactttcttgcctacaaaatttcgagaagttttttgaggggaaaatctcgagaagttcaaagcagccatcggttgcaaacaagatagcagcagagagtttggaatttgatgagtatcaacacttcacgagcgtagaattctaaacgcatgcatgcataccgtcaattttacgaacaaaaaaggttaaaaagaatgtcgcagcttgggcctaaaagttattttctatccaaaccatcgagcgatatgcatgcatccttttctgcaggaacatgcgtgtacaagttacaagcaaaggaatttacaagttaattttagcctgtgaaagaagggccgactgatttcaaaaagaggggtaaaaacaaaagcgattgaacaagctttcaaagtgtcaatttccatcaaatgtggatatattatgagagatagagttattgcccgaatccatggggatatgagtatatgacctaatcttgacatgtcttctaatttaagttatctataagctcactacatattatcatgaggtaaaataatatacttttcccccatcttgttatatacctttctcttcttcatttactctcttctctgttccataaaagcatagtattcttctctgttttcccctgttctctcctcctatgtatatatgcatagacacaaatatggcatgacataaacaaaagctataagcgatttacacggcatcatgaaatgataagaatatacaatgcactactgcaccagaaacgcccttgttgatgattctttattgcgacagcatatagggctcctagaataatgcgatatatatctcgcaccaggtaaatccttaacccttcctcctcttactaatactacgtaatgttcttgtaaactatcgacaataccaggtatataagcagtgattttaaacctagaagttaatcgtactctagcaactttacgtaagagcatgtacaaatataaagttcaatattggtttgttagttaatatatatcacttagaaaccatcctcatacaatagtgagacaataagatctcttaactattattacaccaaaatattttttttacccttatttccttttcttcttcccctgcaacaatttttttttaataaatgttaagagtcgactctgaaccgttgcatagaaacgacggttcccttttcaccccccccccaactactagaaaaagtattttcgcaggcggacaaaagtga

SEQ ID NO: 66635 - DNA, 5871 bp, Oryza sativa
gaaatccatcacgaagtctgctaatggaaaggttactacacgtataggactgggtcgttactatatcgtgcagggtccggtgtctccgagtcctacttggagaccgtttgacctgcgttataaaagggaccccccgagggaacttaagggatcgaatcttagagcctacacaacgaccatagcctacgaagtcggagactacaggagccaagtcgccgggtgatctagtcgaatcaacttgactacggtctcatcggtaccgccgagttctactactccctttgtaatctgtggttctttccatataatcccatatcaactggattagggctattacccgctaaggggcctgaaccagtataatctttgtctcttgtttccttgatgtcgtattacgtagatcctcgtaccaacgtaccccaataccctctatatccggtctacgggtactcaccgtcgatagtggcgcgccaggtaggggcacttggtgctcaaggttctactactatgacatcgagcttcgtcgacaatagagtcaacaccggccccatccaaggaatccctgcttcaacaatgctggtgtggactcaagtcgatgaaatcgtcttcccggtttacaccacggtgccaatctcggctggtccatcaataaccggaaatgagaacgccgtggctataaacccggacggtcccatgtcgaaggatcctcctgccagggcggagaacgaaacatcaacgtcatacgagcccgagaagattcctagcacagccgagccttgtccttccgacaaggactgcgagccgacgaggacaacttccgaggtcaccaagtcctggtgtcctatccacaagtccaggaagcacaacttgcaagtttgctgggtttttctcaacgtacaagctgaaatctgtgcttgcaaagagcgtggaatcctgcgtacttctctaactcgtgatgtctattgtcctattcacaagacgaagaatcacgacttctcaagctgcaaggtctttctccgcgccatgaagacgacgcttcccaaggtccaacagtcaggaacctctctcgaggagacagacaaggaacaaggagcgacgttgacttcggatcgtttcgttggagtaatcgacatcgatcccccactactagaatagtgaatgtcaacgaccaaaaactaacgacggctgcataatcttggtcgttgatactgctttgggccgatttctggtatccgacgacgctagttttttgtggtcactaatgcgtagtgggctgcggtcgttgttgttatttactcaggttggatgggcaattgcaaatggtcgttattactcagcgacctgtgtcctcagctctccggccactgccgccgccgccgccctcggcttcggccaccgccttcgattcgctccacagctgcaagcctgcagctgctgcccatgctccctataactttgctctttgctgctctttgccacacaaaggaggtagcggaacagcgggaggaagaatccccatcattggcataggaaaagtctatcagatcccctccaatccactgctcccttccaattccgaaatcccctcttttccccaaagatatttcgccccaaatcaatatgaatcaacagtttttgattccaaatccgagatcccctctgctacccccacatatttcgccccaaatcagtataaatcatgaggttgagagatgagaggagtgttgattcaccgccatgtctcgcagccgcagtttatcaccggaggtgacaactaggggctgcatcgaatggcctacatggtctcctcagggctcccaaatgtcaatcctccccaccactgaacatcttaatgccaagctcctccatgagtacatctctccacctgatctgcccagccactctgttatttgttccagttcacttgggactcatcaatcgtcgaaaatagtcacaacaggtattctccaatctcctaatgtaaacatttgcatatgatttgtgaaacatattgaattatgtgctaggttaaatgttaaatcttgccaggttaaagtgttggttgtattgtcctcttcgaaactaataaaagctgcaaagtttgctaggtggatactgattatttctatgctgccctcaacctgaaatgtttgatatggtcctgacaatttatttttgtggtagctatggcactttcattagcattaggctgtgtttagttggatccaaagtttggattttggttgaaattggagatgatgtgactgaaaagttgtgtgtgtatgacatgttgatgtgatggaaaaggactgaagtttggatccaaattttggatctaaacacagccttagtaatagaggaatgtaggcaatttgtttgtttgtaggcaagaacagcaagtgttctagctttattcatagaatgaattcataattatattttataaacagaaacattaggtgtgacttctgtgcaattaacaattatagttacatgtgcattagttcttcctaatttgacatatattcttctcctagactgtttttcatgatggtactactagtttgttgattttaattgtaatttgaaataattatagtatcagcagtgctttacttaaatggtgtacatctcttgttttcacctctgctataatgctagcaatacaagttatttctatttacttaaaattgagttctgcatccagctaactctatacatacttcaattgaagggtctgaagaccatagcttctccttggattcagttgggtccaaagaccatagctactcctttgtttcagttgttgaggacactatgggtgatgctgtcgaggacaagatgtaccaagttgtaaaggaagatgaaccaaaggaattacttagagactccaaggttaatttgatggcaaatgttgttgaagacaccatgaaagagaaagagattaatgaagatgaccatatgggttggtactccttagctttagttgttgaggacaccatggatcagcaagtgggagcagacatcatggaccagcaggttgtagaagactccttggtaacatacaccatggaagagagtgatgaagatgaatacttgaaggcagaatatgaaaagggtgcattaatcttcgctagagatgaggcaaatgccttggaaagaaaagaagctgaagctcgttatgaaaaatcacttgaagagattagagatgaatttttgaaaatttatgtccctttgtattttactctaagaaaaaagtaaattcagttagatagataatatataaattcgatcagcatccagttcatggccagttatttgttagcaaagaataactcatgcatctgtaactctgctatcactttagtatcttcaatgaagactatatattgtcttattgtggggtctgacttgattgatctatgttcactatgtgcattcttgtttcagtttatagtatcattctctgcagcagtaagatagtactttgctggacaatatacagtctgaaagtttcacttcaactggaactttaagttatgctagacaccacagggactgggactctgccaatgatttgtttgttctatcccttttaaactttgtatccattgtacagtgcaatatgatttgttcaacaaagttgtaaagtattcaagtacaggtctagatgaagggtgctcgatttgttcaaggaagttgtacatgatttaagtgcagcctgtacactgctatgtgtatttcaagggtatgctaatgctgtaagcctgtaaatctgtaagcataacatcgaaatatttttgtacatgagctatgctttacagctcagaaaatgcatcttaccttttttttctgctctaaacatgatgtgttcgattttctggtcatccttttatttcagttagtatatgtataaagtagcaatacaataaaataaacatcaaactagcttttcccagttggatattgtgttgtaccttaagttagaaaggtgctggtgctgggttcgagtcccctgaacaaaagtttttctaatgattttactttcttttccatacgtttttttttaaaatacatctactatatgttccaaaatcatgctatgtgaacaagatattttttattaattacaatgttaacaccaaatttagtatagtttatggatttgtcgctatcctgcgtatctttgttcttgggttaagaggtttagacaaccaatccaacactgtcgtctagttataaaagtgtactctttcgtataaggtcataaccgatccaacaccatcgggtgtatattcggcatagttcatcaaggcattaggcgttagaggatcgaccgttcaaactagtaattatagtagaagaaaacaaccattatatttctttcaaaaaagacaataaaatatatgccgtgaaatatattgtactaaaatagtgtatattgtaaatgaattttaaggtaaaagagaacagagaaaatgtattgtccgattatgacaaaaatgagtatagttacaaagtttactccttcgtacaaggtcataaccgatccaacgccatcgggtatatcggcatagttcaagaagccattaggtgttagaggattgactgttccaacaagattattacaatagaagaagacaaccattatatattgcataaaactttgaataaacacaataaaatatattgtactaaaataatatatattgtaaatgaattttgagttaaaaagaacagagaaaatgtgttgtgagattatgaaaaaaatgagtctaaaaaaattattagtacagtttcacatcagggacattaaagaaaataagttgtggctttttaaaaaaatttcagatgcatggaaaaaattatggcgggtgattacataccttttttatttttttttggcgctcaaaggaggagttttaggcatatgtccatgtacatatctcctcctccattcataatagacccaatatcttctcccctctcacatcccctccctcaccagattgagagaaccacagatggagcgctaatcattggtgccgatcggctgatcctctacttctccagtgcggcaccgtgccgcgcggcctcatcgcgctactgatccggtggttcccgtccgagtgcttcttcaatcaaaccctagaaagttctactacaggtcactacttctccctttgcattgaaatcatgtcgtttctaatctggtgcctgtcctctatccttaatcaatccatgatgtttggattctatccttaatcaatctgttgcatgtccgcatttgttagacatttctgaattgttgttttttgaatcaaacatattttatagcgctgggctgtcacttttttttgtgtatgaattatttcatctatagtcaactaaaaacagaatgcagtgcaattaatcatattgccaaataataatttatatgatatctatctagtcttgacattttacctaacagtgtattgtaactcttctttgacattaattatatatacagggttatataaaacttaatatcaactagcaattagaggggatggctccaagcaaggcatggatgggccttgtggatgatcggctaaatcacgagtacttagagggtgtagagaagttcatagattatgcattcagtaaattagatggtgtccaggttatacgttgcccatgcatcaagtgctgcaatacatattctttgcctcgtcacatagtgtcttctcacctgaaagcgtatggaatactgaggagctacacattttggtaccatcatggtgaagtcttagcagaacaagagaatgacatagaagttgatgagtatgattcacaggaatttaatggggaaggatataatggaatgca

SEQ ID NO: 66636 - DNA, 1210 bp, Oryza sativa
atagaatttgaatatgatttttagtggagtggtagatgttagtatctctaactggcaaaaaaccccccaaaaaaaaaatttttttttttaaaaagggggaaaaaaaatttttttttttttttttcccaccaaaaccttaattttgcattgaattggagagaaatatttacactaggaggtatcccctcaaggattagaatgttcttcctcttttgactacattatttgcgttggtaacagtttttattttccaattaaaaccagaatagaaaacatgtatagaaaaaaaagaatctatgtgcgcttaaaggaaaacatatgtttttccttttatgattaaacatttggacacaagaataatcgatcagcacatgaataataagtcatacaagatgggtccttttcgatttgtccaatcaattgcaagttgattctggaggaaaagaacattaaatagagtaaagaagacgtctccagtattatttccgcttttgctgaatgtatatattcaccaggataacaaaacaatggtagttaatgaaccggtcagttacaccggactaccggagacggttatatatcacggtaagtcgctgtgtatcaattatctggataatttaattcgaagttaaaataactaagaagcaatttatgagtagctaactattgatagtcaggaaaatctcggggttcattttcctatttattttctgaattctccgtaactaatgtttctgaaaatacgtagccgtcagaaccccaaatagagctagagggataaggtggaacaaagcaaagtcaattgacgtatttaccaatggaattttgtgtattcgttgatattccatcatttctttttaattactgtgctaccgtagtactccctccgtcccatatgtcacatccctccaaaatctcttatattatgggatggagggagtagagtattttttttgttgctccaccgttcccaaatataaatatttaatttttgttccaaaatataaggacttgtgagaataaccgtctacagtgcattaacttgtggttgtgtcttaatgactcaactcgatccatagattgctgctaaattaatactatcacttaccaatcaaaagtcaaatatacagagaaagctacccatcggacgtccgatgcccatcaaaaaatcggatggtcaaatgttgcagttgaccaacaagtgaagcat

SEQ ID NO: 66637 - DNA, 38551 bp, Oryza sativa
aacaaaaaaaaatcacggcggcggcttcactgacaccgccatgcgcctcaccgccgctgccctccgccggccggatctgggaggggaggggaggggaccgccgccccgtatccgtgccgccggcctccccctccctcctccggccggatctgggaggagggaggggagcccccgccgccgccccgcgcgtcgtcgtcgccgccgccccgacccgtcgtcgtcgtcgccgcctccgccggcctccccgctccctcctccggccagatctgggagggagggggaggggagccgccgccgcagctccgcgtgtcgtcgtcgccgctgccgccggcctcccccctccctcctccggccagatctgggagggagggggaggggagccgccgccgccaccccgacccgtcgtcgtcgacaccgtcgccgccctcgcctgcctcctccctccctcctccggtcagccgtacgccacgccgccagccggacaccgcgccgccccgccgccttccacgccaccccgcgccgtggccgccgtcgctccccctccgacggccggggagaggaggaagggtgaggggaggggagaggaggcggcgtgaggggagaggaggaggcgtgaggtgtgggaagagaggccggccgtgggtggagactggagacttagaaaaaatcaacacttccccaagtctatttatagtgaagtctattttcgcaagcggaccactgcgaaaatagattttcgcagacggaccgaccatttcaccccgatttatatttttgtagacggtcatttggctttaagagtcatgtccgcctgcgaaaatgagacccctacgttaatatgccttttctagtagtgccccccccccctccctcatttctatcttccacgtcatcaaatttgcatgcatgtcaaccgagagagcccgttaataaacgtggttgtacaagccctaagctagccagctattttcatctactgccttcgtccataaaagatatatttcttgtccaagtatatggctaaaaacaagatcggcaaggagaaagtgcgtattgaaaaaataaaatctattgaataagtccctacatgggcggaatcttgccttcttccatatagcaggctttcctaacttggggaaattttcaagagagacttaaatataattaagtttaaattaaacacaagaatatattgttcctaagagcatgctggtagttaacagtaagccgccgggcacagtgacagtactgcaggcatcttgacgacgttgatgcgccaacgttttacttttctcccaataatttggtcaagatcgatattattcggcgttcactttgctcctaataattggtcaatagataattcatgcccgttgaacaaatcaggtccatgccaagtgcttcagccgcctactcttaattagtaccgtatacgaactcatataaaacctagcaaaagctgttgtaagcaaatgtctcaacaaaatccactagtacatatccttatatatgtgacggcctctaacatgcctggaaatagcgggccgtcacaagaaagtcatctcaattaggccgaaaaagtgcccgattgagatatggtcgcacagacatattacaagggcataaaacttaagtccgtcacggatgacacctatcagtgacgggccgtagtttaggcccgatagagataacgttccatatctcaaacgggcctaaagttagggcccgtcatagatgaccatcatccgtgacgggcaccaactttaggcccgattgagataacattccatatctcaaacgggccttaaattgaggtccgtcacagatgaccatcatccgtgacgtgcaccaacttgaggcccgtcacagatgactcatcagtgacgggctatatactaatccccggttgacacgacttaatctctatcgggcattaactaaagcccgtcaccgatgagtatttttccatttttcatatgaaatgtttatatttgtaagttgaactatagcaaaataattagcttgtagtacaataattcaatttatgagtcaaaataattttacgtgtagtaaatgatatcaaatggaaaagtcatcaacaacaaagttgtatagctcaactcatcaagatctataacttttattttagtcatttttctatataacaatttttgaacagtttgaatttgaatttaaaaatatgacaacttcaaacaatattttcaaatactaaatgatttcaactaaataagttatcaacaacaaagttgaataactcatcaaaatttataacttttattttggtcatttttctatataacattttttgaaccgtttgaatttgaatttaaaaatatgacaacttcaaacaacattttcaaacattaaatgattttaaactgaaaaaagttatcaacaacaaagttgaataactcatcaagatttaaaacttttattttggttatttcttcatctgataaaatgttagtaacattgttcacaaatttacatatatgtgttatagtttataaaaccagataagagatatgtcaattttgtgaacaatgttactatcactttatcagatgaagaaatgaccaaaataaaagtttatatcttgatgagttattcaactttgttgttgataactttttcagttgaaatcatttagtatttgaaaatgttgtttgaagttatcatattttcaaattcaaattcaaacggttcaaaaaatattatatagaaaaatgaccaaaataaaagttatagatcttgatgagttatacaactttgttgttgatgactttttcagttgaagtcgttcactaacaaaaaattatgtttgaatttctcaaactttgaatttcaaatttcaaattgtttaaatagagtcggatggagaaatgaccaaaataaaaattttgcacctcgatgagctctacaactttggttttggtgacttttccatttgaaatcatttattaaccctaatttttgttcaaagttgttaaattttgaaaattcaaaatttgaattgttcaaatgaaacttacttgtacaaaggaccgatacaatagttgtagatctcggtgagttatacaattttgttgtttaggatttttgatggttgtgtatgtgaatgaatgtatatgaatgagggatgttggggtgtgacatcttggcctagggcttaataggattaatagaatactcatagcaacaagttacaactactcttccggaagccaactttgatgttaagcgtgtttggcctgtagcaatttcgggatgggtgactgatcgggaagttcttctcaggtgcacacgagtaaggacaaaaaagattggcctgagagagaggctagacggcatgcctaaaaataaaatttatttttttggagattatactcatctgtgacgggcattaacttagacccgattgagaggactcatctatgatgggcattaacttaggcccgattgagataggtcatccgtgacgggctatagtttaactgatcgtctgggtcaaaagctattggtgacgggctttaattatggcccgattgagataggttcatctgtgacggccgtttgcctgattgagataacttttcacatcagtgacttctagcctgtgacggacgccatgcccgattgagatgggggttgccgcccgattgagatgatggtatccgttctagtgatcccaaattatccatgtcgtcctaactattggcaatgtacaaacttgtgggatggatacagtctagtcgaatagcttacgaaattctcatgtcgatgcgaaaatttgtttcactgcatcctaaattaaacttctataaattggacaagttcataaaaaaagcattatttaattaaaaaagtattatattcaatgatgggtttaacaaaaactaatttggtgtagtactatatttttctataactagtgtgaccatcaactatatttatacaattaagcatgagaaatataaaacattaccaaacaatacctcggatgaatggaagatctataagatattcaagctcatttttggaatccagttcggtcttaagaaacatcactggcttcaaataaacctagcgtcttcatgccaacttcaatttaggtgatcttggatttgttgaaatgcttacattgtcacctttcatatgcatatggcctcatatcaaaatctatcctgagtcaacagaaatcatcaaaacaagacaatatagttgcctaacccgaacttaaacttataccttgcgatagactgtacgtcggtccatccttacaagagtgattttttagtttttggatttttctcataaagaacttttgaattaatggaggatatagtagatttttttagcccattgctagcttgatatatgtctttgattttctaaaatatttttctttttttaagaaaaaacggaggcagtatactagcctatagctactacaactcacaaatctgaacacacaactgtatcggcagccaaattaatagtgaactcggccggcgagccagtcgatcgagcggcacacgtatggtcgtgagttgctagcctcatgagcgtccacccaccgcgccgctattggcttggtcattcatgcatgcaagcatgctgcatgagaaacaaaacgcatattcacctgcacctaacattgactgctagctagctgctgccggcgccttgacgccacaaaacagatattatcatcataatcgttactcccttcgtttcataatgttagtcattataacatttttcacatttatattaatgttaatgaatctagatagatatatatatgtatagattcattaacatcaatatgaatatggaaaatactaaaataacttacattgtgtaacggaggaagtatgacattatcatcagcaatatatctccgcagatatatacatcaaatcattatcatccggctacgctagctgtatatataaacgtttgaatttgaccggtgcaaagtcagacatgttcacgtgccaaatagtactccttttgttcgatattataacaagtcattttaattttttttcctattcaaacatatttagatgatcaaactcataaaaaaaattagcaaaaaacatctacttccgcgccgccaacaccaaccacctcaccgccctcatgggcaggttcaagcgtacgtacatgcctataagcatgcacgccacccggctttacataaacgtttttttctgtacgatagccactataggtactataggtgttgtaggtggatcttaactgatcgcgtctgcaaaaatcgatcttcattttcatatacggctacataaaagacctacatcaaaaatctattttcacaggtgtgcatataaaagtgagcatattttctcatgtggtgttttaagaggccacatggaaaaaaaaagattttcgcatgcgggcttcttcaatgatccgcatgcgaaataacccctcttctccacagatattttctatgctctctcttttccctttcaccacttcaaattttgtcacgatctctcctctcctctcctctccctctccagctctcctctcctctctctctctccttgtctcctttcctccccctctcttcctctcctgaccgcgctggagtgggcagcgctgacgaggcgggctgggagcgggcgccgccactgccgccgatgaggaggcggctgggagtggcaccccttgcatggatccagtggcagcggtcccttcctgcatagatccggcgctgggggccctcactcgcgtggatcggaaccgacgacgacaacggtggacacggatctggcatggaatatggtgggctcgggcggcagcagcgtcactgccgcatacggatcaagcgccgtcaacgactacggcgggcagtgggggcgagtggatccaacgccggtgacgacggtgggtggtgggggcagaagatccgatggcgatgatgatggtgggtccgacgcggatccagcaggcgacgacggcgggctagggttcagtcgatttgggttatttttattttttcgctgaaattattttcgcatgtggccggtattggtgacataccgtacgtaaaaatatgattttcgcagatcttttggcgcatactattgcactggccgtatgcaaaagtcacttttgggcacctataaaaacgatttctatactagtgtccatcgatcccctctcaaagttccacaatcgtctatgtgttcccgtgaatttcttgcatgtagtggcaatgtgagcgccttcatgcgtggccgtatatatggtccgaaccatatggtcgctagctgcaggtcagaagcaagcacaccacggctgcaccactcgtggatcgaggaaggttctggggttcatcagcgagacgtcgagcagtgcctcctgtactcgttctggccccggcaaaggcaacaagtacgtctgaattccgaaaagtgaaaaattcacggcaaagcccaaagagaaacccccacagatcggtaagcgtctttgggcgcgtggagtatgggccgcagcctgcaaaatcagcgcactccgggtccaactcgttcaccttaattcggccggacgcctgactctaaccggcaggtcgtacgtcgtcctagagcctagcaaaagtaaccaagtccaagttcagacacctcctccggcctccgttgcacggcctactacgagctcgtttatccacgcatagtccagtcgcatgcatggctggtgggctgcctaccgcgcggcgtcactctcaacgggaagatcggcaagtctaatttcaaaggattctttttttgcggggaaagggagatatattactcaacaaagctatccacaccaacaaggtgtgagatacaatcacagctattgtctggccagaaggccgtcaaggactcacttccgcccttgtttgctaggaaatcactaacacaattattctccctgtgaatcttcctaatgataatctccctattcccggacaaggggtctctaacctccttgaccaaaaacgctagctctgatctgtcactgctaccagcgccgacaagcttcaaaagctccaggctgtcagtttccacgataaatggaagcaacgtccactgaagagccataataattccttccctgcacgccagaagttcagcttccagagcgccgccgcatctgctcatgttcccgcagaagatcaaactgcctgcactattacggaggacagcacctattccccctgaaccatatcgagcgtcaaacgacccgtcgacgttcagcttcatccagcccgggtttggtttctcccaatgattaagcaccttcggatcaggcacctgggatgtccccttcatgcagcccaaattcgaaaccacaaattttcctttggcgaaatccgcccgagggaactgcttgatttctcgcaaagatgacacataactgacgataaacctgtgcgagacagacactggtggagcagatttcccatggtatatctcattcctgttgtaccagatgcgccaaagcagcatcaaaaacattgccccttcctcttttgcaatcagccctagctggtcaagaatccacccagagcctgaccaagaagcccccgcttcaaatgagatgtcctttgaactgcgcagagaaagccaaaggttagtcgcgtgagggcagcggcataatgcgtgagctacatcttcctcttccctgccacatatgctacagatggccatcggttctaatctccttgtcttcttattttgcagagtagccagactattagtagctgctttccacgcaaagatcttaaccttttgaggtatgttacagttccaaactaacttccaagccttgctaagatcatgcccagacgagctagagctggagttaacattagccagggaaacagccaaatgataggcactcctaacagagaaaatcccatgtttatcaggatgccatgccacaaaatcagcttcttgagatcgtgagggacgaatcttcagtataatatcagtgtcaatctggttaaaatgttgctggattctttcaagatcccactcaccattatcgttcagaagatcgggaacccatttaatgcggcagttacccttcctggtgatgggtctcctggagaaatccctaggaagccaaggatcacgccaaatgcggatggaatgaccattacccactctccagattatacctttcttcaaaagttcgagaccatattctatccctttccatcctggggaagagttccccccaaaacttgtatctataatcgaaccgttggggaaatacttagcttttaaaactctagcacataagctgttcaggttgtccaagatcctccaagcctgcctggccaacaacgcctgattaaaaagcttgaaatctcgaaaacccatacctccacactgtttcggtttaatcagggtgtcccaagccctccaatgagttttcctttttcctctgtcggcgccccaccaaaagttacggacggcttttgttagttcatcacaaaccgagtccgggatcttgaagatgcccatgacataaactggaatagcctgaaggacagacttaataagaatttctttaccaccaacagaaaggtggttttcaccccatagcagaattctcttccaaactttctcttgtaaactttggaatttgcctttattcattctaccttcgggcgttggaaatcccaaatatttgtcctcaaagccagcgctgcttatattaggtggtatttgggtcaaaggattctttaagcacatacactaaatcataaatcatgtgagaatcctatacatatataaagtttatctccactaagtacagttaatgttatttctctcttctttcgttaagtcacatcatctcaattgtttttgcacctggatgattgatctatagtctaaattgtctccctcatttcttctcctttgtttaatctgtggatgattaatctgtgttaccttgcttcttttctctcgataattgagacgtatcaccttagctttccttttgaatgatcaacctatatatgatttaaattgttataaaccacatcatcttaattatttataacttatttcatggtcgattaaagatgaaagttatataaagcatataaagttatgtcatctagctatcttatatgttatatgttatgtacattactattttacggaactcccatagcaacgctcggagtttcatctagttctataaaattcatataatttcaatttgggataaaaggattttggaggattcttacggtagttaagcattcatgtgaaagttctctaaacaaagcatgcttgaagagttggtagcggcttgtggcttcaaccccataaacccatgtatgactacaacatcaacatgtgaggagaaaaaaaatatagctagcctacacaaatttaaccatattaagcatttgatatgaaaattatattttcaatgcttacaataatatcattatatattgagcattaactaataggggacagtgtgccgcctagggttgtagttgcggggctttgccactgcaccatttttttttcttgattattcgattatgtgctcatcgagcatttgtttgtatgtaaaaatttgcaataggacacttaaaaacttgtggatttcgtcgcaggatatcctaaaattgtaacaccactattgggcaccctaaaaactgatagttagatgtgggataccgcggctgctattttagacaaaatttgttctaaggcatcgtgattttatgattttagctcctgacatataaaaagtcaatatttctcacttaagatatggttatttgttgatggacactagctcactaaaatatacatttatatactattataaaaattgaagatgtttttgctagtactttggtacgtcatccatgtatgagtcggtttttaagttcgttcgattttggaaatacaaatccgtatttaagtcgggttttaagttcgttcgcttttgaaaatacagaagaagtcgtataagatatctctttaaaaaactcgcatactaacttgagatgattggactcctaattgcagctcattattgtctagaaaaatatatatccaagtgaattcccacagtgaattttaccttaactaaaccgtataacaataataatactaaaataaccttcaccagttgcaacgcacggacattttttctagtgtaatgagatatgagaaagaaaccatgtaacatgtcaaaaatgtccttagccccgtttgttagattcttccttctcttcgtggctagcgaaaggggcatcaatggtggcggtacatatgcatgacgaaccactgaatgggtgctgcgggacgtcgattaattccactcagagtgatactaacactactacgaaaaccatctttcatggcggttattttgggttttcactggtggaatttggagctgctacaaagcaaaggctagtgaagatcaagatcttcactagcggttatcaaccgccagcgataattcattttcgctggcggtcgtcttaaccagccaccagcaaaaatccattttcgctggcaattggcttaagacggccgccagcaaaaatgaattatcgctagcggctatgttaaataggccgctagtgaaaatctattttgggccaaaaaatatacccatgcagctacccagccgccagcgaagatgatttggagaaaagctcgttgattcattttcaaaattcaaatccacatctagagatctagattagatgctcacttccaaattcaaacacgaaatacaaaatcatcattagcacatatcaaacatcatttacacagaccaaaacatgtgcatcatctggaacaacaacatgcacaaaaaaaatttcaaatcggagaagaggaagctgggagcacgatgaggacagcgtcacggtcggagaggagggagccgggagcacggggcagcacggtcggagaggagggagacaggagcacggtcgacggcgtcgaggtcggtgccaccctccccgtgatccggtggcggcggatccggcctccccgcccgcgcccgagctccacttcccgttcccgagagccaccgcccgcacccgagctcgccgtcgccttcgtcgcgcagtcctccgttgccggcgctggaggattggagggagagagggagtggagggaggtggaggagagataggataaggacgaggctggtgtgggggcggtgattttatagcgttaaattttatttcgctgacggtgctgtaacttgctgccagcgaaaacccgattttttatgacaggcctcttagcatcgccgctagcaaaaatagaactatttttttggtaggcctcttagcttggctgccagcgaaattttcgctggcggtctgtaactcctcacccctcattatatttttagtgacggtttttgcctattaccaccagcgaaaaattatagggtacacgtcgtagaccttgtagcggttcagcacgcccacctggtgatagaccttgtggagcaggcaaaatattagtggttaaacatcacacagtacgctggaatgaatgatgcagatcgatgctaattgtggtgtggtgtgcaattgagatcatcagtaatggtggtgaatggtgactgacttgtaccggttgacgacgttctacctggggcatcatccgagctcgtttgcggaggctcatggcgacatcgttggggacggcgccgaacatggtgaccaccttggtgagaccggccggagtcaccgaagaggccgggcaatgagtacttttgacctttgatctttggcattgtttccctctgacctgaaaatttatattttgatgttcagcagcaaatagttatattttgagagtttcctaaagatcgatttttatatgtccaaagaggattattctttaatttcatttgttgcagaggtaatgacgttgattcaattcctttccgttgcaaaatataatgagagagagagcagccaagccctggcctgcctagctcagcgtgtgcagggcaatctgatcaccacctcaaccggtcaacatgtattctttaatagctaccaatttaagttgtgatcctttcacataaatttttaaggtggtattaatctattaacattaattgtggaccaatgaaatttattagaaagaaaacgggtctagtctatttattgtaacagaaactaagtagaaattaactttccaaatataacattttttgacgtgaacattccaaatataacatgcatcatgcccacttcacatgtgcagattgcatcgaggaaagctaacgcgcgcgtgcgtatcgtcagcgcgcgattccagagaacgtatctaacccgcgtaaaatctattttcgtttttccttaaccagcgacgcctgaatatggagaagacgtggagtctactacatcggactcgtactacatgcatgcatgccctttttcctctttaaacaaagttttctctcaaattacttatccgatctataatccgattacaccattgtgttcgttacaattaaatcttcacaacaagatcttacatgattatattatgatgaaaaaatatttatatttataaattacttttattatatacataagttacttttatcatatatataagttacttttagatttaactaaattacttcttagacatataaaagtaaattcaataaagtttaaaagtaatttacatatattataatataaaagtaacttaaacggacgtaactttgtcacgatattagaagtaaattcgttgtagggataaaaatatgacttcgtgtcatatgaaaaaaaggcattcattaaagttattttctttttgttataagttacttctataatatatgtaaattacttttaggttttattgaatttacttttatatgtctatgaagtaatttagtgaaatctaaaagtaatttagatatatgataaaagtaatttataatttttcatcaaaatataatcatgtaagatcttgttgtaaagatttaattgcaacgaacacaacggtataatcggattataaatcggataagtaatttaagagaaacttctctaagaagaaaaaatacatagatattgagtgcactagtagctttttttttttggaaagaagagtgtctctctttagcactatccagctagcactctcggtgtagttgtgtccatctaacccgattagtttaggagaacataactaacttgattagtttaggataatgatggtaattaaggaaatattttcctttttcggaatttttttattgtaatagattgaaaataaatctatacatgaaaaaaattttcacgtaaaatttaaaactttcaacttaaaatttgaaactttaaactcattttaaaattttattaactcgaaatttgaactttcgagttagacataaaatattttgacttaagatttaaactttgaagttaaattttgaaattttttaacttgaaatttaaatttataaaacaaaatttgaaaactttcaactcagatttgaaaacttttaaatcaggtttgaaaactttcaactcgagattgaaaactttcaaatccatatttgaaaactttcaactcagatttgaaaactttcaactcaagattgaaaactttcaagtccatatatgaaaactttcaactctgatttgaaaactttcaaattaaaaaaataaaaaagaatgcaaaaaaaatggaaaatgcgctgaggaaaaaacatcgtggaaaaaagagaaaaaatcgcacgaaaagaatagctaaacaaaaaaatccacgtgtagcggtgttgggcgcgcgcgcgccatttccgtatatggcgcgcgcctcttcaatcaatatcgaacttgataaaattagtctcttgtgtcgttttggctttggttcgtatgcaccagatcagataagtttgtgtagtaaaatgagtatttttacaagtctatacactaaggtgcatccacctaacaaattatataccatcaatacaatttaatctatttaatttatcctataatcaaatcaacaatccgtaacaataatcggctcagcaataaatcaaacaaggcctaaaaataggggaaaatattcgtcctgtatttggcccctatcatagacaagaacgtttttgtcacgtcgctaaacagaagagagcatacaaaaaaaaatctattgatagtggcgtttgacagttgagagtaagaacaagtatgcatcgaggacattgtactagactagaggcagctagccgacgcaacgtcttggactggatttcttgatatactacctcgccgttgacttttttaaaaatatttgaccgttcttcttattcaaaaaatttaagtaattgttaattcttattttatcatttgatttattgttaaatatatttttatgtatacatatagttttacacatatcacaaaagtttttaataaaacgaacggtcaaacatgtttaaaaaagtcaacggtgtcaaacatttaagaaaggagggagtatattagccgtcaacttttcttatgtttttaccttttaggacgcgtgcatatatgtatatgcaattcaattagtcacttaagtacatactgacgttacatacatatataattccttgaagtctcgaagcaacttcttgaaatttaatcttattggcacatccagtacagtgtagaaatgtaagctaagtctgcgtttatcatttgaattctttagtactttatatagatgtctacatcacaaggcaaatttagatcaattgtcaagaaatatgaccaattgggttctcgaatttcgactctgacaggagcagcgagtatgtggttttggaaatcctcgctgcattcgtctatgggcacaagccattggttttagaaattccccacagtaacactgcacatataaagctaaccccctttttaaatgctaatatatactgtattaagcttatgatttacattccagttgatcatttccacgcccacgtgcacagaaagctacagcggaacacctgaccagcaggccatgaccagcaccatatgtgtgtgactgagactccagagagaatgttcaaattctcaattctaaatgccaggtggtgtaaaaagttaccgcctttatccacgaacatgtactccctctatcccataaaaaaccaacctagaaccggatgtgtgtcacatccggttctaaattcgtttttttaagggatggaggaagtaggaattttgggattttagtattatctccgtcccaaaatattgtaatctaagatagatcaaatttacgaaagttatctatctagactcgttattttaggataaaacccatcctaagttacaacatttttttgacggatgaagtattttcgtagagattaaaaataaaatggacaaaaagacacacgtaccctcatcaaaattacatgaaggtaagtgggtaaaaggttcaatattttaagatccctaagaaatataggtcaaatttgaacctagatctctatatttgtggacgaaacaggaaattacgagctgaggaacgaaaaacaaactctctctctctctctctctctctatctatctgatcgttaatccttgtcaacagtccttccaaattaaggtcattcagacgtccggtcataaaaaagaggaactaaaactacttttctatcctaattcacgcttcaagctggttaattaataattaaaataacaatttacaaacgaccggattaactgagtcgtgtcccatcccacctgcgcacccagcccggtaatctccaattattctccattctcccccacggtttaagatcattccgttcgccatgttcaacgagcacgtaagaacacacatgtacaccccagctacgtacgtacgctcgctcgctagctgcgagcgatggatcggcacagtataaatagagccccagtttcatcagctttctcaaaccacgcagccacgacacatcgatctcccatctccttgtgcagccgctgatctctatagctagcatcctctgatccattgatcatacaagcacttacctagctaagctagctcgcttgcatttgctatatagtttgaatttgtcacccacagcgtcgacgttcatggcacctgttccggccaccgccgccgccgccgcccctgcggccgtcgtcagcacccacgagatccggcgtgcgcagcgcgccgatggcccggccaccgtgctcgccatcggcacggcgaacccggagacgtgcgtgccgcaggatgagtacgccgacttctacttccgcgtcaccaagagcgagcacctgcctgagctcaagaacaagctcaggagaatctgtaagcattatgcatccatgcatgcacattgtgtatatatgttgttaatttcaaaccatttttcttctctttttcaccttagaaatatatgtagtagtaagaacaagattgaaaaagtatatggatgcacattgcattgggcaaagtgttaattaagcttcaatttccacacaaaaaaaacttccattttactatacaatcaattccaacaaattttagatcgattgactcattgtatatctttgggatggtgcgaactgaaacttatttttttttcaccttgatgcaaaatttaacttgcaatacttcatccggtacaaagtgtaatttagcgcattataattgaataagcaaataacaataattagtgcatttcatgtgtgctaatgtgtggatgtacgtatgtttcaggtaacaagtcaggcatcgagaagcggttcatgttcgtgaacgacgacgtcatggaggcacacccggagttcgccgaccgacacctgacgtcactcgacgccagggtggagatcgtctccaaggtcgtgccggagctcgccgcggccgcctcggcgaaggcgatcgccgagtggggccggccggccaccgacatcacccacctcatcttcagcacctactccggcgtcaaggcgcccggcggcgaccgcctgctggcgtcgctcctcggcctccgccccaccgtgtcgcgcaccgtgctcagcctccacggctgctacggcggcggccgggcgctgcagctcgccaaggagctcgccgagaacaaccgcggcgcgcgcgtcctcgtcgcctgcgccgagtccacgctcatcgcgttctacgggcccgaggtggggtgcaacgacaccatcatcgggcaggcgctgttcggcgacggctcgggcgccgtcatcgtcggcgccgacccggtcggcgccgtcgagcgcccgctgttcgagatggcgttcgcgtcgcaggccaccgtcccggacagcgagggcgccatcaccatgcagcacaagaagggcggcatggactaccacatcggcggcggcgtgccggagatgctcgccggcagcatcgagcggtgcctggccgacgcgttcggcgccatcggcgtcgccgccaggtggagggacctcttctgggccgtccacccgggtggccgaaggatcctggacctcatcgaggaggcgctcgggctggacaacggcgccatggcggcgagccggcaggtgctgcgcgagtacggcaacatgagcggcaccacggtgatcttcgtgctcaacgagctgcgccgccggttcgtcgccgacggcgccgagggagccgactggggcgcgctgatggcgttcgggccgggcgtcaccgttgagaccattttgctccgcgtcggaagcggcctcaagggaaattaaataaacttaagtaaatttaattattttacttatacatgaattgcattctattggaaggtaagtcctataataaaatgtgttgagtcctaccactttgtttgtccgtttgggtcatggacatttttaattagggcatcaagttgagggagtagctctgctaaaaggagagatgtttggaccttaactgggtgttttggaagtgaccttgaacccaaaagtgtggagtagctataatcatggtcatgcatgccatttgttaattactgcttaatgacgatctttgtaatatcaaaagttaaataaataaagatctttgtgcgcagttacagttcgtttacacagcaaaatttcgtgtacttcaacgcaattcatattttgcgaattttgtgcatttctgaatttaaataaaatgcgctaattggatgtttctgattatcaaagttcatactatatatgtccaatttaaaataacactttcctaacttaaactaaatgatcaagctagaatttcttagttttagaatttcgtgcgacacatcagtgtctaaccccacgtggcacatatcagattcaaactaataaaaatagaaactactatgttcgttcaaagaaaaacgaatttactataaatgtgtcgccatatttactataaaaacgaatttaacatatatttacattgtaaatccctaaattacatatgtaattttagtgtatttataatgtaagaccataaattacatatgtaagttctaaaattacatttgatagatttttatctaaaaatctgtcaccatatatttagatagacctaagaaaaaatagaattaatcattttaactagaatgtgaatttatagaggattgtgggtgtatgattttgattgttgcgcatccatagcaattaaaaaccggttcaagagaaacttcaagacatctggtacttaccatgagaaagagtgagtaacagtgttggacttgtataactagctcctcttctaagcacccaaacgagggaaggtgtgatggagtttggttggccctgctttagtggctaagtggtttccgaattcattatgtcacaagagggggtgggtgtgaacggtcaggagtgagttatgcgaagggtcttatcataatcatttgcatggagacgtgtcagatttgtaacatgatggtagattgtgtcttgtggatacagttgtatatctttggccaaagtaaaactattcgaatagctaatccataattatgaggcgatcgacctgcttcagtgcaattagtcccacactttttaattcgcttgacttaataaattagtgtagatcaggtgattcgttgagcttgtccaacatagtgttgtgttgttcaatggagattaatcttactttaatcaattaaccaatttaatgttttaaactataaatgttcataactgtatttatgcaaagagccataaacctccatttactagtgtggcctgctaagtacggtggttgatactcagcctttttataatatcttctttttaaaagtttagtgactaaatgctgaaaatgaagttactggaccaaggcttatatcctacttaaacatgccagtcgagtggagatgtagcttcgtataacgtccgtgtatttcttaaaatatcaatttaaattttatttaagcgtcgctcttttctcccctgttcaaaatctccaaaaatttcaaagttacttttaatcttgcttttattttttcccggccaaaataattttttttctttccatccgaatattttatatattctcggaattttccttctccggagtaatttttccggagccgggagttcgtcctttttttttcctctcaccagcacacgtgcaagcatgcgcgccttctctcttttcctcaccgagagacaagcagactcatcaacctttttcatgcatgcacaagctcttctctcttcctcctctgccaccctttttcgtaaactctctgcaaacccagcggttaggcacagctctgcctcctccttgacagagcttcctgcaatcccagatggtcgttaggcaccgttctgccgtttcacagtgaaaggttggtatcaaaacatgaattcggcaataataaaagaggtagcgtatgagacataaaagtgaatgaatgcggagacaatggatttagaaaggttcatgccctctcaatgacaggtaataccctactcctgtttagagatttgaatccgccgagtatagtatagatatgacgatcatatgtgctcatacctcctagagggcctcctacctaccttatataggatggggggcaggattacaaaataaccttaaccaaatacggtatcggttttctaaatctactttacaatattaacaaaccaggattttatgccgttccataatatagaagaaaacataatacccaaatcatgatctgttatatattccatagatataagttatcctctataataagtcggaataactagtcagataaccatgtcgtgcggctacggcgtattcatagtctccacagttggcacttggcaccgctccgcctcttcggccgagcaaggtaggcggcgtcggcagcagcagagagagctgtggatgaagaagcaagaacagtcacaacaatggcggacgttctcgttgccagactcgcctgcggaatcacaacagagagtataaataccccactgcgccgccttgccgtcaccatgacgccaccaccacgccgcctccctgcccgtgagcctgtgcgccgccacccaccaccgcgcgcgccgcccggccgccgcaccttgccgtgccggcagccgctccgctcggtcgagagagagaagaacgagagagaagagataagaaaggaagagaagaagcatgagaaagaataagagaaaaggaggtgggacacatgggccccacatctccccctctccctttgacccgttgacctgatgccggacccactcagaatattccctgaaatattcctttctgttctttcagtaaaagaaatcctcgtaacttcaaaaatccatatctcttcatccctaactccgtttaactccattcaagtgccaaaatcttctaaaatcctcctctatttaatggcactgtatttttttttgtgttttgttttgtttagcagtagttttatgtattgtttattttctcgcatatagaacccgaggtggatggaggattcgcgcaggagttcgatgctccgtttgttctcgcaggtcaaggcaagcccccttgaccacttcttgcacctatatttttaactaagtattttgtttgccaaattgcatctttaggtcgcattgtttggccacgattcgaatatggattgttgggccttcctagtagtcacacttttattttgtagttgatgacccctttcttcgtagctccactgtatattttcctcggtattcacactgccgaagtagactacctatataggttacgattgtgcgtactagcgtgtgggaaaacttggatactcattattactcatttatttcgaagacctgacgagatgtcagtgtggttacgaagtggagaagtgttttataaaaacttgatgatgcgggagtcagtacctggtcgtttggctacgtattatccataagtatcgtttcctttgagaaattcattcaaacataaaacaatacgaccaaaacatgctggacacctacgttttagctacctgcgatagtgaccgacatgacgctataccggatgtgccccttcgggggtcagaaggtatatttcgagcattctttttttccaaataaaactaatagttttattagtttgtcgcatttcatgctttttcaaatcatgaaatttgactaagttcggggcaaaaggtttcccccgaaccccccttccaaaaggtaaatgaaaggttgagaaacttccatttgatttgggaaggtgtttctcaaccactacttttaggaacaaacaactctaacgactaaaacgggtcttggcaagacccttaacggagaggacttcttcttttaacacgaactccgcgaacggtccccccaaaccccccgcaggggctccagctcgcccttcggggtagaagaacttgttagttgtagttgttccgaagggacaagttgctcccctctgctaaccagaggaagcactttggaaaataaaaacttgatgtatacctccgggcagcagagcagagggaacggagccctcgtcccgaggggatactaattctctttcttaactacttattaatatatgatatagaggaatacctattcctatcagtagatagacaagcatactataagatgctatctgggtagatagcatcatatagtatcaatggatagcagagcctacaatcgggttggagccctccttttggggtcttacccaccctcgagtccaatctcgggtgggcgcttatggcaagtcccattccctagaacttatccgtggatcacctcccctttacccgaatccacaatcggatactaagatttactttttaaagtagcaatctttctagtgttgattttaccaattcaatgtttcagataattgcatctttttttaatcaagtatttttattttataactttcttttttaaaaagtgctttgttaaaaaaacacatgtccctaacaatgacaagtggtgttatagcgctcgctagaaggcatctcgaccctttttgaattgaaggtagaatcatacaaggaccacctcaaactagctaaatagtgaaggcccacaaggggtagttctctctagagaaatgagctagaaccacggcttcctttttttttaaagaaaactgacgcaaggttactttcgtgatagctgaatgcttcaagaaaggccatacaaccaggttaatattgccaaattaggtaaaatggtgccatatttatgacttaaaatgaccagtgaaccttttgttgcaacagcagttgtttcctgagaaaccaatcatccagtacagccacgccggtagggttcgattcccccaagcctagaatctggaatgagggaaggtctcatcttgtcgatagcctagcttagaagtgccataggaacctatctggaaaatcagcccccggggataatgcaaaactctgacttcgaactcgatgttagggacattccctggcaagaaaaggttaaagagttgagcaacaaaagatgagaaggcactggttgtggaccacttttcttgtcgctagcgggaagagcccactggatggattccaaggggatcctatcctgcgatagtgaccaacgcgacactatactggaggtgccccttcgggggttagaaggtatatttcgagtattctttttttccaaataaaactaatagttttattagtttgttgcatttcatgccttttcaaatcatgaaatttgactcagttcagggcaaaaggtttcccccgaacccccttccaaaaggtaaatgaaaggttgagaaacttcgtgggatgccattggccgagcaagtagctaaaacgtaggtgtccagcatgttagcggttgaggagcactggtatggtggtgtatatgccaatctcctgtagtgggaatgtgttggagtccatatggtggggcctgggtagatgagggcctgagcctggcctgatgcttggtggagagattccacccaactgtgggacatgtggtatttatgggttggttatggaaaagccttgtagtgaactcccctttgtcatccatgtctgatccacaagtgatcgtaatgtgaagcgttcactacgtgtgggtaaagcgtgcaacctctgcaaagtttagtcaaactgtttaaacagccgtcccacggtcatgggcatatgtgaggtgtttctcatagtgtagtgtttgttttaaacttattaaattgattcttgggatgggaatcgttaccagagtttgcctttgtggcagacgaccatccttcgtggttgggaacgagcctatgtggttcgggatgccgattggcaccaaggtgtggtttagggctaagaccaccgtggtagagtggctgagatggccgagttgtgttgagatggcacggtgtttgtattttactcattactacagtgacaggtgcaaagcaacctgtggaatggagtgtggtgtgagccttactctgaaactaaaacttgacactctagaggtttgcaactaaattatttaaaaaccttgggttttccaaatgaaactgttccactccttgttttaaccttgcatgtcatatttttccctgacttgctgagtacactgagtacttgcccttgttgatatttatatttatagagttagaagaaggatacctcaacccttctgccgaggcctactttcaggagcaggccaagtacgatttctcatggtttcaagcctagttcccaaacatagcttttggatttatggttgtcatcctgcttttatgctttcgcccacgtgtaccttatctttctagtgtttctacccgtctagggtttgtccatgacggtagtagtttgagacctccaccaatgttgtaataaaactttgttatttctggattccactattattctgtgaatactagcttgtgtatactgggactggtactgtaatcacaggtaatgttgtgacccccagcctatgccggtttatattcttgactggcatagtttggggcgccacaccccgttaggatttagtgcctaattggtaagtatttgtgttttatttatgtttgtatctgcatattaatttttcattttgcatatcttgacttggttcctgcatagagatttaatatacacaaaatgatctaaaattgacttttttttaatatgtcaccggggggtgaaatgcccacctgaaaataatatatatatatatatatatatatatatatatatatatatatatatatatatatatatatatatatatatacacgtcaaacagacttagacagggcaaagcaataactgcgcaagggcaggcaacagagagaatacacggggaaatacaaggaaagagaaacacaagggcaacagaaccaccctaaacacacattgatgttttccatcaacaagatcacatagccaaacacccaaacctaatgctagctccctagcttgacaccatctactccacaagcaacctagaaacaccaagagttgagaaataccgggaggcattctaccacgcacaccggctcggcttttggagatcaaaggttgtggttgtcgaagaccacccgcgtaagccatcaagagtcagatttcatcgtattgcagatttagatcaatgaccaccaacgtccttcgggagaaggaaaccccaaaggagggagagccattgaaggttgcggaaaaggctgcccgcatcaaataatcttcaatccagcattatcaagttgctagccaatttaacgcccaccaacgtctcccgggggaaggaagccccaaaagagggcgagacactgaacgtatgctgtcaaggacaaccaagtaaaggagatgaagactagacatgaagccagacaaaagagatgtggtgaaaggtagcaatcctattagtggaggggaacatcaacgacaatggtggagtcaaaaatcgccaaggaagcccgggaaacaaaccaacttgtagacccaaactatcaatcacacgagcatgccagagagagtagattgaagaaagagggccaaggaaccgcatactcatgatatatggtggatcaagggaaggttatttaggccggacaaggaacaacgaccgaaattaacaccaaccatgagatgaacagggagagacacaggggaacaaaggaggggatgaggcaaaccgaagctggagtaggcaaagggaggagaagaacaggaggagacgaacaccggagtaggcaaagtgtcgaggagtgatactggcggatcggatgtgtagagtattggggtacgttggaacgaggatctacatagtacgacatcgagcagacaaaagacaaggattatactggttcaagccccttatcaggtaatagccctagtccagtttatatcagattgatgatgatgagaacagattacaaagagagtagtcgaaatagatgttactgatgagatcgtaatcgaaggattcgacgagatctcccagcgacttggctccatgtactccggctttgtgaaatttggtggatgtgttcgctctagaattggataccctgaacccctcccagggggtcccttttataccgtggatcatcttgccccccaagaaaggtttgaggataccggacctggtacggtatagcagaaactctatcttttccgagtaggactttggaaatcacctgactcgaaaacatattttctataatttgtaatggtttccatgcgacatttacgggaacaatccgtatatgcgaaggtataccttattggtatattccataagtagcagaataggaggtatgccttatctgtaaccctgacacaaaggtaggagaagagtaagaggagacgcatgtcgaaggacaaatagggagacatcaacggatttccaaatgtgcggccttcaacaaaggaaggacatcgagaacgacatcgccgtcacacaccaaggaaatccagagagggttttcaccccaagacgaagtggtgtagggataagccacgcacaccaccccgtatccagcagagccgacaaaggagcagcggatctgggcgccgccagcctgtcacgccctgaagttcccctccttgctttaaaattcataaaataaatcgtccgaagaaatgatttaatttaacctagagatgaatccctaattaataaatgcaaataataatcggaatcggtatgtggaatttttcttggattctacatgtcaaaatatgctaacaggatttttagtggaattttcagagcccaaaaaataattttaaccaattaaaaatgagcacgtgcaatatttaatcccaggaaaatcccttttcctttcttctttttattttccctctttttcctttgttgggccgtcagcccattcttcccgcgctggccttccctcggctgggccggcccaagctggctcctcccttccccctccgggtcacatacaggtggggcccatctatcggccccttcttccaactcccgccgccgctccccaagccggcggcaaccaccaccaaagccgcccgggccgccgcttcctccgctccacctcatgcccccactccgctcatgtcccgcgcccacgtcacccgcccacttccccactcctcccactcgcgcgcgcaccccgcaacggcgggattcaaattcgaatccccctctctctcccccacctgcccacgtcgtcggcgagaaatccggccgcccccagccacgtccgcctcccctctccgcctataaaactctccccgtgtccccctctctcgcttttcgctctcgctgctctctctcgtgccctcaatcacgcccgcgccgctcgccgctagcgccgccgccgccaccgatccccggccgcgtgccgccgccactacagccgccgccacaccatgcaatcgccgctgctagctacgccggtgccacccgcacctcgtccgccgcacggttgccgccgcttgccaccggaaccccttcttcctcgcgcgccggtgagcattcccattttccccgccttcggccggcattgccgctcgccatggacatcctctctccctctaaatcctcccatttgctcccctaggtcactccggacatcgtccacccgctcgtctcgccgttcgccgcttgccgccgtcatccaccgtcgcctcttctcgcgtcggtcaaccccatggtgagaactccctctcctccctctttctcccctcccttcctctctctctgccgcgccgcccgccgcttttgccgtgccgacgcgcctcggtgccgccgccgctcaccatgaccggccagccggcttgaagccaagccaagccagcccgccttcctcctcccctttgagccaccgcctggtggggcccacccgccaggccacctcctcctcttgtgccgctgacccattggtcccgcttgccggcgccgtcccctccttgatgacgccagccctggggatttattgcgcaataaacaaatatggacttttctttattagtaaaaacacagataatcttccaaaaatcataactaattcatccgatctccgattaagtccattcaagtctcagtaaatacataaaaatgtatagaatccaataaaaatggttttgtttcctgtttcagtagacttatagcatgtttttcttatgtgctttgtttgtcgcgtagatttcgaccgttttgtcgatccgcggtttcccgaagacgttgctgtggtctcatcagtgcgctagcaacgcaagtcatgcattacaattgatcatattgtacccaatttacaaatgtcccgcatttttattaaatgttacattgttttacaatatcatgtggaatgggtcctactactcagccatagattgtttaccttatgccattgataacttgggttttaaaatgactagatgttggttaaggaaatgcttagccatgcttagttcaactagtactcaaagggcaatcacattaatgcatagactttgattattggcatagctttggatttagttaattaaaatacactatatggtgggctgtgggtgcatggttttgctagtcgtgcccatggcgattaaggaccggttcgcgggatgccctggaagaacttatcgtacttaccacaagccagcgtgggcaacggctgggcttgtagtgtagctttcctctagccgacgtacccaggcaagggtgggcgtgatggagttgggtcggccggggtgtccggttgatcggctgccggattcaccgtggcacgagaggggactgcccgctgccttgcgaggagtgggggtgaaacctgaggtgtggtgcgattggttagagggggttatgcgaagggtcctgtcacgtcctctttccggtatgtcgtggtggcatgtcggcgcacggaaacgtgtcgtagggctgtgtcttgtgggtacagttgtacacctctgatcagagtaaaactattcgaatagccgtgctcgcggttatgggcagtcgactagattcaccgtgattagtcccacccctagttagcttttgaactggtgtagttcaggtggttggttgggcctgttgtaacgtagtgtagcgttggacagtgattggtttatattgattaattactacaacagtttttactgctttcaactactgcttttaaatgctagctttatgctaaagaacctttagcctcccttggatatatcctgcatcataccttttcttccggtatgacttgctgagtacagtgggtagtactcagtcttgctctcttttcccccacaccagagttgaagttcttctcagttggagctgtctcgttgaggttggtttcatcgctgccgtcaaggattgcctgtggagtggagtcgccccgctgcagaagtcaagctttcaagtctaccttgttttactttttccgctgcatttgtaatcttttatatttttgtaagacgtggatctgtatgtcaacaattgtcgtttgtgtaccctggctggtcctggacaggggtttaatacacattcagcttagaaattctggttcgtgaatttctgggcgtgacacagccctgcggcatggccagtgccgaccaaaggtacggtggcagaagtcgaggcaaacaccaccgctgcagctctccttccgtcatgccccgccgcttgcgctccgcgtcgccgctcaccgccgcgcacgcgctgccctgcgccgcctagactcgctgtcgttgcccgccgccgccccgccgcagtgcactacgccgtcacccgtcgcgtctcgcggccagatctagccgtgggagcatgagatccggcctcagcgaagccggagtcactgccttccgccggcgagtgccccgcggcgaccggctcgtcgcgcgtgaccccgcctccctcgcgccaaaggcggtgtgcgcggcgccacgttttggccccatcgccgccatcctggcaccccacacggttgtctggcggcggcgaggcagagagaggatggagtgtgggcggcggcggcggctagggtttgcccctgagctgcccgcgcgaggggcgacgcgagggatagttgcccttgtgtgcgcttgtgttttcgagttgccaaattgactaaatttttagctgtgacattggtccatttatatttctagagctatcttaaaggtacaaaccaaaattgtgaatagggtccatgcataaactatctatatatcctaaacattccgatcatatcctaaatgctatctaggatgtttgtataacgcatcgctgggtccgtcaacaaatttttgaactgtaaacttcagtgaacaaaacttccgatcatgcagcctcttcaatatatctaacgtggctgacacgtacgctataactaatgggctcacacgtcaaccacccatatgagaaggcggtatgtcatcctgtccactcggattgtcccattccaacctcgagggcagattgggaggatatagctagcttgactcacaacaaaaaatcatttctaggtttaaatatggatatgtatatttaaatctagaagtgagtaatttttttttgaacggaggaagtgctaccctgcaacaagcagtccattttgtgatcgccgtggctttgtgaacctgtggtagtgtggcggcaggcatgagtctgtagcttgtgtagcaaccttgagactgcgacggaggctgttgggtttcgttgaatcggcggggaagcacgactggtggtgaaattatgggtgtataatactatccattaaacttaaatttgatgtatacaaatattacgcacatacaatttttaataaaattttagtgagattaaagaattgtggtattgtatgtgtagtggtatatgcgcgtgtgtctctggtatgtaataaattaaaataaaaaaacataatgactttatgcatcagtgggtgaccgccctacgtgcgaggccacgacgtcactcgttcgtacctcatgaggcagcagcggtgacactaacggtagtttgttttttttccctagttttttttttagaactgttctttctctaggttatcactgccacttgcctaaactggtagcgaagccattttattatctactggtgatatagacctttttgtttttaaaaataaggtccataaacatgaatgaaagaaattattttaaatatattacttttatgtttgatgatgttgatttttggacatgtgtgataatggctttgtgcatccttggacgaccggtccgtgtgcgaggccacgacatctcttcgtgctatacggcagacgcggtgacagtaacggttttgtttttacctagtatcttattatcactgccaaatgcataaacaggtaacaaagccattttattatttagtggacctatttcttctttaaaatggagccataaacgtgaattaaagaaaccaatatttttttaatttttgatgacgttatcttctatacgtaagtttgactattcatcttattacacaaaatatataattatcatttattttgtttgtggtttattttttcattatgccagttgaaaaacccacatatataggtaccggtttcccaaccgacatccccaaagcggcaccaatgaggagaaatgattggtgccagtgtctaggaactggcacctataaggtccaacaaatcaaaaaaatatcccgctcgatgtatcggttcgattttatcccacagtatctcatcaaagaacaattcatcgatatcttcattcatcaacatcccatccaataagaacaaacaaccatactccgagatcgagattgaaagatacccaagaacatcaatgaacaaaattaagcacatgagaatttcaagcacacgagactccggatctggaagacttggaaagctctgaggccatcgggagggagggagggcgccaccggcagcgacaatgtgtggggaggtcgctagccgccccgctgcacgccgccatggggaggccgccagccgctcgccacgcgccaccctggaggggtctaccggccacccgcacccccacgtgccaccatgggaaggcagcattaaccctaccactgccagcgtctgccgcgacaggccgatcgcccatacgccgactcccctccccctccccgttgctgcccaccgcgagtagtcgctcgccaagataccgaccccgccacctccgccgtccaccgcgaccggccactcgccctggctagatgcagaaggagaatgggggaagagagaaggagagagagggacaggtgagtggagggggccgggcgagtggataaggacgcatttatccatccactcgtgcgactttatccacttgatcggtcgcgcccccggttttctctctcgatcaactcggctcgtttgataggtgccgattttcttaaaaaacctgcatctataatatattatatgtgtcggtttttatttaaccggcagctataatatattaaaggtgtcgtttttttttaaaccgacaactatagtataatataggtgtcgatttttctgttaaaccggcacctataattacttaaaggttccccttttttgtattttcagcctgtggaggtggggaaaacacctataattaccaatgaactagaaaaaatgcccgtgcgttgcaacgggtgaggtctattttaatcttattattgttatatggtttagttaagatgaaattcactgtgggagtttgcttggatatactgtatatatttttagaaaatcatgagctgcagttaggaatttgattgtctcaagttagcatgcgagtttttttaaacatatttcttatatgattccttctgtattaaaaagccgactcaaatacggatttgtatttctaaaagcaaacgaacttaaaaaccaactcatacacggatgacgtaccaaaataccggcaaaaacatcttcaattttttgcagtgcatatttacacataattttataaaatcaccaaatatatgtcaaaaagttaacgaaataaataaaaacagtgggagtgtactttattcattggttggctggtgtaatttttgttactcgaaccatttgtattgtacaagtactccctctgtcccataatataagggattttgtctttttacttgtactgtttgaccgttcgtcttatttaaaaaaatttaaaattattatttattttatttgtgacttattttattatccaaaatattttaagtacaacttttcgttttttatatttacacaaatttttttgaatagaacgagtggtcaaacagtacaagcaaaaaagttaaaatcccttataatatgggatgaagggagtagaatgtaataaggtggtcggtgacacacacaagtttatttatacttagtaaaatgcccatacgttacaacgggacgtctcatatgaaaattggaataaaaaatgaagcgtggtctggcataattaagtgtcccatgttatgttgtgtcgcatggtacgtttgtttcagttggcaggtttgaactaattaattaaactgcataaaataaacaaggcattggattagactgagcaatttcataagtgaaactgatttgtatgaattatcaatcaagaaactattgccttcaagatctaattttgaccattaattaatttctgctccctccattttgggttataagaaagtcaaactattttaagtttgactaagtttgtaaacaaatatagtaatatttataatattaaattagtttcatcaaatcaataattgaatatattttcataacaaatttatattgggttaaaaatgttactactttttttacaaatttagtcaaatttaaagcattttgattttgaccaaagtcaaaacatcttgcaacctaaaacggagagagtaccatggtacatatacatatgtaaaaccaaaaaacagtgaaatccagtaaaattataatcatctcccgtgcatacatgctcctgatgaccgacgtggtcaacgcggtgatctaacgcccagcgcctccaacacgaattgctcgtacacgagagcaaatagttagaacacttcttaaacaactatagccggagatttaaaatcttgcttaatttacctgcctgtcctcgttcccatcttcagggtctatcgctaggttcctcgctcgcccgatgcctcctgcggtttagccatggccttgctcaacgttggacaactgttataaaaccgacccgatatatatctcggaaactgaacatggaagaaacatcataaaagattcaaacatgaagacgacaccgagatacgatatttgataatagagttcagccgatgtctacatctcccggttaccgattacgggcgctcctccctgatccagcatattacagtgtatccggatatccacgaccctccaccggctaggccgccggcctatcgtacccacacctatgctactgtcgtctttcggttacaattggtgtgcccctctatttaagagaaaggctaggatagagtccgactcttactctagttctaacacctattataactccaagttctaaactgtaacagactatatacacatattcaacacaaactctaacaacagcaataagaggaacacaacgggatagggcgtcgttgggggtgagcatcaatttaatttgcattggcggcgagcttgtcaagaggaaggtggaggagaatgcggtgggggaagacgatgttggggagcgacatcgggatatggcgacgttgggggacaacatcggtggcagtggtggcagaagtcgagagaggcggcgaacccggcagataaggaatgcggagatgcgtagagccgagtgctgcacttggagccggggccatctagcgtttacgtcctagcgctgcgcttggagccaagccgacagagcattctgtcggatcattgcgttgtccacgtgttggccaccaggagtgggtttgcacctggttactacctttttttttcccctgcggtttctctgcttcatcttggagacggcgggtgaaacggaattaatacaaaatcgcacttggattcagacgacgacataccaaaattttgattaaaaacatcttcaatttttataataatagagatagagaagagatatgaaagcattcgcaacttgcattaatttcactttctttttgaaatcaccgagtgtcgtatatactacttttggtccttgcaaagatcgataagatggtcgtaaaaggaggtagtatttgaatcacttcccttcaaaactcgcggtttatggtggttaatcaaagcgattgcgtacgtacgaccaacgtactcgaccaatttagtcgtgcctaagcttcaccaatcaccagagatctccacggtataaaattaatattgagatggcaccgtacaatataaatagagcctagtttcagctttgcccaaatcatgaaatcaagtagctctccccgatcgattgagtactgcacaatactcgacctaagctaagctagctagctcgcttgcattgccaggcgatactcatggcacctgctcatcatcaggcagcggcggccaccaccgtcaccactcaagatatccggcgagcacagcgcgccgatggcccggccaccgtgctcgccatcgccacggctaacccggagactcgcagatcgcaggatgaatatgccgacttctacttccgcgtcaccaagagcgagcatctccctcagctcaaggagaagctcgagaggatctgtaagcacgcatgcacatcgaccgtatacgttaatttgttcctgccgtttccaaccattttttcgcccatcttattatttgaaacgtaacaacactataaaaaaaaagatttttgtggacctcggcattcttctgcaagcggaccaaatgtaaaaagaacgtaggccatctcagggccacagaccgtctagctgtgaaagcctaattctacaggctattacttaagaaaaccataaaaaaaagttctattaatattttcactggcgattttcctaaggtaccacctataaattctttcaaaaaaaaggtatgacctataaaaatagaatgatttataggtgattattttaagaaaataaggtatgtaaaaatcaatttatttggacggttaccacccataaaaataggagcgaacctatttcaagagaaaatactacctttgtcctagaatattaaaagttttaaggttgaacacggtcattaagaaagtggatagaatttaatggagggaggttgttattggttgagaaatagaggtaggtgaaaaaattaaatggtggaaagttgtgattggttcgaaagagaatgttggtgaagaagttgttatacttgggacagattctgaatgttagaagttgttatatttttagacggatggtgtatcttttttacatgaagtcagatgatgaaaaattttatatgaaattatagctctcgatgaaactttacagttgaaagttttttttatttgcgatcattgaggggccaaaatatgtgttaaagctcttaaatctattttttaaaatgttttcttatttttttaaacaaccttagatgtagacaagttctatattaacactgtagagctctacgcaatgtacaactttatactagaaaggtttgatatttagatcattttggtgtcttaaaaagtatagtcattacaagctcttgtatctattttgggattctttacaaagttcaaactttgaaaatttcttgcaaattcgcaagccccatcaaggtaaaatattcatatatgtgtgtgtgagagagagagatcattgtagtatttcctttaatatgacataattagaattttcttagaatatttcttatatatagtgattcactaatatcaggttgtataacatatcgaatcatagtctacgtaagtaaataatcatattgaaagaaatattttaagaagatgggccttgccatattaaataaaatattgtaagtctcatataaaactttgattcaccttaattaaagctaaaattagttctctataattttttaaatttagtcattatcaaagaataaagaaaaagtttttgcaggacaaaatcttaaagaaccaccaataaaatgatttttataggtgtactttttaaatagtcataggcagttctcaccaaaaaaaattcctataaatatcaactattgcagacggtttcttataaaattggaccttaaatatgggactatcactggaatatgaaaaaaaaatcataatactttttatatgaagtcggatgatgacaaactttacggatattgtagctctcagtgagatctataacttgtagtggaacctgttttcatttgagattgtttattaagggtccaaatattcatttgaaagaaaaaaaatgacattttgagtttttcaaataaactcggatagagagatatgctctatatcaaagttgtatagcttatcacgatctacatatttaatttagttgatgagttctccaattgatgtcatttaattaatgtataaaatatgtgttaaaagttttagagcggtacagagttaaagaatagcatccaacccatagtcaacccattatagtgtatatcttaggggcaagattgttgtatctgcacaagaaaatgccattattaacagattcctttgctaacttctggagcaagtcctcaattaatacacaacaatgtttttttggtatcaataattgtggggaatctaaaaattgtgacagaccctcgaagaattctatgccaattcatactctctgatcttcctttgatgacatgaatagatatttctatgatagacttgatctagtaggtgaggacagtgataagagtggttatcttgccattttataactgacgcaactataatttaatcaattaaaatgatttagaaaattatattcccatagatcataaatatttgatatttaggatataattcgatcaaatcgttgaaacttagcccataaaattctagtatattataataaggtgataaaatttaatacctttatttttaaaatatatggtgctcttaacttttggatatgtcatttgatcatttgtattatttataaactatgtaaatattatttattttaattctatttgtttcatcataaaatgttttttaaccatgacttatctttttacgtatttgtagtatttctttaaaaaaagatgaagaatcaaatacctgtgttcgaaagtcaataatatcatacaagagtacttaaaatcagagagagtaataagctcaaggtattataattgtatttttcaagaaatatcaatgtgtgtgcatgactatgtattttataatggtattgagatattattgatggctaaaagtttcaattgaatttataaacgttaaatatttatgatttgagccagtgttggaggaatttgcgtgcttatattatataattaatatggttgatatatgttacaggtaagaaatccggcatcgaaaatcggtacacgtacgtgaacgacgaggtcatgaaggcccatccagagttctccgatcg

SEQ ID NO: 66638 - DNA, 686 bp, Oryza sativa
cagggatgggaactaatccctcctgcacggaaaatggaacgatctattagcacatgattaattaagtattagctaaattttattttaaaaatgaattaatttgatttttttaagcaactttcgtatagaaactttttgcaaaaaacacaccatttagtagtttgaaaagcatgcgcgcggaaaacgagagaggagggttgggaaagttggaggccgaacacaccctaagtattctgtaaaggaacattggacatatcatattactgttggaccagactttagatgagtaattttcttgagaaaaatgcattatgatctttccttgaaataatgacaggaccttcgtgcattgacaatgaagaaaggtgttagcttggttctccatggagcatccggactgcctcatgaacttgtaaaggttcgatatactgtttctgtctttaataagattgattaatgaagttttagcctgtactcgatgagtttccagcaattacagaagtttgtttttaccttttttgggtgaaagagggaaatccatcacctatcactccccatgttttctatgttttgtttaatcagtttgtgcatgtgatcgaacatggtataccatattcaaacctagactttctttgttgaagacttgttaatttggagcatcaacgatggagaaaaataagtccttc

SEQ ID NO: 66639 - DNA, 7924 bp, Oryza sativa
agcatagctttgacagtccatgagtggtggaaggcgttagctgctaacacgggtctaccaaagaaaaggtgtttgcatcatcattttacttacaacacgtgaaatctgaaaggggagaaactaaagagtatcccaacataagaaatgtttagcaatagcgcgacgaagatcgaggatgccaaaatctatgccctaccaagtaaaaatgattctttgatcttgtcctcttaaatttatttttttttctcgtacatttctttttgttaattgtgcaggtcagtttacaatggctacatttaatgaaattggcaaactatagaaaccggtttattaaagaaaacattattcaaggtttacaccctaccggatgaataatttactactctctccgtttcagattgtaaaactttctagcatttcttatattcatttagaagttaatgaatctagacacatatacatctatatgaatgtggacaaaagtcttacattgtgaaatgtagcaagtagtatttatcatcctcctaaaatacacaagcccaaattcccaaaatgcacgtggccgtaacaccatttaccacccacgtgctcctacaagaatcgcatggagccatggacctactgtctactggcttggtttcatccagaaccatgggctcttggcagacaacccggccttctcacagtgttttgattggtacacctgggtacgagcccctgtgctgagctgacgatgaactgtttcgcgtgtcgctgtactgggagtattgggtgggtcagtgggtgggtgtgaggaatggacaactggacaggcgatgcggactgaccggtccgtggcccgtgggggcgcgggtgccgcgacatggacgcgtcggtgccctgtttccagtgaccctgtaggaggagaaaaagaagggctcgccgctgcccgctgtaccacgatcgcgtatcgacacatgggcttgcactgcattgcacacacatgatcatccccgtcacctccagcttgtaccggccgtgtatgtggctgccattgccatatcctcatcacatccagctggtgcctgccctgccctgccagaccctttttctgtgccatggaattctgttcgtgaacacaacagtgaatcaccaagatcgagaccgaggcggacgaggccgcgcaggcacaaatgacaagccgcctctgctccaggagagcacggcgccggcgcgcacaggggcaggacacggcgagggcccggcgcgcgggggtcgacacgtccgcgccgcgggggagagcagagggcgtcaaatccgtgtgtgagtgcgcgcgcgccgtagcggcgcttgtctgtcgtctgtctcggcgatcggtcggtctctcgcggcgcgccggcatgcaacgtcttttctacgacctgtggggtttttggtacgcgcgacgcgctatcatcgccatgtgcgggtacatgtgccgcctggactgggaggcgaccggccggcctggccggcacagtgcggtgtacgcttggcataatggaacgtatagtggtagctgccgtctttggctaagctcgtaagagtgctgtttggccacgactctctctttagtttctctgtcacttaatttagttgattttttttaaaactcatatattttgttgattatagatataactaggtacatatcacacatgagttatttacctgtaaatataagtaattttttaaaaaaaaccctcgaagatagtcaaattaacataaactcctaaaattcgctaggaagagcttgtaagaaactagaaaaaaactgtgatgacggtgatccaccaaaagaaacacacgacttgctaggaagtgatcattctcttctttaccacgttgcaagttagatccacgctgatgacggtgacaaagaaacaaaaagtggttgtagatgaaaatgttaggaagcatacccaaaagagacctccgcttggaggttgaggcttatatggcaaaacgatgaaaactcagcttctcccttaagatccaccactggtggcgaaggaggcttgcattcttatggttgcctcacctaagatgaatatgacggccggtggaatctcctaagaagaagcaaacctatcttacttctaagggagcgtccatggtaaagccagagaccattccatggatgaatttgactggaatcaatagaaagccatgggaataaaaaaaagcgatgttgatgaactcttgcactacataaaagcaccaaaagaaaagcgaaaaaatcctactacctaatccccttcccttcgctggcaaccaaagccgttggaatcgatggaggaaaagggtcgggcaaagaggaacgaaggagcccattttagggcccctttgaattggaggaaaaaaatataaattttggaggatttcaatcctatagtaaaatttcaagcctttgaaacaaatgattgaatcatatccaatcctttggaattcctatagaatggacaatcctataaagattttggaggaaatttagcaaaagcttcaacctcttggtaactttcctttgagtctatctctctcatccaattcctgtgttttttctgcggttcaatcaaacggtcattcttgtgtttttcctgtgttttgcaatcatctgttttacacttacattcatgtctaaattctacatttttcctattcctacgctttcttaatcctgcgaatcaaggagcccttagactgtgctttgctagcttgcttctggttggtccaagtcaggtgctctccaggcaacccaccatatataaccggatactctatccgatcataaatatttaatttttatgacaaatataaacttctaaaagtttgaccacttatttctataagcatctaaattgattatttgtgggtcaaccagaaattgtttcttttttatggaaggtgtaaatttataaaatgtaaaaagcctataataatgttacgatagtacttttcaggttaatccatatgttctttttttaaagttctaacggtttaataaaattttattctaaacgtcggcaattgcttatgaacagagggggcatacagttacatgaagatactggttgtcgaaaaagtacacccgagcaggtactttatgtacatcatagctacgtgtacacgtacttgaacttgcggatacccggacatgtacatgtatatatgtaaggccagtagcagtgcaaggcacgcttgacgtgcctccagcccatttaagcaaggattttggcccaaaattcatctctaggttacgcaccccataccacagtgctggtgacccaatcttgtgaccccacgccttaaaaaaatctcgtgaccttcctcatccttatccccacgacgaaggaggcggcgcggtagcctcgagatggcgacgcagcggcccacgcgacggcggcggcggctcggctgacgacggtaacctcggcagttgcctcgtcgtcctccgcggatctggagcagtggtgcggcgtcctcaggctcgtctccggccggcacgacgtccacggctatcttgagcggcgcgacgtcctcggactcgtctccggccagcatggtggcctcggcggcagaggtcctcgaggcggcggcttcctcgaggccgagcggcggcggcggcgtccttggcactccctccgccgacggcagaagcagcagcaacaacaacagcctccctgagcccacgcggcggcggcggctcggccaacgacggcaacctcggcggtggcctcctcctcacttcaagatcgcgttgatctttctcgtcaccgccgtcgcatttctcttcatcccgtcctctagcttctccccttcctcaccggagccggataggattgaggattccagcacgggagcaagatgccgagcgagggaacgacctccacaacgcaaggaacggcagcacgcgccctcgttttcgacgagataacttgtcgcccagatagggggcgagcaaccaaacagagctccatgctctagtgttacgcacgcacaaatccgagctggcgacgcgaggttccgcgccacgtcccgcactgtgagaggcctaagtacattgttgctggctacagtgaatttgatccgaaaggtttgtgtgtcctgataggttgcaggacatccacaattagacgatgacgacatcaaaagcatgatgtttgaaacagagcccattaattctgtcatattttcagtatatgtactaaaagcacagagtcatgaaatttatatattttgccgatttcaaattacatttttggtttcagaattccagtttcaaaatgggaaactgggttccaacttttacttctggatgatttcatttcacccaaaaccgttttatctccattttaagggaccccaaattaaaacctactacgacctcctcctgttttaatagacgacaccattattttgagatatgcatttgatcattcgttttataaaaaatacataattattattttaatatgttgtaacttggtttcagatactttaagcatgacttatattcttacatatttgcagcaaaattttaaaaagacaatgattaaaagatcggacggagtgtttttgttggtttatcggtcgtacaatataatttgggactctaaaatccatgatctagtacacgaagttctggaattgagctctactaatatacaatatacaagcttgtttgaaagtgtgtggacaagacggggacgtaggggtgaactattgacaagaacccagcaaccagctagcggagcccggccacttcggtggtgtttgaatctccttacataaagataaagatgaagattaagttttttaagcaaaacgatgtggtattaacgtatgattgtttgagttttaattattacaaacttgaaaaatagattaatatgatattttagagcaacttttatatataaagttttcgcacgaaacgtaccatttaacagtttgaaaagcgtgccacgaaaatcttaatcttcatctaacttttgttgatgaaaagaacgggccgaatcttcccttttcttgcaggtaaccagctgattttaattttgctacagtttttgtagccatatctagctcttcgtattactcgagagaacaaaaatgtcttcacacattgatacatacagagaatatttgatcaagatctactccccaattcattttttactccatcttcatgatgtccaattattatctactttctccgagttgataatacttatcgttttgaataaggacacgatctctaaaaaaaaaagttttgaccattattttttattataatatgtataaaagtgttaacaaatacatgattttattaatgtattttttaagactaatctatacatatagtcaccatatttgaaagacaaatattttaaaaataatttataatcaaagattctaaagtttgaccttatacctttgtctaaaacgacaagtattatccgctcgaaggaagtatactactcatccacaggaaaaaaaaagagagccaaaccatcgatattaaaacgatcgaaatgacagggaaaaggaggtcaagaatctacgctgcctctgaatgtttccagctccatacatttacacaccagcttaccgttgaagctcacagccgatacgttcggcgagaacaatgccggcctaatcgcccaagattattagatacatgcatcatgcatgcatacatatataaacagatatatatatatccatgtcatgtcaccaaaaagtgagataaagggatacagaaaaagtgacaccgatcggattacaaaaacaagtggcaagaagtagtgatcacaggatcaaacaaagtacactgcaagcaccagcgaattgaatcgaagaacagcagttgaatagtaggtaggcatatatgcaggggggatgctaggactctcctgccatggatggccattgcttcaactagtgtagctagctagagatctctcactgctgctagtcaaccatagcttgcacattgcgattgcgattgctcactcacaatcctatgatcaccttgattaattcacaaatcaactaggataatctgataatgtgcatgcaaacaagcacgaactggtagtctgtaggcctgccctgtagctacgagctagctagctcacacacacgagcaaagctagctagctgcagctaatcacagtgtgccttatttgacagtgaaattaatgtaggggaaataggaaaactaatagaaaatgccagtagaagtagtagtaattaattaagctcgattatattgttttgtccatgcaagatcggtcgtcgcggtgtcagggtcgtcgtcgtcgtcgccgtcgtcggtagccattagcggcggcgagcggcggtctcgcgctgcgcgttgaagtagacggcggcgacggggaggccgaggtcgttgtcctcggcgaactggcgggtgctgaagcggtccctcgacggcggcgggctcaccgcctgccggcgcttctgccggaacagcaccaggatgaacctgtggatgccgatgtttggccgcgggctctcgtagctcaccacctccctccctgcatcaccattgatcacacacaaaattaattatagagagatcagagaaagctataacctagataagacaaataaatattgttttgattaattagtacatattttttttaaaaaaaaaatagttactacattaccagtttaccacaaattaattgaccttgtattgtggctaattgttcactctggatctctctgatcagtcaattctcatcaaggttcaaaactggcaaagactaaagcaggatgtacaggggaaaggcttaccaaaagaggcatcagtagtcccaggaatatcagtaacaatcctgcagcaaggtggtccaatcaaaaggtcacctgattagctacacatactctatagaatgcattgattgaaaattaatctggaaaaacaatgattaacagcatgcatgacagaatctttgcaagcaatcaatcatggcgtgaccagtgaccacctatacaaatttgtctggctatgtaggtgacacttgtacctaataatgtctaatcaacttgaataagaccgagcaatattaacttgtacaggtagtagtataaattaccagtgaagatgctccctcaggtatggatcactaggccctggcacatcagggtcagtcatcacctgaattaagcacacaagtacaaaggatcaattagcacataatggacacatacatattacagtatagatgtgcgatagtctgatgaatccagcagcagatgagacaggcatacgcaccaatgtgaagaaggacctgaggtcgccgccctggacctcgacgcgcggcttgccggcgacggcggaggggaagaactcgtggccgttgaacacctgcttgttggcgccgtaggtggccgtcatcttcaccgtggggttgaagttgtccagcacctcgccgatcaccttccccacaatgagaggctccagcaccctcgacatggccgtatatctatctcaagattatctcacctgaattgattcgatggtcagtggctgaactagtgaactaataactgatgagctgctaagtgtagtatacactcttgtactgctctctcagctctctctctgaatatatgatgtggctaggtgcaggcaattcagttcaggatggtgaagagagcaaggcgcaggggcgatatttatagatgccaagaggcgagaagagcctatctgttcttgtcctgtcctggctggctatattctgatcgtgcaagctgagtgtgatggatcatagattacacatattttcgaataggagagtagtatcggataaaaagctcaggggcatgtctatcacaccagagatcacattagcatgtcaaattgtttaatcct

SEQ ID NO: 66640 - DNA, 1350 bp, Oryza sativa
cggagtgattgatgccattctgtcatgtgatcaagttcatgtccatactacatacgtcgtctggtcctttagagcaacatgacttcaggacgttgctatcaacggctattgatgataaactagtaataaaatttgtcgatgaaattacttgccgtgataaatgattccgttgtcgccaggttacagttattcaacgtaagaacttcatattcattctagaaaccaacactattcatcaccattttcctcatccccgaaaaactttgaccagtacctctgtttttgccacccccctccctccccggccacaaggtgtagaatcaagtgccatcgctgaccaatttgagctgctcccaattaaaatacaaactaaaataaaaaagtatagaaaaaatgaaattacctatggataatattatgtcaatggcattaaaatttgtgaattttggcatttggataatagtacctccgccttaaaatatatggatttttcggattaggcacgagtaataagaaagttggtggaattaaatagaaaaatattatgattggttgagaagaggaaaagttcgtgaaattaaacagaaaaatgttatgattgattagaagaaaagaatgtaagtagttcgaatggtgtaaggttgtgattggttgagaagagaatgtaggtagagaaattgttatatgttaggataaaatttgaaggatacaagttgttacgttaaggagagagtattatgtctatgtactatcaaaattcaattatgattttttttcaacttaagctgttttcgtcaattggacgggatcttgctacgaccacgatcggtttggtaaacgacctgccccaatccttcccacgcacctcctctcccttcccgcgatcagtcgtcgcctaccaaccaactacataatgctctaccgacacctcataaagctctctcctcccccaccctacgctaccgtctctcgtgcacgcacttcacgacgacttcgccagcaagggaattgtactccagagcaacagctcaaccgacgacgagagctcacaacattgcctttgcaaaaaaaacaactcgcgtatttcccattctttatacaattcctgttatagtgtggtaaaaaatttacacgtattgatctctaggctgcctggattgatcggcgtcagccctctccagggagctctcgatcctgcccgttgtgacaaaaataacatacacaaggcacaataggatcgactattctaacaaaaaaaaaacgaaaaaagaaagttaagaaaaaaaaaacgaacggcatgttcttctcccatcattccattttgcacttgaaccgtctggatgcgtctga

SEQ ID NO: 66641 - DNA, 3802 bp, Oryza sativa
aaaaaccaacatgagctaagacctcatggtttctcttgtttgagtcatagaattcctatattttttcctatgctgttaccaaacaacatattttgctaattactttggatttcttccttgtaggattcaacaatacgtgacatttgattcctgtttttttcaaatcctccgttctaaaatagccctaattagacacttcctaggagcgcacatgtttaaaaaaatctgaccattgattagatggattgcattatcgtaacagtagcatagactaatttaatagttataaaattcataaataataaatatgatatgtgccaatcttagtatcacaatttggtcttttattaatttaattctaaaattcaaaactaataattaacatgttgtaactgatatggacacttctttttaatataagcaacttataatttcaaaggtaactaaaaattattagaattttatatttatatagtatcagtaataatagtccattaacttacgggttgatgactaatgtatttaaatcgattagattatggaaaatagctcaatgttcagcactttactatggaatcatcatatccaggacgtgcactctgttttgtcttgaaaaaaccttcaaggattaatctgtggtgttgattgtacaaacccatgcacatgtcagagatggcagcttgattatgctaattaagtggttgcttcttttcttttgcccctccttttaaaaaggagcatatatacaatgtcaatgtaaattctccatgtccacgctatccttttacttgcttgtacattactttgtattaaactatgtataaatgtatattttctttatatcattctttgcagctggagtgatcaagcttggacattctcaaagctgcacagcacagctccacccacaagcatccatttttctcttgaggtaaaaaaggcagagcatgatgaatcatcttgctgttatgggctatgaattgcaaaaggccatgccctgaacggcattgcactagcaaggagttgccactccaggtgattattccttcctgcatccgcagctgctcagcttgggtgcaggaggcggccataaactaagctcaagtggttgaaggaggccttcctccactacttcacaaagtggccctgtgccaatgtgttctctctctgcctgcagcagcaacaaacaaacacttctttccagggaaaaggagatcctcaattatgagctcttcattaggcaaaggttagtgctcttatttccataaatggtggagccacctccaagtacatccatgttctttgcacatcgcaatttagtatagtcatctcatctccctgctgcatgtagcagctactcgtgcttgcatgctgtgtgctaagctaactggagccacactggtaaactacaattgcctaattaacattcaaatcgaagcaaagaagtttaacccgcattctctgccactgggaaacgtcaaattacgttatggatgaattatgatgttctgtatgtgttctctttacagtttacatggatgtattgctcagccaactgttgtctgagtaactttaattatattttactctggaatagtactccctcgtttttaaatacatgacaatattgacttggatataactcttgatcatttattctattcaaaaatttagtgcatacatatatataaaagtataagtcacgcttaaaatacctttaataaaacaagtaatgataaaaatagatcatatttacatagtttttctaataagatgaactatcaaacgttttttctaaaagtcaacatcatatatttaaaagcagagttagtacgtaacaaaaaaagagtagggcacaacctttcttttattggctatggtttcaagtgtgaggcactgcagccacaaattccacttatttgagggcatgttcggaatgatgtgaattagctgtgatatatttgaattgatagggaaatcgcacatgagttaggtataatttgcctatccaaacaaagccttgaagggggcaaggtgccaaggtacttgtgatacttttactgtggtctctgttgttattattttactacctgtattatttttttgacatgattactacctgtattattatcagtataaataatctaaaccattaatttatgagttctactaccaatagaaaaaaaaaatctagttgagatggtagttcacatatatttggtctactagatgagaaaatgaaatttctaggttgattttactacgagtagagaccaccacaaaaagtataggtataatatatatacccaattgaaaattttagttattaattgcaatataaaaagaaataaaacttcaaagaaattttaattgcatccaaagaattgtagtttgaacttctagtaaattcctttttatattgcaattaagaactaaaattttcaattgggaatgtatattgtaccgacaatttttacggtggtctcttgtagtaaaatcaatctagaacttccattttctccttttacatatttttttatttgtcctgagtcctgacagatctaattaatttcttacatccatggtgaaagaatttgaatctatagcagcatgcattgatcttatagattaatgcgagaattttgctttttaccatatagatgttcctagaggaatcttcaattaattatatagttagagttggtcaatgtacaatcttccaacactaaattatatagaggctggtgtaacgtgtgtaagctagctagcttatgatgattcatggccatagatcactgaatccaaaaaaaaaaaagaaaaagaagaagcgaattttaggaaatgatctaatatcaaacaaatagaagtggtgtgacttcgaacccaagccaactgacctaccaccttgtggagctagccagaagacctctactgaatcctaatcctactgtgtcatttggactttggagtttgccagtgcaaaaagaagtgtacagatcagtagatagctacttcagtaatcagtgtaccatcacttggtgcgaaaaatggaaaagacttgtttcttataaggactagatccgcattaaacgctgctttacagacaaccattcaggatgttgaaaaatcacacaccctacatactctggaagatgtaccaggtgaaggtacaaaatgccaaatgctttatcatttctgggcacatgacatctttgccgaatgttctcttcttctcaaatgcaaaagcaaatggaaaaagggtaagctgatttccatgggggaaattatgcttaatgctttcctcaaagcagagcgccatattgtcaatttgtcatcggctgatgagcttaacagccgaaaggacaagcatcagtggcaaatttaattatatatcattttgtggcaacatgtcagtttgcagattcttctcccttcagaatggacgataagaagaatttatttttcaaaagataatggatgagaagatgcgaagaacatatttatcattcttcatcaccagaagtgagcaggggataaaaagctatgttgctatatttcatctgcattggagtgttgaggtcagtaatttccctcaaatggtgaacaattttctgaaacatttttgagggcatatattttcagccgaagatggtacttaatatgaaaacattgtcatgattaatatttgtgataaatatttggttttgcaaatgatttattcaatgacttgatttgaaaagatatgcggatgttggtgtgagtgtgtgtgactaatatggatcatgttataaacttataatat

SEQ ID NO: 66642 - DNA, 3213 bp, Oryza sativa
acatgggcccacttgagttcttcgagaggtcacgtgcactgcgtgggagctgtggacaaacgtttcgctgggcctaaacatatgaagtttctcggatgcgtatcatgcactgtgattggcctaagctaggtgagaagtttatcttggcagcaagacgtagctgcgggcgaagcaaaccaattagcctatgataatgtgtgtgttgatgcaaatgtaaagtgcggttgattttttaagaggtaaacggtgccatatcaatccaacaaaactatactagccggtcagtagcttgtgtttttatatatctacttcaatttacagctgacatcataatatggagacatggtgggccagcgtcgacatttcgggttatttttccaagcaataaaaaacagagtaatggatatgacgggataagcaccagaaatggaggagaggcggcagaaaagagctgctaaagttttatgaatatgataaaagatggcagcgggacggggaagaagagcacactgctatgaaaatcatttttcatgcagccaaaacatatttttgcaagaggccaaactccatgcctgcaatcaaaggcatatgaaaatcattgatttttttaagaggacttccatccacattttcatatgcggacaccctaagagacttgcttgcaaaagcaaatttcgtatgcagaacccttaagtcactagcctgcgaaaaggtatttcgggccaaaaaaataaaaattgatttttataggattgaatcatcgatttaaattcacatcagaaacatatccaaaaagcactacgtcgacatgcatctttcaagcattttctcaacatgaataagcacgactcaatcaacaataacagatcagccataatggcaactcatcatcaacaatagtatatcaacaatagaaaatcttggatcaacaataataacatcacaatccaactcagcgcataacacgagacaacgaaggtaagtagtagaagtagatgctactgttggaaatggtcggctagtgcaaaactggcaatatttgtctctgttttctgttaggccatgcccaaagttcctatgtggcatgtggtgacagctcgtctcacctgaatatttgagctagcttggatggatttgtaccactgtacggatgtgtgaactctacatgaatgtgcataccttgcaggcgaggcaatgactttggtgctctaggcctggagagagaaggggaaggagagtaaagtgagcgcacttggagacttcgataagatcgagtcggtatagcacttcggcgagtagatggggtggtcaaacagcatatcagaccactgccaatgaaattgacacgacctcactggagaaatctgaagcaagctcctgtcccatcaaatcaatacagcctcgtcgggccgagctcttgtcccactacctcgatctggccgacatagcaagctctgttcataccatggggagaagtggagaggtagcggcgtgtgggaggatgtatgtgtcggcagcagtagtgaagcatcggaggaagacaagcgggcagcacgacatggcgcttgggagtaagagagtgggcatcgcaaggtggtgatggggacaatgtggaggtgtgaacaacgggaacaggataaggaagataagtttgtgaggataggacaagtgggccatggactaatatgttaattgttctctactttgaggggcttcgttgcatattatgtaattccaatatattttatgacctgaaagtaaaaaagaaacgaagggttgacatcgaaaatggatatgaaaggagcttgatttcacctagacgaagggtgaataggcgttcctgaaaatcactcgcagcgaattcatgtttaccgaaactttaggtccgaggcaccaaacttcaaacagagaaagttgacctgaacttcaggttcactttcgttgtttcaaacggagaaagttgacctgagctttagatacttggtatcggaagttccgacaccataagactgtttcttcgaggagaaattgctcggggctgaggtttcaacagagtaaaagtaaagtaacatgaacacaaggggaaaaaatgcacaactaaggaaggcacgagatttttcaccgaagttcagatttttcaaccctactctccgttgagaagctcctaagagccagatcgctttcaatcccttgcctctccaagctgttaaccaggggaaagctccgatcaccaagcaaacaccaaggatcagtgggtttcctcccaaccacaaaggttcaaggatggacaaccctcagcttccttgggtgaagcttgctctatcaagtaaacacctagaaattagcttggtattgcctaacttacctctttcctggcggtggtgatgcaaaccttacaaactttcctgggcaatccacacaaatttgaattctacggacgatgcctatctggctaggtagagaaccaccaagagtaataagcatgttgacgaagccccgacattgatccaagtgctcaagcaagaaacatagctcccccatctctcaaaagtcaaaatcccatcactcacaagatttttggctcaagaatcaaggtggtagaggctagaaaccctagagaggctatggagagaggtattgaaatgtattccagccaacccctcaaatagggggtggcccggtttaaatactcgcccatccccacaactggtcgttactcacagattcaaacaccggaagttcagtctggagactcggccaatagctaggatggggacttgaacttccgatccaaaggacctgaactttaggtcttggtactctgtcccgaactggaaactgcaactcgctttttcccttcatgagtatggtgcattgtgtctctctctaaatagatcaaggtcactctagagtacttggacacacaattcaagacaacgacacaagcccctcttaatagtgcggattttcctatgactgaaattcaaattaaaataaatttaaattgccttgagtcgaataccactttgttttgtgttgtagggatctccctcttcttgggtcaataatatatgggactaatatatgcacttatcttgataaacttgattagtccccaaatatatgttgtcatttatcaccaaaacccactaggggtccagatgcactttcaggatgttgggcccatttcatggtatgtgcgttgggagggtt

SEQ ID NO: 66643 - DNA, 43005 bp, Oryza sativa
attcgtgcacgtcaacagaagatgggatcagatttggtatattgtaatttgatttaggaatttagggatagattcctattggaaatagaagttctacttctactcttgagtaagaggtttttatataaatagagcgagaggctatgccttgagggtaagctaagtttgagagattagagagttgataacactttgtattagggtttcatgagaaacttatgagaggagtgttgttattgcactttgtaaaaataaatagatgcataaagttcaatatactttcaagagttttttttatttgggtttgcttgggtccgatagtcaggccgatgacaccactacggttagatcggtggagatggtcggaggaggcgacgcaaaaagcggacaaaccggcgcaagacgatttccatcgaattcgagtgtaacttttaattctgctaaaagtttggtttttggcgttctaaccattcacatttctctgattggtttagttcttgttgttcgacagttaagatcagtttatgtttcagataaggaaagactgcataagagaaaaggatagaattttgtaatgcactcatctgtgatgagacctccctggtggcctagtctccaaccttccttgtggttgtagttcattcttctttagatgtttagctgttttgccatcataagctcatcgatccagtgttttgttttgaagatatatttgtgggagacatattatactgccttaatatgatgttgttgatttttaatatatgattgaccatttacattatttaaaaattagtagataattattatttattctattgtgtttcattattaagatgaactggaaatggcgtttgtttagttggatagagtcagccaatgggaacccctgtatcctcaagtcttctcccttagcaaccgcgcttaataggcggagttaaaaaagataaaatgcatgaaccctaaaactatatgtatacataaaagtatatttaataataaatcaaatgatagaaaaagaattaacaattacttaaattttttgaataagacgaacggtcaaacatttttaaaaaaagtcaactgcgtcaaatattttgggatggagggagtagttgaaacttcgtggcatctaacgttaacgcattaccacgagatatatggacaaatatatattaaatgttgtagatatgatgaatggattagaattcaaatattataaaaatgatataagaatgatgatttagcatgtctgtacgttgagctttagaatgtaataaaatgtagatataattactatgcttttttgttgacctttaaataatcgagtgtttattggattaatgtggcatgttcgtatgttaggctttacggtgtactaataattattatactcgatgtttgtatgtttagttttagtgctttgtgagttgtaactatataaaagaagtatgaatatattaccatgttcccttttcctttgttccggggcaacgctccggtgttctctacttttagtattatactaccagtagaattaaacttaaccgtttattttaaagggtagattagtaatctagtaatggtaatttcggtaggggctgatttatctgtattggtcggacgcaggcatcacatcaggtccgaccgtccgacgcaggcaccacatctcgcccaatgcacgaccactgattgcgactcctcaagtagcccctttaggatccacagaaacgtgagaacaagaacgccgcattgaccgagaacttaacctgcacaagcataaactaaacacatcaagaccagatcacacacaacacaaacaaggatccgctcatttcgaacaaagatgaaacagggagcaaacagaaggttgaacggacccgctcagcagggacggaaagcggcagcatggacctggcggcgcggcgcgcgcgacgggagaccttcctgaacaccgagtgcaggaaccggaccaggaggtccaggctgcggtcctcgtctccgtcgtcgtcctcctcctcccctgtgtcatcgttgtcctctttgctgccgttccagtaggacgcggcggcgcccgagagcgcgagagggcgagaggttcccgaccgtctgagtttgagagtgaaaatgacaaaaatacctctccgcatatatttttttttgacaaaaatatccctccacaattctactatcatcaagtgtggtagtagtagaaatatatttaaaccgttcgatcaaatacgatcaatgattcagattattctctactacaagtagagagcaccagagtaggactctttgttccgtgctataaagatcttcacaagggttatggtttggtgatcaaacccaaattgtagagtacatcggacgattggttaacacaataacatgtctaggacgatatatttttcttgtgttttgtctgaccagtcatagctcgtgtggtataccaagatgggatctaatagtcatagctaggactgtcaaaaaagctcgaggctcgcgagcagctcgagcttggctcatcctaggctcgattcgagctcggctcgagctttaaacgagccgaacccgagcctgagcaaaagctcgcgagctttaccgagccgagctcgagcttctaccgagcctggccgagcttgactatgtatagtttatattgcatgttcaccttattaatataataaactaatagataaatatgtatattagtatctatttacacaataaattaccatgtgttagcgcaatatatttattttaatcattttctactcttttattagtgtgattaactagaaaataactatacttatcaaaagattatcattaaaatatatattatactatttatggccgagctcgaacgagcttgcctaaaagctcgaagatgagataggctcggctcgagctcggctcgagcttgtgtcgagctcgagcttgtgtagacgagctcgctcgagctcggctcgttgatagccctagtcatagcccgtgtggtatatcaagacggaatctcagatctggcgaacgtagcttactttttttttcttctcttatatttttctcccgcttaatcagtttttcttatacacctatttttgtacggttcttttatacattagattagcatgggaaatgaatgggaatgattcagcttttaagatagtggtggtcagtttttattggtacaccggttacgtagaattgcgtagaattggggtgagaaggaaagtaggattaaggcccttctaggtttataaccatcttatgagtcaaaaagctaggtctaaacaaataagttttttttgtcttttttaaagctataaaagccacttttacaccgttaagtcaaaagttaggttagataagttttatttggcttatttgaaaatgaaggtatgactctaccattagacttaatgctttaaagccatcggctttaatacatataaaccaaaaatttagcttaaaatctaaggcaacaaatctaagcccaaataaagagcccataagacagtagaaaaatatattcggttaggaataagttcatccaaggtcccttaatttgtcaacgaattcgattttcatcatttaaccacaaaaccagatacaacgggtccctcaactatcaaaaccggtgcaatataagtgccatggcggtttggagggtggttttagcttacgtggcgcctacgtggctaaattgacccggtcttcatctgacgtggcatagatatggcattgacatggcaatttgatttggaaattaataaaaagagtgaccccacatgttagctacaccaaaagaattaattaaaaatagtggggtccacgttggctccacttttcattcactcccctcatcttcttcctcctctctctccccatctcccctctcctctctccaggagccggcggttcagcgacgcggctggccggtgacggcggagccagggatgacctcggagacgaggacaccagggagctgcgcctgtacggggacgctgacggtgattgttgttactggactcacgcctccgtcgcatggcttcgcttcgcttgcctcctgccatgtttttaccatgccttcttcgtcagtgagatcctctctatatgtgccgttcctttgtagtgatctcgtcagagttggtgttgttgttgttgagctcaccgtggtaggagctgagagggggagagggagagatggggcggccgccgtgctgcgacaaggcaaacgtgaagaaggggccatggacggcggaggaggacgcacgccaagctgctagcgtacacctccacccatggcaccggaaactggacctccgttcctcagcgagcaggtcgtgaaaatcaacgatatcgccattgttgctaatgggatcgagcttgaggtgcatttgatcatatcagatcagatcaaaatatggtgtttttgtttatctcttcttttgctctttcggtgatgcggcgtcaagggaggttcggcggccagcgacgccgcggcgaccccccgtccgacctcctcgccagcgtcgagtcggtcgcctccgccacctcccgcagcatccacgtctccaagttctccgtcggcttccccgacgacgacccggactccgacttctcgcccgacgacccagacctcctgcgcaaccgccccgtccccgaccggctactcgtcgtctccgccggtgtcgccgccaacctcctcttcgccttcctcatcgtctacacccaggcgctcatcgtcggcgtccctgtccaggcgcagctccccggcatcctcgtctccgaggtcatccctggctccgccgccgccggccggccgcgttgccgaaccgccggatgctggagagaggagagaggagatggggagagagaggaggaagaagatgaggggagtgaatgacaagtggagcccacgtgggccccactatttttaattaattcttttggtgtagctgatatgtggggtcactctttttattaattttcaaatcaaattgccacgtcaatgccatatctatgccacgtcagataaagaatgggtcaattttgccacgtaggcaccacataagccaaaaccgccttccaaaccgccatgggacctatattgcactgattttgatagttgagggacccgttgtatctggttttatggttgaaggatgaaaatcggattcgttgacaagttaagggaccttgtatgaacttattcctattcggttatgtgccccttttctcatgggctgttaagtgttaacttgcaagaaccaatcctatctttcgagttgggccttatgcattagagtggacttcactgggcttttgtaagacccacccaacctttagccatccaaccaatgaacttgtagaatgtttttttttaacgaaccgacacaagacagtgtcaatttcattgaatagagcatgaggaaaaaactttacagcttatacggaaattcccgcgcttgcattgttcttcttcttttggtattcagtggtgtgctctatgaacttgtagaatgtgatggactgatggtgatatttgctgaaagtcatgtatattcttgaatgatcgcatccaagcttgtttagtcagtaggacattgaacgattccctcatggttgttcaagtttgaagcttaaattctacggcccaaattcgaagtagtaatttctccttttcgcagcctactacaactactactctatgatgactttcagcaggcagcatgtggactggaaagaaatgttcttcagaatctagaagcaaaggctcaggttcagacagtcgccaacatcagtcttcaaagttgatttgatgcgacgccattagtccaaggttaactttgcaagggtcatgtcactatgagaaagaacattaatttagagagagagagggagagagatagaaagaacaatggcaaagcttaagggcccctttgaatcgcaggattgagaaaacgtaggaataggaaaaacgtaggattttgataagaatgtaagtgtaaaacaaaggattgcaaaacacaggaaaaatacaggaatgactgtttgattgaaccacaggaaaaacacaggaattggataagagagatagactcaaaggaaagttagcaagaggttaaagctcttgctaaatttcctccaaaatctctataggattgtccattccataggaatttcaaaggattggataggattcaatcctttgtttcaaagggcttcataggaaattttcctataggattgaaaacctctaaaattcctatgtttttcctccaaatcaaaggggccctaagttctagaaacaacagaaaactatgacggtccgtattcatcttatgctaatgtaaacacaaaggatccaggatcacagaaagtgatgtaagtatggttagggattgctagccttgactagtacgcagatgtgacaatattaggtctgagtttttcaccggtggcatggcattcagcacaatgtaaacttttcaacacttgtagttgttggtttcgccctgaactccaagaagtatgcaacatggttcagaactcttgaacaggtctaagttgttgtagattcgtagccttgaacagggaaaagaagaggagcagttcaatacattaatctgttttgtgaaaatgacaggatatccaaatattcgtagttagaaggcagaataatacaagggaaaaaatcaagtctttttttttcataaaagaacccacccacatggccacatctaacagacagacaccaacagcaatctaggatctggaggggtgttttctagacaatggagcaaataatctaggacttgaagggatgttccctttaagatattgagattaaaaaaaatcatggaccagttcagtactctattgcatttggtccattcgaggcacgagaaaatatagcgcatatttctgattccgtcatgtgtttcaaattaacctgtctgtcatttgcatcaggtaaacaaaattgcagacaatctttttcacttgtcagttgtcacacacacacacacacacagcgcactgctagataggatcataagatataacttatccccagtgactccagagtctagaagcaacaaaaaaaaaggaataagaaaacgctatagaagtcgatcacagcaaatgttcttcattttcatacgtaactgacatgctagtccagctatacttgacaaagtcatatgtcacagagtctaatagtctacgcccctcttgtgttaatttgcacttgttgaccttctgttctctcctaaaccatatatatcaagaaagtaatcggcacttctcaattaatttctttagagcatagtatgatctcactggctacttatttatgtaagtaaatagccgatcagatcagtgagcatccatgatcaatccaatggtgcacttgctatatttcctgtaagctgactttgattttgttgtcatttctccattcagagaacagaatctccatattacacactggtgcttgaagttggaagaactaaccttaaatgttgagtcaatgttagagaaagatctccactctgtttcttggacagctgatagaagatcaccgatgatagcgaatggcagaaaaaaaaatctttcaaatgccgtcatatacaaagaacttgggttttcctttccctattcccatgctgcattaattgatttttcatgtacagtgtgtactctcaggaaatatacaatattgtctcattcatgacaatgacataaatagttcaatatttcaatgtgctacaggagggcgttttgcattactctactactagtatcaacctatcatcattcggaaattcagacagactatgtggttttgttttttcccactctgataaaacatttcgtcatttttttagcattactggacgccaaccgccgttgtgtcaacatgggagtttttttttttctatggttgatgcgagattgtgccttttagggatttctttctgtgaagaccctatgtttccaaacaaaaccttagaaaatatgatccctctatcgttgaatggcaccttggacattcgagatggtcacgcatcatcaggccatccagtagaagagttcatcattgcatgccttgtgagctccacaatggtcgttgaccgtgttaagtgaaccgtcttgtgtagattaaactcttggcaaggcaatccattaaccaaaaccaaaaaaaactcctgggagtctagctaatgatcaactgatcaagttggcactgtacgtatacttggtactacctctgtcccataataattgtatttttaatattcgaatttatcccaaaataattgtcacaatatagtactaatggtctcattaatcacttctcattcaaaattatctctattttacccttaaccacccttccacttttacatatacaccatttaataaggggcatcatagtttttcttttcaaaccttaatatatgctaaacaatctagaattacaattattttagaattgcaatgaaagtaattgtgaattcataatccgaacaaaggccttttagcaggttcagtgcaaaagctggatgtactttcattgctcaatgaattatccattacctaaaaagaaccagcctttttaattatgttaattaatgaaaagagcgtttggcaagtggacagaaaacataaagtttattgggcaatattggtgcttactagcatggttatgttgagttgttaagaactcaccaaagagaatgaacatagacacattgcgcacagtttgtcaaccaacatgtcgcttgcacgagaacaactcactagtgcatacagtggacaaaggcacctattaatggtaagagctcgtaagttgactacttgcaactatttgaaaattgatgacactgtgtatctataatgtggaggctcatcccatcacccttatcttaaaaatcaatatgagatcaggacagtggcggctaagaaaaccattattatttattcacataataaagaggttgcctacgcgatatttccgttgttgcaagaaacacgatcttcggctacgttctccatcacatctgtctttggtgccatcacctcgacgattttgcaccagccatcgtattcgagtgacgcccacatctatataagaaaataaaaatataaatcacatgggtgtcgagaaaaattaaaaataacaaaaaagtgaccatgcacatgctcataagggccacgcaccagcgacctgtccaaccaagacccggcttgttgcgatgcgagctgcgacgcccgcttgcgcccagagctagctcgatcaacgcatgcatctcaccgatcgaatcgatcggtttctttcacggcctttgacccgtcacacgcggggtcgattcggtgatttcgatcccgtccgctgcacgcagtcccgctctcccacccgaaagcccgcgccgtgccgcctgcgctaactagctttgctacctgctgcgttccaacttttcttggacccactcgaccccggccgatcctgcggtcgagcccttcaaccacgcagcgcacgcacgcacgcatgctgctcgatctgctctgccccggacgaggcgggcggccaatgcgcccgcgtcagacgctcggggttctgtgcgtgccgtgtcgtgtgctcgtgtttgtgctctcgtgtcgtgtttcgtgtgtgccgtgcagcgacctgcgcttagggtacccacaatggttatctataagctctctataagagattcatgtcagtatattttcctacttggaagatattaaatgaatagatagagcaaagctatctactaacttagagatagtctatagagaaaaacgaggcaatacatgagagagctatagatacccacgtagacatactattgaggtggtttactattaatctagtctattgctgagatgtacatgttttatagataacaccttactttaccattgcgggtgctcttatatgctgtggacgtcgtctcgttctcctgggctcgccctttctgtccccgtccgttctagattttactgcctccgttcttaaatataagagattttagttggatatggcatattctaatacaacgaatgtggatataatcaaaatctcttatatttaaggatggagggagtagtactccaaagggacgatacatacctccaactttacttggacgtggacccgacccgatcctgaaattaaatttgaaaaatatactgttgattctttttttcttagaaatattcgtgatgcaaactttttagcagaaatataccgtcgatctcgcacaatcgttgtgcgaaagtgacgagagcgtgaggacgcatgcggtatcacgagatggaagaactagagcgaacggctcacataagaaatcagcgagaccgcatgtcttgtccatcagtattgcttattaacaattttcaacagtcgctatcgctcattgagtgagcgagattgctcggtctcgcggtttggccgtgcgagaccgcgtggtctgacgccgccaccacgcacgtcctcgatttcgcagttcagtgccgcagtttcatcgtgcgagaccgtgcggtttcgcgctatcaccgtgcgacaccgtgcggtctcacgctgtcattgtgcgagaccgttcgcgtcgtcactttcgcggaacggttgtataagatcgatggtatatttctgctaataaatttacatcccaaatatttatgaaaaaaaaacgaatcgaacattatattttcaaatttaattccccgatcctgcgggttcgagcccttcaaccacgcatctgcggccgcacgaggcgggcgtccaatgagccgtgctgtgtcgtgtcgtgcactcgtgcgtatgccgtcttatctcctgcatatgccgtggcctgatctggacgccgtctcctggctcctgcaggttcctcctcacccttcctgtgtctcctgcctccgtccgttgtagtagtaaaaaagggatagtactcgtaactcgcgaaggcgataggagggtgcgcatgcgcggctggtggcgagccgagccggcacccggcagatcgggcgcgcctcacgtctatatagacactcacgggggccgcgtcgtctccatgccctcaccctcgcgcactcccattcccatcctccacatcccgcgccatcgacctcctctccccgggaccgcgtcgctcgcgcgttgcctccacctccagtagcaagtatcaatggcggactccggcaagaagcgggacgggtcggccaacggcgccgagaagaaggcgtcgccgacgccgaagccgccgtcctcctccacatccggttcgtcgttcgttcgtcctctcccctccctccttctaggaacacgcgtgctgcggcctgcgtgcgtccatcgcctttttgctttgttaatttctcgtgttcaacgcagcgtttgtttcgtagtacgtcgtcgtagcctgttcgtgatttgccaccgctccctgtttttacaattttgctgtataatcagctcggttgcggtctcgatctcaagattgacactatctcacataaattaattatgatatgaccgcgtcattgtttaagatcggccaacgggccgcgagcccgcgagaggtcgcgcgctcttgtctgcatgcatgtcgattgtcggggtactcaatgctgtgaccccaatgctttcggcgttaaccatctgtccttttcgttcatcccgaagctaatttatacgcctccatccacgtttcttctgtcctcgaatagttggagtttgcgtgtaggtcttgtgatttttgggtggcttcatgaacaaggtaaaaaggcctttccatcaaaaaggtaggtagtagtagtaaaaagaaaaagaaaaaccgaaataacaggtgcagattgacccggtgggccgggcggctcataaaaattaacgcttctgacttgatcacataaatatcaacagttccgaacaggtgacacgcaactgtacacaccttgatgatcgatagggcctacggcattcacgcacgcaagtactactcctatctacttatctaaagctggctgtttagcccgaatttgattgggccacgtggcttcaatcagtttgcaataaatctatgatttcctgagaaaaaaatataagaaattttttaagagaagaatctggagccatgaggaagaaaaatcgcaggctcccagcatgaggaagaaaaatcgcatgctttaagtacattgcctccacacgcatgagcgaatgatgttgggtcttccttggcagctgggctacaccttgcctgggccagcgggttgagaagatgagttacccaacatcaaatatacttaaagcattacttatgatttatatttttttatatttgtataatgcttttaataagaggaatggtaaatatatgtatatgtgcgtcaaatattaagaatcggagtgagtattttgcaaatattgcactactccaaatgtggtggtgcaagtgtaacgactttacgtgcatatgttccttgcaatattcaaacactgcttgcaacaaaattaatcagccgaaacaagattatcatgttttcaagcccattttaattatcacctccgtagggactagagataaactagctcattacttcaaatcataatagtattgtcaagacaattatcacatacttggggatgggcgtgttggtcttgtggcaaatggacatagtactggccacttggaaacgataagaaaactgtcacatcaacgtgatttttgttgcaatgtcgttgtgaacatatacttgtctgtattttgaggtaatgccaagttatatatagttgttcatcgaataatagaagagggatgtatttgatttatatagttgtatgcatttaaatctccaaagaatggcatattaatgttataaaatatgtacgtatatttgcaaacgttaaaatttccacatatttttgattaatcatctgtattatggttaatcgttggacaatgccttttccgtcccatgattgtattctgctattctgtcttccagaacgcacccacgtccaactgagtatatcaaagcagtgtgaagtgtgaactgctcctaattcttacaatagtttataactgcatgacttttcaacacatcttagtgtcatgttgtaatgaattgaccattgataaggatatatttatataaatgccgacatgcgacacttgaacctcgcaaagtcaacgtagtatcttatatgacacctttaggattataattacatcatactccgtgctactccctccgtttaatattataaatagtttgactaaatttatagtagaatttagtaatatctaaaatatcaattagtttcattagatctaaccgtggatatatttattttgtgttgaaaataatataatattttcctataaatttagtcaaacttaaacaagtttgactataaaaaaaatcaaacgacttataatatgaaacgaatggagtagataatagtagtatatcagtacgtagcaaggtttatagtagaaccggtggtaaccggccaattaacgactggtctgccagaataaatcggccaaataaccaaattggaataatttaaatccaaatgattttaatttttttataataataaatttgatagattcatcaatattttcaacataccgatgtgctttttttaaaaaaaatatatattgatgtgcctcttttcctggcaggtttctccaagaatgtccccctcctcgtgtttgtgttattgctggggctgctgtaccggcagcttcagcctccggttccgaaaatctgtggaactccgggaggccctccggtgaccgggccaagattgcagctcaaggatgggaggcacctggcctaccacgagtacggcgtccctaaggatcaggccaagcacaagatcatcttcgtccatggcttcgactcctgcagatacgacgccctccaagtgtcacctgtaagtcgcgatcgatcgattactgaacacacagtaatctgaaaatgctgagcccctgggttactgaacggaagctgaatgtgtataacaggagctcgcagaagagctgggtgtctacatggtctcgttcgatcgtcctgggtatggagagagcgacccacaccccggtagaacggaggacagcattgcgttcgacatcgaagggctcgccgacgggctgcagctcggccccaagttctacctcatcggctactccatgggcggggaaatcatgtggagctgcctcaaaaacatccctcacaggtatgtatacagtgtacattatatacaccaactgccgctttctgaacattgttgcagggaaaattaaccaaaagtgaaatttgtcctgtacgtgcgcgtgcaggctcgcgggggtgtcaatcctggggccggtggggaactactggtggtcgggttacccgtcgaacgtgtcgacggaggcgtggtacgtgcagctcccgcaggaccagtgggccgtccgcgtggcgcaccacgccccctggctcgcctactggtggaacacccagaagctcttcccggcctccagcgtcatctccttcaaccccgccatcctctcccgggaagacttgaccgtcatccccaagttcgcctaccgcacctacgccgtaagcaaacatgatcgatccatagtactcctacttttttatgcgtgaaaatggatggacgatatgtgctgaataattaaattgcatgggggacggatgagatggttgcaggggcaggtgaggcagcagggggagcacgagagcctgcaccgggacatgctggtggggttcgggaagtgggggtggagcccgctggagatggagaacccgttcccggcgggcgaggcggcggtgcacctgtggcacggcgcggaggacctcatcgtgcccgtgcagctgtcgcggcacatcgcgcagcggctgccgtgggtgcggtaccacgagctgcccacggcgggccacctgttccccatcaccgaagggatgccggacctcatcgtcaggtcgatgctgctcaccgacgagtgagatcaccgaccgaccgaccgagacgcgcatctctctgttttttttggtttttggaattttgggtactgtcacgtaccgacgtacggtggtacgcgtagttgcttgctcctattatcctatcctatatagagaaatgacaataatattttgcggagtcattttgcctcgtttcatctaccacatttcttcgtgactactactgggtctctcaattatctgagccggaacgtgattatggagagcgttggggcccatgtcagttgggccgtaaacgggcctcggcttacgtgcagccccaatattgggccttacggatgtgggctgagagtagttctagttgggctaggtggttgaggggacactgggtgacacacaccaccacagggaataagttcactttgggtccctctacttatcgcccagtccgattttcgtccttggccacaaaaccgggtatgacccatcccccaacttacgaaaaccgggcaaacatgatccctcggcggttttgaaggcggttttggctgacgcgtcgcatacgtggcttctttgactaggtctccatcccacatggcattgacgtggcgcttacgtggcaactatatctcgaaaaaataataaaaagcgtggccccacatgtcagctgcaaaaaattaattttaaaatggtggggcccatgtggaccccacatgtcagcctcactcttctcttcttccctctcccttctctctcttcttcccttcccccctctcactctccttcccgggcagaggacggcgcgggtgggcggcggagcaggcgagctccgacagcggcggcggccatggtcggcgccggcccccgaccggagcgccgccggtccgcgtgaaggcgagcagcgcggcggcgccctggaagacgccatcgacgccgccatccgtgccgccgccgccgaccacccggacgccctccgcgcgcaccgggacgacatcaccgagcgcctctacaccgcgctcgtcgtcctcccgccgccgctccacaagccgcctacgccgtctctcccctccctcatctctcgccgctgacgccgcgccgcgccgctccctcttctcccgccagcggccatcggggagaagggcggcggacggctaggcgagcggcgcgagagatggccgccgccgccccacaccgccatgaggctagcagccgacgccgcaatcctcctccccccgctccaagaaacgctcctcctcctcccacaggccgcgctccctcgcgctggccgtccttgccaccgacgcctcggcgaggaggggaggaggcggaggggagcgcggtcaacgatgacggatggccccatccattgcgccgcccttgccgccaacgccaccgacggctcgcttgctcgcatgcggggaggaagaggaggcgaaaaggccgacggtgagcacgcggggagagggaggaggcggcgcgggagcacgccggggcttcgagtctgccaagtccacctccgcggccggcgggaggaccaaagagtagcggcggctcgccggccgccaccgctccactcccacctacggcccctttgctccgcccaccacccgccgcccctctgcccgccgtccttccgcccaccgcccaccacccgccactcgccgtcgctccacccgtcaccccctctgcgccggcaacgccgccgctcgcccttctgcttgccatgtaggggagagagagaggggggcatagagagaagagggaggctgacatgtgggaccacatgcgtcccacctttttttaatttttttacctgacatgtgggtcccactgttttttattattttctcgggatcaaatgccatgtaaacgccacgtcaatgccacgtgggtcgacgacctagtcaaatggagccacgtcatctaaaactggacacagtactgccgagggacctcttttgcacggttttgtaagttgggggatccgttgtatctggttttgcgaccaagagacgaaaatcgtactgggcgacgaatagagggacccggagtgaacttattccccaccacagcatcgatctgtacaaatgcgtcgatatcgatgtccatcattttgcttcctggcctcctgaacagtacacatcatcgacatgtttgattgcctctctaaacgattctgtacattcagcacgaaacaccatttcaggaaaaaacaaacaaacaaaactgagcatattttgaagttgagttaccctctcgattgttccattcatctgtgcctccttatacatctctaccaaccttacacctcaaatcattaccaggctataatcaccatttcccaaccaccgccacaaatgatacagtactgtattaaccaaatgaaatgaaaagaaataacccattaattatcactaacggggagtaacctaatcatgcccacgaccgacggccatggccggtcaagcacaagcggctagctaatcctccatctccgccttcttgggcgggccgaacctcttctccagccgccggagctccgccggagtgagcccgaacgccctctcgaggacggcctccctgatgccggacccgaacaccgtcgccgggatgcggacgatgccggggttctcgctgttgaaggcgccgtagaccgtggccggcgtgtcgccgacgttgagctggaagtgcaccatggcgcgcgggaacaccatcacctccccctgctcgagcaccttggcgaagaggcggccgccggagtcgacgaacccggcgtacacgcggccggcgaggacgagcgccgtctcggtggcgcgcgggtggtagtgcggcgggttgacgccgccggccgccgagaggtcggcgcgggcgaaggacatccccagggtgtgcaggcccgggaactgcgccggggtgacggacacgccggcgaaccccgtctccggcgagaagttccccgcggcgcgcacgccggagaaggcgaagtcgcccgccgtcaggttggcggggctcctgcacgggtaggccgggagcatggcgagctccaccggccgcccacgcccggcgtccggcacgcagaagtcctgcaccgcgtcgggatcgccccttgccgccatcgccggcagcagcacggcgagcaagaggaggagacaacgacgacgatgcgccatcgattctacgctcgttctgtcactcgttcgtcggtggacagctgcttgctttgcacgtagtagtacatatgtagtcgagcactgatgtcttgtaaggtgagttgatcattgccagtaatcatgcaggtattgatccgtaggttattcttgtattttgtcatgcacgagcagttgtaaagcgtcgatcggccgctttcccggaagtgcagagatggttagaaaagttctcttttttttcttcatgcggaaaagaataggaaaagtgaagggatagaaatatatgtacatatcaatctatagaaaaaaaattagaggtttgagtggatttttttttctctatgcaacttgtaggaaagaaaatattgttttggctttctcatactttattttaacaaatcgaataactcatatagaaattaatcctgagaaatccaaattctttacttttcctctaagaccctatttagttcccaaaacaaaaattttcgtgccgtcatatcgaatgtttgaatacatgtatggagtattaaatgtaggaaaaaaaaccaattacacagattacgtgtaaattgtgagacgaatcgtttaagcctaattatgccataatttgacaatatagtgctacagtaaacatttgctaatgatggattaattagacttaataaattcgtcttgtagttttctgacggaatctgtaatttgttttgttattagactacatttaatactccaaatatatatctgtatatccgatatgataactaaaattaaaaattttctccaactacaccaggctaaatcgaacatgcccctagttctggaagtgtattgaagaagcagggagggaggctctgaagaatggtggcttctgtggattttcaagtggacgctgcacacttgcacagtgcggactgcggaggaccacatgggctggcattattgaccggaagagtcgttcaggtcgtcgtcaatcgtgcgtgcgtgcattgaacctgtagataaggcttccaagaaactcaggaccagggaggagtcataggatccagcatagttggccaatagttcccacgactggttaaaacagaataatctgggaatgatcatgaataataccaataaccggtttggcactcggctttcagttcagtagcttgtgtttatacatagaatgcacatcttttctcaacagtcgactaccgatgaaaatctttcttataacatttgttccctctatcttaattgaagtgctccgagcaacgcatgttgcacggcatatctatcgtaggcatgaccagttgtgacctgtatgtacgtgcgcacatcgatcgccttttgagatcatatatgtgtatgaatcatctgggcagatataatgatgctttcgtggcgtagcaggctgtccatggccgcctccaaccggccgggagcgcgccgccgccggatatagaaagggataataatcccttgccgctgacgcaacttaatcgcactcctgcatcattgcatcttcggccagcgcagcccctccttcacagaaataatgcgttggaatatcatagcacagaaaagttataagcagagagctccattagcaaactggagtataatattagacaggtgatgtctaatctttgtattaggttgctacattcatccaactgttattcacgaaaagatatttcatgaattttataggatttctgttggatttagtctcatttcaagaaaaaaaaacatttctttccattccaaatgaggccaatctgaatcctatggagttcttttcagttgatttcccttaaattttatttttgtaggagttcgaccaacaagtttgtctcatgatctgtctaacggtattttgggcctcaatttcgtgggcttctggcccacgatagcacatcaaacaatggccatcttccaagttgcaaaccttctgttaggcccctttaaatcgcaggaacgaaaaaacggagaaatatgaaaaatataggattctgacaggaatgaaggtgtaaaacagaggattgcaaaacatagaaaaaacataggaataaccgtttgattggaccacaagaaaaacataggaatttgaggagagataaagaatcaaaagatttcttccacgagattctacctctggttaaaatttctccaaaacttgtatgggaaaaggcattctatagaaattttataggattccatagggttcattcctttgattcaaagggctttataggaaaaattcctatagaaataaaatcctgtaaaattcttataaattttctttgaatcaaagggggcttactgtttttttttcgtttcaggttctaccggaggttacttcagtgctgccgtgcctggaactgaactatccaatgctatcgaagaacagaagattgaaagtgacttgtataaatggcggattgcatgatgcaaatagaactgggttttttttttctggtggttgaattgctagcttgcattcctttcgaaatctcttgagagatcatactttattagtcctatttaaattcaatgcttttgttggaacgcgggtgtacctttcaagttcctgttgttccatttggagggtccggccgaacaaatggctgacagcataccgtccatttctaagatttttaatgaactaaaaactgaactacaattgcagatcccttagcacacaaattacgagtttgccctgagtaaccaacgatctgtgatcacagaagatgcatatattggcctttaattaatctcttcttaaaatatacttcctgcttaggtcacttacagggttcacagaactgatgtaattttatgaaactgctaggtctcgatttgtgaaaaccggtcggtattagctggtttctgtacggtgttgactaaaatcatcggtttttacccgttttcggtcggatttcggtaaagctgtgaggagtggtttctacttcgaaattgaaagggtaaaccctggtcacttcatttatttatttttttttgcttacacgcttgacctatttctatgagcaacgagtacatcttgttttttttctaataatggaattcatgtcgacctttgctttcaaaaaactacaaccaattatgcaaagattataggttgaaaaaaaagaaaattacaaaaccacaacttgattaaaaaataagataactacttagattaccaacctaaagatcaagatgaaaccattggcttatatgttatacgtagtccttatcttcatcacatcgagaaacaaattctccaaaaatatcagtcgatcattaccgatcgaaatcagcatcgccgccgacgaaaccataacggaagataaagtcggagagtaactaaggctgtgtttaaatctaggggtgtaaagttttggcttgtcacatcggatatacagacacacatttgaagtattaaacgtagtctaataacaaagcaaattacagaatccgcttgtaaaccgcgagacgaatttattaagcctaattaatccgtcattagcaaaagtttaatgtagcaccacattgtcaaatcatggcgcaattaggcttaaaagattcgtctcgtaatttacacgcaatatgtgtaattagttattttttcgtctatatttaatactccatgcatatgtccaaacattcgaagtgacagggtgtaaaattttgctaggggatctaaagagggcctaagatgtaaaacaacctttcgcccaaatcttagcatcactctaactatcgaaattggcactaggtgcaccaacaaggacctccaatgctacgccttcaagaaagtcacgatattcatgatatcaccattgttgttccggacatttgaaactagggtttcacctaaagtgtccactcgaaagcaagaaggtgaggcaagatattgcgacatcgcctctaggaaagtatgtggccccacaagcatcaccaatgtcaggtgtgcgtgcctcccccatgtcaccacctcagcctcgcgctgtctccacctccactacaccaccggcttgacccacaaccaccgccaacccccaactagatccagctagccctccaactagagggcaactggcaagcatggactagagggcagctgccactaggatcaatgagtgcacttaccccatctctgccattcttgccatcacgcgacaacagatacctgatgatgacatcctccactattacccgccagcaaagacgcaaaagtcgggcggcgaccatgtgagcctctgaataatcccaccttgcttagcttgggaggaggaagccaccttaaaagggagagccacccttcctctattggactagtcttttagagagattgggcctttccccgagtgggtgtgcctatgaactgttggagtccgggcaaccttaagttattgggcctcgaccaactccacctgggccggattgttatcatttggtatcagagttgggcccttgttaagggggtgggaatgatgaggacatcctccactattacccgctagcaaagacgcaaaagtcaggcggcggcgaccgtgtgagcctctgaataatcccaccttgcttagcttgggaggaggaagccaccttaaaaggaagagccacccttcccctattgtactagtcttttagggagattaggcctttccccgagtgggtgtgcctatgaactgttagggtccagacaaccttaagttattgggtctcggccaaccccacctgggcctaattgttatcaataccatacatccagcagcaaggaggtgataccaccactactggagaaaggggctttagtcccggttgggaaccccacctatagtcccggttatgcaaccgagactacgaatccgggactaagtcctgggagaaaggggctttagtcccggttgggaaccccacctatagtcccggttatgcaaccgagactacgaatccgggactaagtcctgggtgaaataactgggagtaaaaatccggttgggaaccccacctatagtcctagttatgcaaccgagactacgaatccgggactaagtcccgggtgaaataaccaagagtaaaaatccattttccaaccgggactaaagatggagctaggccaggtccggttgctctttttttttcttttttcattgtttttaacatcgaatattgattttactccatcgccaaatcatacctaagaaatcccgaatcctcaaatcgatcatctccaaatacatcccaaatcatcacagatcaaaaggatcatcttcaaatcctcaaatagatcatctccaaatacatcacaaattcttaaaaaaaatacatcacaagttctaaaaaattcatcacaaatacatcacatattcacatcacacaaatcaaatacatcacaggatcatgcaataaatcacaagttctcaaaaaaaaatgccagcaggggcgccggccggccggccgctgccgcgccgccgcttcgccacgccggttgccgccgcgcaggctggcccgcccttctcttctcgtgcgctcgctcagccgttgccgcctcccctcctcccctccgcgtcggccgccgcgcggccgacccaccctcctctcatgcgctcgctcagccactccttcgctatgaaggaaggaaagaggtaaggctaagaggaaggaaggagataaggagttagagaggaaaaaaagagatacgagagaggagtttgtgtggagggagaagatgataagtactagggattatatagtgtgttttgatctttagtcccaattagtaacactaaccggcggttgataatacaaaccgggacttcccggttggagttaccaaccgagactaaagattccggaggaccctgacagcatgtgaatcgggactaaagatcacatagtccttttctgcttataaaccgggactaaaaaccatctttagtcccggtttttattgcaaccaggactattgtggtttttaaccgaccggacaaatatggtttttctagtagtgcacatacatataatgaggacagacgattgcatctcctaacactcaaagatacgaatatcaacattcaacaacaaattctgacttctctaaatttctattgaaaatacacgcaaaattaataatggagactagctagcagcaaatccctaagcaacgaacgtgatcaaagcgcacatcagtgcagcgtgtgtaatatttggccattatattagaccatggtggtctggtggatggatagttcagctactgttttcctgaggctgtatatgctgaaatatactccctccgttttttaatagatgacaccgttgactttttctcacatgtttgaccattcgtcttattcaaaaattttatgcaaatgtataagatataaatcacacttaaagtactatgagtgataaaacaactcataacaaaataaattataattacgtaaatttttttgaataagacgaatagtcaaacatgtgagaaaaagttaacagcatctattaaaaaacgaaggtagtatattgtttcctcatctaataatatatatgtatatatgctgacatagttcagctactttcatgagggtgtatagtgaacgttcactatttactaaaagagtgaacatggccataaattagtagttaaagtctgaaattatctgacttcaatagcattcctgaatgtacgtattattccatgattgtaaaaagaaattgtgagatcgacctctatatagagtgaaaccatcttctatatagccacagcccacagtggcggatgtagacaatactgttttttttcttttttggctgagtgcggcaagtttatttcaaaaaatttcataaaggccacgaacgttttttctttgtttgaacgtggaagcaactttcaagttctattgttctactgggcagaatgcaagcaaacaggacaaaaactgtgccatccacttccaatatcataattatgtttgaagcatgcattctttttttttttttttgagaaggagaggctcacctccctcatttcattagagaaatgaaaacagtcctacaagcaatccaaactacttacaacccaactccaagtttgaaacttccaaaaacatcgcacatgactaccaatctaaacattctgaaaagaacagagagaacagattccaccctatttctctaaacaccattctccagcctcttgatgcaaggattccatccatgactcgccttgtacatatcagcggctaccttttttagcagcacagctcccagttgcaagtttgaagcatgcatataattgaactcacactgcacattaattccgtatgcaacacagacctgccatgagtgctacatatatatgatgatcaagtaaagagcaaaatttcatattgggttcaaatctacgtaggagcaaatttcagattgggttatttgaggactaagttccatatttgtttggctaagtttctaatttttttttaaaaaaagactgcgtatatccaattggatatagaagccgggtaaaaaatatccttctctaaaaaaataataataaaagagcaaaatgtgtgaaagttcaattatatgctcataattatgcatgttggagccccaagttgttgcaggtcttcatccttgctctagatatgacaaattcctgcttttatatgctactcttttcgtctcaaaatataagtgattttgtttggaagtgacacatctcagtactatttgttcagattcgtagtattaggatgcgccctattaaactaaaatcacttatattttaggactgatgtagtagaaagctccgttaaattttgcaagattggcatctgcgatttcacatgcttttctctgttgattgtgagctctaaaagcagatacctcagatctgtatatgaattgatcgtctgctcgtactagactgttcgagccattctggctctcagaaacatacatacttatatcgattctgcagtgggccacaacatccctgaaggtcaccaaaccaccacataaacaggaagcaccaaactttacggtgattctgattcagctgttagtcaaggtaaaaaggggacggccacctctcaaattacaggggtcgctatcggaagaaaagaaaacaggcgcatcaggaatagttccttgtgttttgttgggggaaatgcctctcctgtaacgtcgcaactggacgcaaggcggttactctaaatgaaaggcctcgcaaccactcccatgtacatactggtaagtaaagatagattaatcactagtaaaaaatgatttttctgaatgccggtcccgatagattccagacgggtcgtaagcaactggcgccggactgtcgcccacacgaaaaaatgcattattccgtgcgggcgttttaatccgaccgcatatgataatcctcattatcccgtgctgtcgatttaagaggaccgtacggaaaaatcgattctcgcgtgcgggcctcttaagtcgaccgcacgggaaaatacctctccctctttttcttctcacgcacttcaaatttttcacatcctctctcttccttttcccttttattctccctcattcactcctctctctctcttctctctatgcctttcctctcctccccttcccccctctctctcctctctctctatacctctttcctctcctcccctccccaccgagcgcacgaggcgtcgctgccgccaccgccgacggtacggaaggcagcacggcggctgctggcagaggcagcgtggcggcgacggctgacggtcgcggcggaggccaatagcggcggcggcgacgaggatgacggcgaccacgagcggcggtggcgcaacgatgacgacgacgacgggagcagcggcggtgtaatgacggcaatgacgaggacgacggtgatcacgagcggcggttgcgcgaccatggcgatgacgacgggttttgttgggtttatttttctttttttcgtgcgggtggtataacttgaccgcacaggataatcgattgtcccgtgcggtcgacttaacaagaccgcacttatcccgtgcggttgggcagcccacgcacgaaaatattgattttcacaaacctctctgggtgcagacgggcgctacctccgcactgaaaaatgaattatgtactactaccaatctgaatgtaaaagaagaactaaatattactatccatgagatcatcatgacaaaaactagaattgcccagctaaataggaatagaaataaatccagggtaacttgtatcatgagatgggtcaattccaatttgaattccgtacggctacaactctttttaaacgagtcgaagtccagtcttgtcactttccccctttcttatcctcttttttatccaacctcttttatgtattcttgaatgtaatccctccagggcatgcttcatttttttccttacatacaaaattaatagctacaagaattgttttccttacatatatacaaaaaaattgttgtagctttagcaagatttgaacgaaaaaacactggtttccttcaacaaataattaattatgtagtgtttccagctcctaccggctccagcaccattgccgtgcaactatttgctggaagttaagaattttttacataaaacgtcatttttttttggtctcgatgagcgataatttctagggaaaatcggaaccatgccattataattttgcaaaatttgagatataccatcttgacccacatgtcattgactcatgtgggccctacatgtcattgagataccgatggcatatttcaaactttgcaaaattatagcaaaattttacggccatgattggttagtactttgatcagaaatttccattttagaacctagaacacccttgcaacagcgaattgagaaaacaggggatggaaaaaaaatattttggtagaaatacatgtataaaacaagggattgcaaaaatagaaaaaaataatagtttgactagaccacaagaaaaatacatgaatttgagaaaagatatagattcaaaataaactttctatgaggttggagacccatgttaaattttctccaatacatctatggattaaggcattttttttcgaaacaagccgcactatacagtgtgaggttttatattggtatagcgataagaaaagaacaagattacaccctataaggctataattagaaaaagaaaaataaaacaccactacgtgttgacaactcctacacacaaactcggggaaaaatctagcacaaagccaatagttattacacgtgaccagtggctgctcacccaacaataaagtcacaaacacactgccctacacatatccaagcatatagccaccgagaagttcccggtcatcaccacggagatgggtttgtcgagggagagagcgagagagaagaagatacactcatccttcatgcatacccgatggcaacatctaagagcaccgtggtagaccatattgattgaaggctgaaccacggtctcttagacgatgcctccaaggaggtcacgactcggaagtgccaccaccgcccatctaagaaaccttggacttggttttcacctagagaaacctgctaggcagggagggagatgtcttgatagagcccacaagggagatcacagcaccctaaggcgtcacctttgttggaccaaaattgggctaggctttcgtttgtaacctctctcctgcctatggtcacaaccctatcgcctctctaccattcgacctttgttagcacgcaatttccaccacaatggtgcccttcgcccagctagcccatgcccatcttgagatggtccttacgggacctcccactcctaccaccaccgtatcatccccctccccgcgttagcacctcatatccgcatattggcgcttcacaaccaaaccctcctaaacaacaccacatcaagattgccctccaaaccaccacctccaccctcactgtggagctccctatgaccagatctagatacaccggctataggagggtatgttctctaaggagaagaaggggcgcctagccagagaggggagaagggcgggggagggattctacaccgcctgatctaggcacactacacacggcaccaccatccctacaactagcatcacttgtaaggatgttgcacgctgctgccatggtagtttctacacaccaagatccaaccggatccagcatcgtcggccatagatccggcaacctctagctacggcccatcaccaccacaacctcaaagacatcattgtctaacccccacacgttgacccacgtcaccagcggcttggaggcaccattgcttcacttttgccttgcagttgccgtcctagctcgcgcctagcctcagtcggcttgctctaacggtagcgaggtggaggaaggagagagaggggtggtggcaacggctatggttgccgccccgagccatccacacgggagcgacgcgggtgaatagagagcagcatcctatatgaaactcatatgattcaatatattatccgatcctttcatagggttatttaggaaaaaaatattgaattgagtcttaaaaaattcatacactactacatctgtccaaaaatataacaacctattattggatgagatgtctagtactatgggatgtgacacaagtactatgaatctggatatggtttgtccatatttgtagtactaaaatgggtctcatctaatactatgttgctatattttagaatagatctagtatggttttccactcatacatcaatcaatagaccaacctggcttctattttattttctagatggtactactataatttctcggaatctagacgaaaagttaaactgtttgggaaactttcgattctgagataaactgtagctacgagagaaacattgcccttgtttagttctcaaaacaaaaacttttcacccatctcatcggatgtttggacacatgcatggagtattaaatgtgtacaaaagaaaaagaaaaccaattacacagtttgcgtgtaaattgcgagacgaatcttttaagcctaattgtgccatgatttgacaatatagtgctatagtaaacatttgctaatgacggattaattaggtttaataaattcgtctcgcagtttcctgacggaatctgtaatttgtttcttattagactatgtttaatatttcaaatatgtgtccgtatatccgatgtgacaaccaaaacccaaaattttccccaacaaaacaaggcctttgtaaataggctctgaagctcatagtcaacctaaaaggcctagagtgttaaattaggcctggtttatttccccaaaatattttcctaaaaacatcatatcgaatctttggacacatgcatgaagcattaaatatagattaaaaagaactaattacacagttagtgggaaatcgcgagacgaatcttttgagcctaattagtccatgattagtcataaagtgttacagtaactcacatgtgctaatgatggattaattaggctcaaaagattcgtctcgcagtttctaggtgagttatgaaattagtttttcattcgtgttcaaaaattccttccaaaatccactcaaacatctaatgtgatataaaaaaactagctgggtggcccgcgcaattgcgcagctagcgcccaaacaaaatcatatattttttagtatgattttacttaaaatttattaaatacctatctcgttgtcttaagactttgaatgaccaaatcttatcatccccgtgtttctaattatatagtttttaaaagtcacaccaatttctaccccttacttctgccatctccttctttatttgcttgctagatctaccactttctattcattctccttggaacctttaaaaatggatcttatagattttagagtctattatcttgttaggtttctttttataatttctagaagtcacatcaaacgctgccattatactactctgcggttcgtccaatgtcttttctttttattgtcattgggattttaaaaatcgaatataataatcgttcgggttcattttttactttttagaagtcccgccaaaccgttagtggctttgccattgaactcctctgtgacttatctgctgcctcccttctttattgtcattgagattttaaaatcgaacatgattatcattgttttttttactttttagaagttccgaacctttaaaaattggaccttgtagtttttagagtttattgtctcgttgggtttcatttttcataatttttagaagtctcgttaaacgatgccactatactcctctacggctcacccgccgcctactctttattatcattgggattctaaaaatcgaacataactaccgttggaattcattttttattttctagaagtcccaccaaccatcggtggctctgcaactatactcctatactcccagtgcactgcttctcctttttattgtcattgagattcttaaaatcgaatatgattatcaatgtggtttattttttttactttctaaaagtcctagcaacctccttgtccgtttgcttcacgacctacatgttgtccctccttttaattctcattaggattatatttagtgttttattaacagttatatgtcgtatcaaccgacaccactctactcctttataggcatgttatttaatttatcttatcatgtattttaggtggtcttttctttcaatagtccttattttctgtcaccaattagttatcaataaattgtattcctaatggaattctttttttctttttctaattttagaattttttttcaaattttaactaataccgtatagtgttcttttaatatttttatttttcaattccagttgtttcaaaattgtattcctactcaactctcttttactttttttaatttttgatattattttatttttcattctgaattttaattaatctcgtatcgggttcttatatggatttttctttcaatattgcttattcttaatttcgaatttctgttaattttaaattatattcctactttaactctttttttctttttgctaattttagattttatttttatttttcttccgtatattaactaatatcgtattaggttcttatattgactcttctctcaatattcattatttttaattctgaatttcagctatttttgaattgtatttctacttggactctcctttttttttctctgattaatgtgagaatttctagcccccacagcgaacgtggtgcctccttttaaagctattttaataatataatagatttcgcgagctaaacgggagccttagtgacttactcgacgagacaattgcgcccggaaatgctaatgggcgggtgatcgctcccccgcccgcccaacgatcacccgcccgccctctcccctgtactactccatacactcctcccctactacagtacaccacacaatttttttaaaaaaaacaaaaagttagaaaaaattatgtatagaaatactatatataaaaaatttgaattcaaattcaaatttgaatcggctatgtaaacttttggcttataaactttaggtctataaactttacgtgtataaactttagatatatagaaatactatatatagaaaatatttgaattcaaattcaaatttgaatcagatataatttaaattcaaatttgaatcgggtatgtaaacttttgccttataaactttaggtctaaaaactttaggtgcataaactttagatgcataaaaatactatatagagaaaatatttgaattcaaattcaaatttgaatcagatataattcaaattcaaattcaaatttaaaacgggtatgtaaacttttgacttataaactttgggtctataaattttaggtatataaactttagatgtatagaaatactatatataaaaaatatttgaattcaaattcaaatttgaatcggatatataaacttttgacttataaacttttcgtctctaaactttatatgtgtaaacttgaggtgtataaactttagatgcataaatttactaaaataggaaagtaatgtggtgacaaaaaagaaaatcaggtggagggagagaggggaggggatcgatcgctacccccatctcctggcgatcgatcgcccgttaggatcccccaattgcgcccccccagttgttgggaactggagacgagtcagatcatcgacccacacagcgtgatatggaaggcccacctcaaaaggtcgcgtcgcgtcccgccgagattctggaagcgaaaggctgagcgcaatcgcggggcgtccaagtggcccctgcaaaaaatcccccccgaaatcccaccacccccccgcggcgcggccgcatcaacccactggccctgcggcggccacccaacccaacccaacccaacccaagcctcacatctgatcacgacgcccacccccccacgcaagatcgccgcgcccgcgccacgtagccggccaaacgcagccacacagccccggccacgctcccgcctcccgcaccataggccgccccccgcgccctcgcagtctttaacgtcccagcctctcgtttgcctcgcactcctgccgcccatcacccaaccaccgcgcgcctctcctctcctctcctctcccgccgcgcgaatcgcgatcttttcctaagccgcggccacggtttgcctcgctagcttgcagtatctgtatcacacagaggggtcaaggggacggatcagctagctctctctatagctagcaaagccggccatgtgcaagaggagctgcatggcgccgtccgagtcgtgcgcggcgcggccggcggacgagaggccggcggtctgcagctgcggcggggccggtggtggtcaggcggcggcggggacgtcgtcggaccgccaccaccagcttgtgctgctgcaggcggaggcggtggagaagaagaagggcggcaggggggcggcggcgccggacgaggcggcgatggccgacggcggcggcggtggcggaggcgctggggatcaccatcagcaagcggcgttgctggcgccgttgccggtgtcgaggcggccggcgccgtcgtcggtggcggcgggggaggagagggagagcgcgcgggagcggctgaagcggcaccggacggagatggccgggcgggtgcggatcccggagatgtgggggcaggagaggctgctcaaggactgggtcgactgcgccgtcttcgaccgcccgctcgccgccacgcgcggcctgctcaccgcccgcgacgccctcgtcgccgagtgcgccgcccccgcgcgccgcccgccgcacggccccaccgcccgcccgctccgggtgcagaacggctgctcttgatcgtgatcgatcgcctccgatctccatcgatcgatcgatcgagtgctttcgtcaagtttttgcctcccctggccggccggctgctagcttcttccaagtgaaaagttactcgtcttctatgcgaaacctattcggggtatggattatttgatcgatgtcaagtactctacttaatctgtatactacttttgactactggtggatgtaattaattgttaattgatcaccatttgcggcaagttcgatccattcttgttcgaagcaatactccgtctgctctaatataagagcttgctagctgttgattatttcatccgctctctatccttcacctttacctggccatccaatcgattaattagcaaaaaaaattcatgaataagcttccgatctccacatcagatagctgaattccccatctacactgccgaacttaaaaaaatcctaatgattcggatgagctagctatctcctgatcatccactaataaacaacaacaccttaatttgttcctgttcagtttaagttcaaaatcctagctagtatcgcatgtaatatgcagcagcttaattcattcagctctctcatcacatagatctaataacagtaggcagaggtacggtatctctggaattgtgctctaggatcgcaggtttagatcttgaattcttgatcgatctgttactatgagcaaccagcaaatgattctgcatcaacatctcaccgacgtggcctcgttcccttctttcgttggtcgtctttccatttgtggaacagattctttcctacctcctttgctttatgatgtatatggagtatctgttagaataattaaatgggctagcatctataacaaattttgagaataattactagagaaactcaagtatgcactgtacggagggatgtaagtggggtggccaagtgggcaagcgagattttttttccgcttatcacaattctacttagttttatgtttcaaattttgtactagcaactagaaaatgaattattaagcagggttttatactagtaacaagattgttcaggagaaaacatgtatttagtttcactttgttgattgctcgtggaaggagaggtgaatttttacctagggaatgtatggataataaatgagaccataacattgtaacgtagacgggatgccgagtgaaggagagagaaggcacgaagagagaaacattgactcttctttttgaagatttgatgcgaggcacaagatataagggagagttgtgtgtgggtattgtgggaagaaggttagggaaagagaaaaaataatgaataaaaatttggttgtcttgactattaaactaatagtggctctcttaatggcatataaaatcttggagtttgaaggagactcaacggttaaaattgcgtcggtaatacacaattactagtgacgatatacatagctatcaatggtgatacctatcaagtaccaaccatgatacatataggtaccaataatattattatttattaattttaatttaatactctacgatacatcaatgaaaacctatctaagaaagatgtacaacaagtataatagtaagattttattgtttagcccaaccactactggacacatggctaagtaaggccctacaaaacggcgtagtttctctaactactaactagaagaatggtaacccaacacaaaaaacacccatgtcgccctagtgaaataacccatcctgcaccaggagtggggtagggaggttatatgtagtggcggttatagtcttctagaggttttggaccaccctccattttggtacagagtactccatccttcaaatttgataaaaattttgacaaaatagatgtaatgttgacattatataatttagaagtatggtgtaggaccacgcctaacaaaaatttctaaagccaccactgtcctatgacatggaacatggggataccattccaacgtttggatggtgtactctgtaccatagtagctccctttttagcttctctcccccacaaaataccacctcaacctaattttcctttaattatcgcaccaccttaaaattgtgctgtagcagggggtatgaaattgccatggacacccattaaaagtactctttatgattgcaccactgcgaaggaacattgactccagttaacactgaccatttattaatgagaccttttgattcaacagctcaaattgcagttacgtggagtcgaaatcccaaactcgtgcttaatcatgggcctatacggccacatgcattgtggcccaacatcgggtcctgtcttgagagacggagctagcccagcccacggagaagagagcggtccggatctggttggtccacacactccgcatgcagggccgaatagacttgttccccgcgaaatcgtagtacgcgactagctagccagccaccgtccggcccacaacgccggagcgggatcaacgagaaacgcgtgcgagattctggtgcgagccggacggacgatgagtcggatcggcgtcagccactcatcctgtcacagtatcgcccactcgatcggatccgcaccgacactactctcccagccagccacagctcggtgattcgagcgtgggccgcatcggttctggcccatgccgtccgatccgtccgtaggcgagcgcgcgggtcaccgaccgtgttttttttcgattttgctatatctcactcgaaagattttttcttatctctcactcgattttctcactcaaatttacagtgcattttcttgtaagttacagtgtaatttatgaaacttacactgtaacttttgtaagttacactgtaatttttgaatcttcacatgtaaattttaaattttgtattggatttggtctttttctcgaggatatggtaatttaatgttcattatggtgtttcttaattgctttttgctttttattatatctatcggattttaatataaagattaaaaatctgtgtgatacgattataaaaatctttcgaaagatgtataggtactcccgtttttttttcccggagtagccgccggtgatcagtgatctggattctctggaaagcggtttcccttccttctttactgcttcgctaatagtagggaaactattctaatctctcgaggggatgttccctcgtttgctcaaaaatcatctaaacggttatgaaaaattctggaaaaatttgacaatattcatacaacacatatatacaactccacaaaatcttaagtccaaactcaactcacacgtcgagatataaaaaaagacaaattcagcgtatgaatagtagcgcactgtttatatctaaatttgtcttttttgtttctcgatgtgtagaacgaattttaacatgaattttgatggactagtaggtatcattatactctacattgtcaatttttttcagaatttttcgcaactatttgcatcgaatttataagaaaaaggtataggattagaatccactcccctagtactagtcgtctttctctttgcccgtcgctctcaggttcggtgattgtcgctgattaattagcagccggcggttcgcgatgtccggtttccgtttctttctgtcgatttctctctcgagatcgtacgtggagtcaaattaagatcggtcatcagtcgcccgcacactttttgcctcaagatccggtaatacggccgcgtgcgtggtgccacgcctgaggcgcaccatcgatctgactctacgggaaaagtcacgcaggtgcatgtaggacgattcgagcttacttgacatatattacacgcgacaggacaagtagtagtataaagctcgggaggacgggttgatcgatatgattgactcggttgttactctacttgtataagattaggaacacgtgtgctcttacgtaacacagcgtgcgtcgtctacgcaccaataatcacccacaaacaataagtagttaagtcgttttcaacgtgtcaattatacgggagacgacatgtttccgtcgacatgtacggtgctagcttagctagcccggagctgctgaggcgacagcgaaggtacgtacgttgccggcagcggcagcggcagcggggccagattgcccagacatggcgcggtcaagagagcggcagctgacacgaagcgggctaccacgccgctacgcccaccggtgcgcgcgcgcggtgacgaggcagccacccacagagaggcctctcgcacgtacgcgatcgcgcgccgatacatcatccgtctcgatctcctagctcgcttcctccctgcttcccaccggcaccgcggcacggctaccgcgcgcgcgcgcgcacacacaaaccaggccgctgtactcacacgtgctcgatcgatcgctagcttatatagcagcaaaaactactagctcgactcagctgtcagctccaagcctatccaagtggaacgcaacagaggcgtcgtctcctcctctcctcgacctctcgcggttggaggtctcgcgcgcgcgtgaggcaacaagtgcccgttcgatcgaccggcaaggatggcgacggcagcgagagcggcgtcgtgcacccccgccgcttgcgctgtgttggtcatccccatcctagtcctgatcatggcaggtgagttcttcgctcaatctagctcacgatcgagcagtgcttctgcaaattaatctctcctcgatcccccttcagctaagctgtctcgcttcaagctagcagcttatactggttcatcagaaagagacgatggaaattttgtgtgttttagttgctatgcatttcacaattaagttcgttcttgcaaattggggatacgatgctagctgcatttcgttggtttttatctggattagcaggtgcatttgccgatattatatcatgtgattgtgattagtaatgcgcagctctttaagacctcaactatggctaggtgctccatggcgtaagacaccgcgcccactaaggctacaaaaccaaatcaccatataaaatccatctcatttctagaagatccttctattgggtatcaatcttcagttttctatcaattctttacaagcaaagtaagcaacaatagtcgggtatatttccctttactccgctccatttttttactttttccccctccaattctgtttttgctcgtcttatctggtcatgagctgtatgtggtttttctttctccacaaagttcctctggaaagagcatttgttcatcatttattattcgcaccgtacccgccagctgaatttggtttgataggcgagttgcaacttgaaaatataggtgaaaacaaagcacagggctcgacactgcacgccgcattggaataattgagttggttagtacgtagtactactattagttcttggcaggatgccttggtggctcatccaccacatgtccatgtggtccagtgaaatcttgcttcccattggatcacgcgcactgtgtatcttgtatattgtattatatctaaaatttctttattcttcatccggggaaataaattctttattcttctacaggattaattagtccagggtaataatagtgtccaattgtaaacacattgtatcttaagaactgagcataactccgttgacgtggtgtaaggttttcccccaacccacctgagtttgaatcctaaacccagcatgtttctcatgatagcactaatgtatatattactccctccgttgtaggttataagatgttttgactttagtcaaagtcaatctactttaagtttgatcaaatttatagaaaaaaatagtaatatttttgaaccaagataaatttattataaaaatatatttaattattaatttaataaaactaatttgataatgtaaatattgctatatttgaatataaacttagttaaaccaaaacatcttataatctggaattttataacctgaaacggagggagtacttttattccgatgtgcctgcattcattgcactcatgatgataatcaagtttgagctgagctagctgttgcaatctcaaggatgaccaaaaatattacatgaatgagattccgtgtttttcactgcattctatttctcagcaccatagcacatcagaacaaataaatgaacaatgatgatgatcactcggaaaattaaacttgacaaaatgcagcaaaatatacagtggcacattttcctcgcagacagaaccatggctcatttttgcatgtatatatgcgtctaatgcaattgctggtcactgaccgtgacaaatcgcatgcatgcagggcaagtgcgagtcgcggaggcgctgtccatcggcgtgaactacgggcagatcgcgaacaacctcccgtcgccgtcgcgggtgtcgtggctgctccggtcgctcaagatcagcaaggtgaagctgttcgacgccgacccgcacgtcctgcgcgcgttcctcggcacgggcgtggagttcgtggtcggcatcggcaacgaggccgtcccggcgatggccagccccgcggcggcggagtcgtggctgcagctgcacgtggtgccgcacctccgcgccggcgcgcgcatcacctgcatcaccgtcggcaacgaggtgttcaagggcaacgacaccgccctccaggccagcctcctcccggcgttgcggtccgtgcaccaggcgctcggcgcgctcggcctccagggccgcgtcaacgtcaccaccgcgcactcgctggacatcatgggcgtgtcctacccgccgtccgccggtgcgttccacccctccgccgcgccgcacctgcagccgttcctggccttcctgtcggcggcgagggcgccgttcctcatcaactgctacccgtacttcgcctacaaggacgacccggcgcgcgtgccgctggagtacgtgctgttccagcccaacgccggcgtcgtcgacccgcgcacgaggctcgtctacgacaacatgctgtacgcgcaggtggacgccgtgtacgcggcgatccaggcgatggggcacacggacatcgacgtgaaggtgtcggagaccgggtggccgtcccgcggcgaccccgacgaggccggcgcgacgcccgagaacgccgggacgtacatcgggaacctcctccggaggatcgagatgaagcagggcacgccgctgcggccgcaggcgcccatcgacgtctacgtcttcgcgctcttcaacgagaacctcaagcccggcccggcgtcggagcggaactacggcctcttctaccccgacggcacgccggtctacaacgtcggcctccgcggctacctcccgcccatggcatcacacgaggcagcgacccaggtaagacggattactcccacattaccattcttttttcgattacatggaagacacacgtgtgttgcgacatcatacgcatagatcagcggtaaaatcttgattgtgcaaagtttttttttccttgattacacggtacacgcgcacacacacacaccagtacaaacgcaacttcacacttacatccaccagtgtttcccaatagagatgaaaaccaacgttacattcttgatctcactaaattcatatgaaagcatatttgcgtaagtataatatttataacattggaatttaaatccataatctcaccatcacatgacatgtgcttattccataaagatcatactgaaatgacactcacgtacttttttttgtctaaaaaacttaacctatgtgaggatttgatataacctactataacgaatctggatagcgtgggttgcgttcaatcatcacctagatcaggcagtcagctatgctttcacctgattgctctcaaaacattttacgtgatgtacgttgtactactgagatagtgaggtggcaatgtgacagagataaaaggccgttggcatttggcaggcaaggaatagaattctccaccaattgaagtgtcccatccgcttgcacttactagcaaaatgcatcatcaaactcaatattatactcctaagttctcttgtgaacctgtcctttacatgagccttgacaagtcatctacctttgtgtcttttttgcaggtgatccattggttcctacttatcgccaccgcatcggtcgttttcgccttatcgtgacagtatcagccactgtacttagtgagtcgtgacaactgcagttaacgggggtgccattcagaagctgaaaatggcttcgcagtgatattagattagaggatagatctaacagaaatttggaaagtattaacccaccaggcttgcactgcctttcgtcttacagtgttacagaggaagagtcatacagaagaattgtcattggtcgataatacatagcaaatcatcagttgtaagcgtatcacattcttttgggatttataaatgatcttgttctattctggcatctaaggtctggaatctggacgtatattcttgcacagctcctatacacattactgtttctcaccaatcaggaattg

SEQ ID NO: 66644 - DNA, 1478 bp, Oryza sativa
ccaggtggtagtcgtaacccgaccacttaaagtggaagtagtgggagaaacgctacatcgttggccgaggaccaggcagtagtcgtgactcgaccacttaaagtggaagtagtgggagaaatgctacatcgctggtcgaggaccaggcagtagtcgtaactcgaccacttgaagtggaaatagtgggagatacgctacatcgctggtcgaggaccaggcagtagtcgtaactcgaccacttgaagtgaggcgagagagatcactacattttactggttcgagaaccaggagtaggagtctcttaatcacctataggggcgctaaagttggtttattacatgtgcatatcatgtggccagcatgactcacatactcaacttatagcatatccggatgtccgctcgcattcatgtcgggtgatcaagccgacggtgttcgtgaggagttatccgttaacaaccttttctcgagtagtccagcgatggctggcgcaatgagataggtcgtcggtcttctttggtaggttgggcgcgacgactctgcatttgtcgagatcgttctcgataatgcggtgtactcgaccatgacctactcgagtgcttaattgttcctgaaaaatattttctagaaggtaagatatatagcagataatatcgagtatgtactcaaaaaactgcatggatcttctagtattatcaggatataacgagcagatgtaaatatcaggcattatgtaaaccgtaaacaagcatgatttatacagaagataacagagcgagcccctagcgttagaccgtgggtggtttaacgtcggaaacatccgcggaatagatattgtataaaaaatatgctctaggtaaacataataaatcacggatttgacaatgttgtatggtctgaataggcacgataaattgcagataaaatattgcgtacctttgtagatacatgccggatgtatctacgaaattagtagatcagtttaaaaaacaaatctaccaattaccttgttgcgtactctttcgatatcatgcgatctgacatcttttggtacgccgcggagcttgaggcttggatgatctcgatagaccaaattgtcgatgacgatgatggttccgatcttgttaggttggatctccccctcagccgaaatcgtcgagtagtttgttgtctgagaatccatctcttaaacccatctcgtcgaaatcctgaagcaccaaaatccccctacctagcgcgccactagcgacgtttgatgtcgcaattctggtatttgcatagtatgaggatcgtcggtgctaggatatatgcaagactgaggtaaagagatggagacagagatttttatacaggttcgggcccctgaattatcaagtaataaccctacatcctgttggccgaaaccggtattactcttattcatgataatcacaccagtacaatatttggggtagcctatctaactgttgtcgacatgg

SEQ ID NO: 66645 - DNA, 11358 bp, Oryza sativa
aaaagaaaagataaaaaggaaaaaaggattttcccagggattcaatattcgcactttgcttattttaattggttaaaattatttccaaggctctgaaaattccactaaaaatcgtgttagcatattttgacatgtagaatccaagaaaaaaaaaattccacatgtagattccgattattatttgcatttattaattagggattcatctctagttaaattaaacaattacttcggacgatttattttatgaatttagagcaagggaggggaacttcagggcgtgacaagggctggatctgcagagagactgagggagagggagaggaggaatggaggaagagagacgaagtgacttatgggtggtagattaattgttcggtttttaattgcgactggcttttgtaggcggatctcataagactatgcttgtagaaatcgatttatgcaggcacaactttaggaggtctactgtcgacgtttgatgtcgcaattctggtatttgcatagtatggggatcgtcggtgctaggatatatgcaagacttaggtaaagagatggagacagggatttttatacaggttcgggcccctgaattgtcaggtaataaccctacatcctgttggccaaagccggtattgctcttattcatgataatcacaccagtacaatatttggggtagcctatctaactgttgtcgacatggcggtctaacgatctgactcgtagtcgacaacagggtagccttcctcctggaatccgtgcccggcgagatcagagatagcactttcgtctctcctgacagtatccggagacaccgtagggtactagccatgcttatccctgaagtcgatatccggcggcatgtcttggcacatgtaggcttcttctatgttgtggcttctatgtcgattgtgttgggtgttgatcctgttccctctcctcctaggggggcttgtatttatacccataggtgtcctcttgtccaagtagaactagggaaactaatatgatacaatccgaatagtccttgtcgtttcaatgtagaactctggttgtctttccttatccggaactcccttgaggttagtttccgtataagacatggtatatagtggatcctgccgagatttagttaactactattaaatatgtggtatcaataaccatgacagtctataaaaatcttttttttcagacgtaactggttcgccttcgaaaaaatatatatttctcaagcgagacaaccatcgtatcccacgtccacgtgtaggtggctatttggatacgagggatttaccgcttgcatatatctcttaattatcgtgtgtatgttgaagacacattcatgatgcatgtgtgagtgccagtatgatgtgcatgtaactaacaaaattggactgtgatgataacgctggctaatactaagtactctcttcgtccaaaaaaaacaaaccctgaatttccgtgccaacatttgactgtctgtcttatataaaacttttttataattagtattttcattgttgttagatgataaaacataattagtactttatacgtgacttatctttttaattttttttataattttttcaaataagacggacgatcaaacattggacactgaaaccagggtttgtctttttttttaggacggagggagtaggagtattttgaaacgaaatattattggcttcaatttttcaaaccgctccctctcgccatccatcgcctcccgtgatggacggagtgaatggctgcatggattaagccagccgtccgtccgaccggattagttagggggagagagctaagaaaaaaacattaccgaagctagtggggtccgggttgggtataccgctctttatttgtgtgtgtatgccgcgcgcctttgcgtagacgcgtgacgaattcgcgcacacgtattcgctgcggtgaaacaacggaaaatttgtgcgtggagattcatcgtgctccatctgcaaactggagcaaagcacacaatcagcttcggttccaatattatgcagtgtagacttgaatagttcaattccatcgaaagattctttctagacccagtttcttgagtatataacgacactactataatgttgcgtttcatcatcaaataaatgtgcgactttgagttagtagtagtagtaacattttctatgtacgttcctgtattggaatattgaagtcaagtcttcttcaatgggaattaatgttgtgtagtactgttcttcttttcattttggtactaggatcgaagccgaattactatgccaaacagagatgctaaaactacttatattcatgattaagcattaagtagagatgtttagtttgttcacaaagcaacaatatgtgtgcttcagtaatcagtatccatttgatttgactccctttatgggcgtttttttttcagactagactagaggagtgtatttagtcgtcgcatggcatgtgaaattggcgaagagaacggaatctgtggagggaaattgggactacttgagccattttagtatcatggttaggaataactaacatgaggctgtccataatcctgaagattatgtgcagtttatctttaatttattatgtccctaatccctaaccacaagatttctaccattaccaagtgtgtacttggacaccaactcgcatcattccggcgcaagaacaaccacatgcctttactgttcatgtcttagttttgtcttgaaagaaaacaaggacaggtcaaatctaatgctactagttcgtcaattgagaggcattgataaggatttatgatgtcacgggcaagttttcctgaatgctccagctaacctgaatgctgaattgctggcgacgatgatccgggcaaaatagtacaagagaatggtacaaaatttggagggatttcaggcaacctagcagcttgtcaactagccaaggaactgtatagtaaagtgttgctttctttaaaccttgtctcactgctagtattaggcacctgtcatttcgggatttgtatggttgcacggccgctctttacacaacacgcttgcctgtgcggctgtgctatctaacaagaagtcactgtcgagaaggatgcaaagatgcctagtataaattattggtgcaaacaattaaaatccttgcgagacactcaaaacatctgaaattcaatcgtttgattcttttttcaatcaaaaatggctggtgtgtttggacaagcacagccggtacctttttgactgaatgcatatattcagttcaactaaaactgcatcgcagtgggctctgaatcttgatcatgcacatgtgctgtttctttcagagattgcatgcaccaaaccatgcacatttctatccctaattttcctgctggtcttaaatctttaccatgtgagctgattacatctctgcgttgtctgaacacatacacacaggatggcctgaagaccagagcttctagaaatgggggcaatccatggggattgagaactgatcaacagttcaatgcataactatgcagggcatagacaggctcagcggtagatgattcaccaaccagtgtaaattgcttaaaaaactaggttgtctctcttcaatcaggagggaccgttgcagtgtcctttctgcgcaaagtgacatggaagatttgctgcatctcttgttcccttgcaacaacataaaaatggccttatacaaagaaattcttctgcctcttttgtttggtacagtcagtagtactgtagtaggccgcggtttggtggtgccttgcatcggtacaaaaatacaagggggtgtagtatgctctgattgacctttccatggacacatggtttactgatatgactgaaaataataataaaaaaaatgtccacttcttgagttctactctacatattagttacccctcttgctagaataggttggtattgacccttttgttgttgcatacgtgcatctcgtgaaaaaatctttgctgctaagagctatggccatcagaagtgtgtcatgtcacctgacatttaatttggtgaagagaccaattatgggtgtgtttacttccaaagttttttttccaaactttcaactttccatcgcattaaacctttcaaacacacaacttttcaatcacatcgtctccaatttcaaccaaattctaaactttggaccaatctaaacacaacctataccgtcctgatgatgagaaaggtctaaccagctgaattttcagttcttcagcgaagaaaaggaagatgataaacgaaaggaatagaaagatgaatttaagcaagacctggtagtagtaattgacaccaaaagcgctcgtgcttaatgaggtctttcactgatcaacgaaccctaatcaaagtcgtcggcagccgcgcgaccgggctggtggtctcgccggagatcagcgcgcgtgcacgcacgcatgcggtgcagcctgcgggtgaattcgacacgcacgacgaacatttggttacagtggcagagccgcggaacttggagtggcacagcccgcacaaatctaactacgttgagtgatcgctacaaaaattctgttttcaaccactaaaacaacaccaaaattctattacgcccttgtttggtcgatgacttatcaatacataagtgttaaaatataaagtgaactgttcgtttttcgcatcagcttaactttttttggtcaaactgatcaatacatacaacttaataacaattgaagtatgtaaaaagaagaaaaatgtgaagtacctttaagatggtttcctaccatctttttcacgttgttatacgatcatgggttgcttttacgctattttctactaccggcggttattctctaatctggtccattaccgatcggaagtaggagaaatcaattagcaaaagaaacagccactaagccgatatcaaatcacagacggttgatttcacggagggttgcacaaaaagatggcggctcatgattggggcattctgaaaggcacaggttgattggtcggccatcatttacccaatccatacgccgaaacttcctcttatctctgtagcctaaagcaattggaaagtggtaagttgcaagggagattgatggatagttgattggtgatgggagcattagacagccacagcagaatatataccaaagattactaattaaagtgcctggattagtggaagtaacagtgctgtaataatagtggtagaaatgcagtcgtcaggtggtggtcataggcttcgatccagttttcaatctcgagcacttgtgctttttaatttcttctctgagagaaacaacgcaccttctttgcacctgcaaagtgcaaacgctgcaatttctctcccttcggctattctttgaccacaccaactcattcctctcgtcctctcgagctgtaattttcacttccaaaacggtgctgaaattgtgttatctgcagaaaaaaagactgaattttgcaacagcgagagcacttcactggaaatgtgcaccaattctgagcttccttgtcaccaggtcagatcagtatttcagatcattttgacgtacacatacgcatcaggcggcattgacgattcggatgaatgcaacagctaaaacgtttttggtggcttgcgagcgcgtcggcatcactcgccaccgatggggagaaatcgcggacggcatgatgcatgttgacgtccgttttcttcccctcagaacgctgtacaatttgacccatgaagacacttctgacgagcttcttgttctctgcaagtgtcacggtttcgtcagggaacgaaatttgagtcgtcaataattaatgggtgtgaacacatgatctaagcagtcaaatgtcagaagagtttgtttcgttcgtcaatggataacaaacacgagcggatttggtccatagattatcatccccaccatattccttacctaaaacagtgttctgttaggtagttagttaattatcatcctgtgttaattagcacttgtattagcaaagcactggcccgccctatcagtttcagataggatttagtgaatcttgtaaagagactgtcaattagcacaaagatagcattccagtgcaagctaaagtgggcagatcatttttttaatcgagtccaaatgagtatagtggggttcagaatattaggtcagtaggagcaatgtgacaataaaagattaaaatcagcagtgaaagtctccagatcttccaaaagaaaactggcacgctggtaaaggggcttgacgctttcaaaaagagccagaattggaccccatcaggtaaatgtcaaattagcgtgtcatgcaaaaagtcatggcatatgagtgagtagacaatcaaaatatcagagtgtaaaaaactagataaactggataaaaatggcacgtttttcaaactgctaaacggtgtgtttcgtataaaaactttcgttataacatttttcaagtttataataattaaaactcaattaattatacgttatttaccacatcgttttacataaaacacttaatctttatctttatcttcatttttattttcaagagattcaacactaagtgatatggataacagaaatacaatattcaattaatcatgagctgataactgatgccatttgatgtacaagtctaaataatagaatatatgttcagtatttacaggcttgtagcacagaaatgacatgaaaattttacgcagatagtccaagcttatcattgtacgtgccattattatgtaggattaaagccttatcagttatcagcttactgggctggcagaaggaagaagtatcttctgtctgggctcggcccattctagtctttctgaatttggatactgataaatgatgagaaaaagtacactttacgtccctcaactttgggtttaatttcgttcacatccctcaaccgtaaaaccggatataaaatcatccctcaattatcaaaaccagtacatcgagtcacgtatttgaaggacagttttttctacgttgcgcttatgtggcattaccattagtattttcttaaaaaaaactagtaggaccatgtgctagtcacaaaagaaaaacaaaaatagtgggcccacatgtcagcccatctttcttccctccccatctctcttgctcctccctcaaaccaatcgctgccagccggcgctgacgaggaacaacagctggctcaacggctcagaggagttgagttgccggagcatcatgagctcgtggaacgcagtcgatgcagctgtagggtcgtcttcctgaccgagctcagccattgtgccatccacgacatggacgacgatgcgcaggtagcaagggagcacgacgcgacacgcagtgccgctagggtccaagaggaagcggagtcaccagactcgatgtggaatctcgccgcctctccagagcttcgccgcctcgcccgccgccccaaactccgacaccaagccgttcagtcaacaccaacaacgacaatgtcatgctggtgttgctcccaatgcagtagggctggcggatggctaatgttgagcccgtccccatcgtaggcacgcaaccatagtcaagggccactcgcacgacgatgtgggatagatggatggtagtgatgagtttggtggtggcgtggtgtgtggcaggttaattacgtcaccgccggggagaggatgaggtcctgtgctctgtcgtctctccaggtgaggcttcgaagaggacccgacctccccgtcgcttcccaacggcgtcgtagccaccccctccaccttctcgtccttgttctcagtggctcgccaatacgcacacactcgacgactcctttgcctgcttcgcctgtgagctggcttggtcgcagtggttgggctcttgcgctccgcgacgcttcctggggacgacgtgtttggcgacagggatgaggaggcggggattttggtgtgtgtcgatgatgaggcaagggagagaggagaaatggagggaagaggggaaatagagggggtgctggtatgggtcacatggttttttctgttttaagtgctacgtaggcgtcacgtcagctaaaattgttgtctaaaccaccttaggattttatttgtattggttttaaaagttaagagacacagcatttctggtattgttttttaggacgaattttagactcggcgacaaattaagagacataaaatgaacttattacatacatgatgggtcagtgcctcagtgtacgattgagggatgcgcaacaaggcccaatactagcattgccagcgtcattcttgcaaaattacagctgcagatcagaatatcagatcgtatatactacagtacatacactgtcgtctatatataagaatgtggacagccgatagcgtcataccggtagcattccgtgcatactcctacacatgttaaaaactaacaggtctatgactgcattgtttgtatctcagtggcatgggaaaataatttcatccctcgagaggatatcccatcgtttcgtgtataaaaaaaataataaatatagttacgaatgtacgataactattttcagtttaatttgttatttttgttataatctgtagaagttaaatttagtctttgcatatatttcgtattaacctatgttgtaaaaaaaatttatttttttaataactatttaaatgacatgtaaacaatgagagaatgttccctcaaatgataaaaatccacgcccaatgacataaaaagataaatccttcaactctgcaacgtcttaagtagcggtgccattcctgcaccgctgcacgcatatccatttttgttgtaggcgtacgacagcaccaaccggagtgtctgacagagctgccccccgtgaccactcaaatttctagtatatatgctaccgaaattaatcgccattataaggttataactgctcaagattcatgcaccgacctgttccattatccctctctttcctgatccacaatattttggctttttttttctctactaacagtagaattgatctagaaatttctcgtctgtaatattttgaggttagtaaatttcgatagtgttagaatatatttggtttggaatcttatcaaatgttggtagtatttttaaaagcaaaacttctctagaataaccaaattttggagggggcgcacattgattaaggtatatttgatttgttgttttaccaaatataggtattgttgaaagtgggcaataaagtaaacatatccttcatattttcatctaaagaactgaaaaggctagggagtagtcgctattgtctctttaaaacatgtgttggaggtccactcgcatatgtgtgtagatacatcgtatatgtttatttttcttttgaaagaaccacggtaggggaagcccccaccgttaagattttatattaataaaggagaaaaaattacaataaatttaaccactgtaacaatgtatctctctcagaatttttgactctatgaactcaaagggagagatcattcctaaagagaactctccaagagggaacagagggaacaatgttttcaaaaattaaactattcatctgcttccaaatgttccaagcagtataaagtaccttctcaacaaaatgggtagagttatatgaatttctggccgtgaccaacatttcaccaaagcttaaagaaagattccaaaccacaccaaattgcgcccaacattcagtgctaaaaggacactggaaaaataagtggagagttgtttcccttgatcctgttgaacaaagtacacagagcaaggaagcattttgaggggagcaatgccttctgtctaacatgtcataagtatttaaccgatcaatcaagagtagccaaccaaacaccttgactttcatagtacaactgctcttccaaatccatttaatataaacaggcacatggacatgagaaaaattcatggcataaattttctgtgagaaaaagataccgttgccccaaacatatgtccatcgatcactctcatcattaagatgctccaaggtatctgcagctgacattgccaaatattcctgaaaagcttgctctgaaagtggcaaggcaaagagctgaggtagatcagaagtagagaacatcagaactgagagatttgaattcctggcaaaagaatatattctgggataaaccaaggccctgactttattgttccacaaatattcccaaaacaaacaagattttccatcttgcacagtacaggccgagatgcctctaaaaatatccacaaattgcaaaacatccctccaccaaaaagatcctttaggagtaacagcatgaggaggttctgcaatgtagtaagtattccaaattaaactgacccagggaataggatatctattatagaacttatgcagattcttcaagagaagggcattattttacaatgtaaggtctattacacccaaaccacctctatctttcggctgacaaactctttcccagagaaccaaagacttcttattagaattaatatcagatcccctccacaggcaatgtctcctagctctatcaatactttctataactgtctttggaagtgaaagagagcacatgtagtaagtgggaagggaggaaagaactacattcacaatggtcaatctgtccccataagataacaaagcaatggttgctgagagtcttctctctactctatcaactagaggagcaaaatctataactcttggtcttgtggttccaagaggaagacccagataagtaaaaggtaacttaccaatagagcaaccaaacaattttgagagatgatcaaccttttccaaatctacatccagaggaatcatgcatgacttactatagttaatcttaaggccagttgaagaggcaaaagtgttcaaaattgccttgagacagaaaagctctttttgggaaacagtcaaaaaaagtagagtatcatctgattaaaaatatttgatatgtttattttttgaggaaattgcagtggaggagacctccacggtatatattaaaatagagaaaagttatttacaagcatcaaaagaaagaaaacaacagtgttacaaaaggtcaatccataattgaactagagggcgatgaatctccttgagcctagataaatgtagactcaaatcaagcttgaagttccttttccaggtaagaaccccaggctgaattccattaaaaaataggctatttctctccttccaactattccaagcagccaacatcataagctccatgaagcagggattagagataaaaacactctgtgattggatcatataatgaaattcctgggaagtattccatctccaacccaacacattccaacactgctgactgaaactgcaagtaaataaaaatatg

SEQ ID NO: 66646 - DNA, 1153 bp, Oryza sativa
gtatacatgtataccaagtttgtgtacatacgtataaaacctaaaaaatatacttatacaaactttatatacacgtatgtaaactttgcatatacgtatataaagtttgcatatgcatcgtttgtatatgcgtatacaaagtttgtatttatacatgtataacgtattaaaaaaaactaataatgatacggaaagaaaaacagaaaagcaacaaaacaaaaacagaaaccgtaaactacggaaagaaaaaacagaaaaagaaaataaaatcgcaaactacagatacggaaagaaaaacaggaaaaaaaaaagaaaccactcccaaaaaaaaataacgtgggggagggcgcgcgcgactggtcgcggattagctttctcgctcgcgacggcagcgccgcggctgcgtcggcacttcttggcaggtagggatgcaagtggatagccccgctacccgtataaaaatccgttagctagtttattttccatataatagtacaaaatttcagagaaaatataaaatagaagtgagataagcgggctaaaagaacccgcttacccaccccgcttgcatccctattgggcaggtcacggcctggcggctggcattcttcgtttcgctggccagcagagaagggagcagggacgcagccagagccacgcacgatatggtgccgacggcggagagacgaacagccggatggttcgtgaaccgaacagcatcaagataacatattagtacttactaatcagtatggggtatttaggtcttgatgggtatttctttttcttttccttgattaagcacatacttaaaagataattaagatcctattttttcagcttaagatttttgtaatcttaattattaaatcagattactctaagctaaattgagtgctgacattgaataagttgcgagttgtttgtttctctggattattggaggcatttaagggtagagagtctttagccactcaataatctggaaaaagctcctctaaaggagattattggattatactaatctgacttatagattataataatctaacttaataatctacttgtttatttcagcttactcctaataatccagattataataattctaagctgaatcaaacagggcttaagatttgggggcccaactttt

SEQ ID NO: 66647 - DNA, 1159 bp, Oryza sativa
tcaaatgaatttctttagcaacagaatttgatttgtctggcacgggcaacttggttgataagcttggatgcatttgtataactcatgtcacgggcttaaatcagcgtattatggttatggctgatcacttgccagcagaattagcgatgattcgttgttccgggtggaccctgttctgtaatttctgactttgttacaattaaggtccatttcctgacgagagctcattgatggctttcttgtgcctttgtggagacaggttggtagaggttgctgagggcatcaaaacctttctccctgtttcctttttctcgtactggtacgcttggtgttatcgagtttatgtccatgatgccctacattgattgctggactgaaggagccctgatacgctctactgccacgcctcgccaagataagatggcacttttgtttgtaagcttcctctgttgtttctcccgtggtgcgtgtcgtggttgggtttcgacggccagtcggccagagaagggtcgtgtcacgaaaagccttgcccgcactttgaactgtcgcggtagcatcattcctgctttgacccctgatgaagtcatgcaatccatgcatcgcagctagaggcgttcactgtgttccgccttattcgagctcgtgctcttacttggtccttgaaaaagattcgtgattctttttttcagttgtacctgagatgctcccattttcagagcttccggaattttcagccccccccccccctaaaaaaaaactaactttgcacttggattgtgtttggttcctgaaaaaagttaaaagtttgataaaagttggtagtttggaaaaaaattaaaagtttatgtgtgtagaaaagttttagatgttatgtgatggaaaattgaaagttgagggtgatctaaacccggccttgatgggaaacagccaggagtagaatggtgcaaggtaggtaggtgtgcaggtaggtaggcgtgcccggcgtaatctgaccgcgaaattaccctcgcgcaggaaccgaaccaagctagttgtgctccgtattcgctgcaactgtgaaacacctggagcatttgactccatacgcacgaggagtaagtacgcaaggccggccggccggcctgccgcctgccgacgctgtcgcggcggcacagattga

SEQ ID NO: 66648 - DNA, 6215 bp, Oryza sativa
  unsure (1)..(6215): unsure at all n locations
agggtgttcgacttcgtaagtttgatttggacatggatgttagatggaatgcaacttatctaatgcttaagcatctcttcccacataaggagcttttttcattgtttattgaaactcattatcctagggaaaatgatagactattgcttactgatttgcattggacaattgctgaaactgtgcttttattccttgaacaattttatgattcaaccgttattttgtctggtgtttattatccaacatctccattaattatgcatcacattcttgagattgctggacatcttaacacttatgagaatgatattaactttagaaatgttgttgttcccatgaaaagtaagttcttggcatactggtctgagattccatttctgtattcatttgcttttatcttggatcctagggctaagatcagaggttttagcaatgttctacaaattatgtcacaaattttgacctctgattactctacttatttaactgaggttagggctgcattgtctgacattttttctaagtatgaaagtaagtttggtgctgtgagattgcaaagaacaaccccaggcaatactgctggtaagaaaaagatagcatggggaaagatttttggtgccagtgatgcacttggacatggtgctggtgccagtccagcttctggacttggtgctggtctattttccaggagaacttctgctactgctttgattcaagctgtttcttctaatgctaactcgaatgcctctgagttgtctgcctatcttgatagtgacactgtcaaccaattcgacgatgacttcaatatcctaaactggtggcatgagcacaaacacacatatcctattctgtccatattagctagagatgtcttgactgtttctgtttctactatatcgtcgaagtctgcttttagcttaactggcaggatcatcgaggagcgacgacgacgtctaggtcttgacatggtgcaagctttggcattgatcaaggactgggagcaggcagacaagaagttgcagcacactgctgagaatgtagagcttataaaatcatttgagaatttgtttcttgatgatgtaaccagaggcaatgccactggaactggatgattgtactggacttggactttaatatgatagttagatgaaagctgtgggctgcactcttttttcctttctagagttttctcacgaggtgtgagtttttacctagaaaggtttttaatgaggcagccattgcactacacagctactattatttttgaaagtgtttgtgacttgatcacttaagtttgaattgtgatttgtgaactgttagacttagtatttgaaaatgtttcgtggatttgtgacttgagttgtgaattgtgagacttagtagttgagttagtgaattgaattgtgatattgcacatactataacttgtgaattgtgatattgtaatctaagacttgtgatattgtgatctgttaacttgtgaattggatggttttgtgctgttttttgtgatggacattgcattttttatatgtatgtgcaaaactgaagtgaacaagtggcagttagtgtttggcgtgtctgggctggcccgggcacgatgggctcatcgtgccgtcgggccagcacggtccggcacgactgctatcgggccttgcctgggcctgaggtacagcccgtgggcaggcatggcacgacacgaagtgccaggcatgccgtgctggcccgatcgcctcgggccgtgcctaggccgggccgtgccgggtgggtcatatggccatctttacacctcgtagtgtcatagtttgctcaatagtttatcagccattaaaaaacttaattttagaattaattttaagatttatttattgtagcttattttttacatttactttataaacaataaacaataaaaaacatataaaaatgttacacacaaattagtttttttcacttcgtttacttttccaggcgtaaggcaaacgatagtacgacataaaaatgccagtagaagttttggttattttttcttaaaaaaagacatactagtaatttttgttattgactttgcatcacgtgagcaccgcatcgagcttgtcttcttctccggatcgccacgtcagctttccgcttatcgcgctaaagctttccgatcttgccgcagcttcaactgccacgtggggtcaccgcctcgggcccgcattgccagtgacacgaggtagatgcataaaagtccaacacagtcgcatccacacgcggggccacggccgtgcgccacttctcttcctcgctcactcttccccccctctcgcttccttcccttctgctctgcttcctccgcctctgcttcgtgtcgccgtcgccgccgcagcagccgccgccggcgagcaccgggtgcggatactgggagcgatggcgtccgggaaggtcgtgtccttcgtcggcgccgacgagctgggcgtgtccctcgccgcctccttcgtccggtccggggccatcgtccgctgcttcgtcgctcccggggttcgatttctcttccttgtttttttttttcttcgcaggaggttgacgagagacgggctcacgtgagggaacgtgtgcgcgcgtgcgtgcgtgcgtgcgtttgcagggtgatggatcggcgacggcgctcgcggagctgggcggcgtccggtgcgcgagccccgcggaagccgcgcgaggtgagcgtctcgactggagctcctgtactggactgctggaccggtcccgatgcgagtagacagatggcctcctcgtgatttgtagcagttgtttgcgtgccagttggtgttcgtggtgtttgttggattgcctcgtgcttgctcacgaggcgtttgttggaatgccgtgctcccgtggagcaagcacgcccccacatgtctgcagcctctatctgatcgattgctatatcttgatacctgcagacgctgagctagtcattgtgctcagtgacacggatggggttgatgagctgttcttcggacctgaggggatagtgaaaggtatgccatgtgcacgtactcaattttcccagttactaaatttgatgcttcatacaacgtctcattgagcatttgtgcaggactgtgctcgggtgctgttgtattgattcgatcaacaatgctgcctagtcatctggagaagttgaatcagaagcttgcaggtaggcattgttgattttaggataaattaatagaagagttttcttggaaaaaaacttgtatgatgtatactgggtaatggttactttattctgttccagcaaagggaatactgatctttgtgatggacaattacgacaatagccacaatactagttaatctatagcctgacttatcctgcagatgagaagaagaatgcccttcttgatggatacatttttagtggtttatctgatgaattaaagcaaaagattgttgtaagtgatgggacaagatgagaatatgaattgcgcgtgctcgtgtcctttattctgttgtcacccatttccttttaaataccaggttgttgcatctgggagacatgatgttacagaaagaaccgggcaattcttctctggtaattccaaatatgtgttaccattttgccaacattttcttcttggcctatgtcttttgatgttgtgatggtgcaatgatgctgattctaggctacatggtgatattttaggtcttgatacagcagtttactttgttgaaggtgaatttggcagtagcaggttgctgtcttctctcatagtaaagattatcttacattatagaatattgagcattattctccttttccaatttatgtaccatagcccattaactgaaatgttactgatcacagttttaactgcaacccacttatttttacagcaaaattaagctggttaatgatttgctggagagcattcattttatagcatctattgaagcaatgtttcttggtgttcgggctgggattcatccatcaattatctatgacataatatcgaatgctgccggaagctcaaggttataagagtaattcagttcttttttattctatctaaatcttccatacttttatgcatttatttaaatcaagatcttaacttattatgctacagaatattcgtggagatcgtaccaaagcttttgagagaggattctttgcttattgattatctagagtcatccaagacaaacgcagtaagctcctttatgtcaggactacttgcatcatcataaaatatagtatccttcattccttaaatactcacactgaaacagctcctgagactttttttccctgtcagacaatcaattcaccttggtgaaatatttttcattcaacatacacatgttcattctctcataatttcactacaacccttctttctttttctacaaccaatgggaggagaggtactggagaggagattagatatatgagatggtgccaggggcaaatatataaatgtgataaagaacaagggaggggggtatgggggcaagggatgaattccatctgactggtccttaaaatagcttgagaagttgtaatgttctaactataattgttgccttccccatggcaaacagtttactctagtcttttactcttgtggatttaatttttaggtatttatatttttgtatatgttgccaggatactctctttcagatattattaattacttaagtgttgctctgatgttgtgaaatgtaaaaggactatggctactgcaaggctgaacgcttctgcttctgaattattatttttttcactcttaaacattatagggctatgtgatggatatggctaaagcagtaatattccctttgccacttgtagctgtttcttatcaacaattaatacatggtatgctgttaaactcctttgcatcagccatttgatggcaaaatgctagttcaaagtcatttatgcttttaataaaaagacttgaatccctacattctttgcttatgtttttttcattcatatgcatttctctgttcttaatttcaggttgttcatcagcaaatggagatgcattagtctcaccgttgaaggtgtgaactgtcgggttattttaattctgattatagatgcttcagtttcgcaaatatattataaaacttcatttgcaggtttgggaacagtcatttggagtaaacatcatagatgctgccagtcaacaaatctacgatgcaagcaaattagctgaccagcttgttatggcatgtaaaacagcaaaaactatcggctttattggtcttggagctatgggctttggaatggcatctcatttgctaaaatcaggtttctccgttattgcttatgatgtaaggagattacttaccatagatatgccagtagatatgagtacatatccaatgtattactggcggaaagttgccagggtagcagaaaaagagtgctgtgcgccatagagcagggcacttgcagtgcagtgtggaggagtgtcgagagtgtgcacagtattgtgtggatgagtgtacgcagagtgccagagtaggagtgtgtcagcaccatatgcagagtaaagagaatagggcctgccaagattgcacgtgtggctacaaaaaaaacacacctatncaacgggagctattcagctcacatagacagttgaagttcacgtgcatggtgcacgtgacaccagtgatctgaatgacaggcagatagtttgtgaacgcctttattcctagagatgagaaaatagaacagcctacatgccattttcaccattttatacatttattcagtaacggacataatgttgcaaactttatttcataaaatttgctcttttttttggttttacatacaataatattttttgtattccatttaggtatacaagccaacactggccaggtttactgatttaggtggattgactaaagattctcctgaggaagtatcaaaaggtaccttgcaaccttctgctacagagtaaagttctcacaaccataagataaaatttgatcaactatagaattatagtcagctaaaatgtgttgcgcaatcaaagtccacatggaaaaaatatatgtatggatatactagctgaatgcctgtgctttgctagggataaaatatatttttcatgaagtgtgctacccatggtttgatatgggaaatattcaccttattttaattttatatgttgctatccatttaggtttgattttttaatatt

SEQ ID NO: 66649 - DNA, 1749 bp, Oryza sativa
aattttatttctatatcgactctagtctcctcttctaatattccttattttttaattccgaatttcagctatttctatattgtatgtatatatggactctagtcttctcttctaatattccttattttttaatttccaatttctgctatttctaaattgtatttctatatggactctgctttttttttctctgattaatgtgagaatttttaggccatgagagcgaacgtgggagctcctttttctattcttttaataatataactagctgggtgaccgcgcaattgcgcggctagcttccatacaaaattatttttttaaaaaaaagttaaatagctatattattatcttaggaatttgatcaacctaaccttattatctccatgtttctagttttatatttttgaaaatcacacctatcgctacctcttacttatttgtcacccttttattttcttgctcgatctattagggtttctatttatcctccttggaacttttaaaattagacagtttattgtctcgttgggttttgttttttataatttttataagtctccgtcaaaagcggccactctactcgtctatagtccatccgccgcctccttttctttgttgccattgagattttaaaattgaacataattatcatcggtgtttatttttaacttttttttttttccggcaaaccgtgaacagcttcgccattgtactcctctatgacccacccgttgcattccctcttaattatcattgagattttaaaaaatcgaacgtgattatgattttggtttaccttttactgttgtaaaactcttgccaaccactgtgattgtgctgcttaacagcttgcccatcattccttctcttaatcattactgggattctatttgatttttgtgttaaatttaaccactataattttaacatgatatcatctaacaaatattttttagtaatattaaaattcaataatatgataaatagatactacttgaactctttcgaattcatattaaaaaccaatttggagttgtattttattttaaattttaatttttaaaaaatattttgttgtgttctagatggacactgcttctaatattctttatttttaattctaaatttcagtaatttctaaattgtattcctacctgaactttgtcgaattctacgaattcgtattgagatcaaattttgggattcatcatgacgtgtctatcactccgctcttttttttttctaatttcttctatactttttacgttatttgctaattaggattaccaattaatcttcgaaaaccctatatcttagtcgccaataatttataattttgagacttacatcacttgcatatataagtttgggatttacatatgtaataattttgagacttatagtctaaatacgttaaaattacatatataattttagggacttataacgtaaatacatgcttactattatttgatgaaaaatatgacgacaggtactcccttccaatttgccgtgctagtcatcaatctattgaaaaaaatgcatgacatttggtgtgctttctctccgggacgccatccatattttctccaggagtgctaggctagctatttaggcatgcatatatatatatggcagtgcatgtcctttttttttcttcgatggttaatcggatacgaattagtacaacaacacggatacgaaaaatcaatttgctgtatgattctttccatatattcattgatcaat

SEQ ID NO: 66650 - DNA, 1071 bp, Oryza sativa
ggggttccaccaacatattttagtctattttggattgagtttagcttgatacgggtgtctaagttggaatcgagcaggtgtatatatagtgaaaattgataatctatagctgaaaaaatttctgaaccgggttcctgggcaccccccttgatacacctagctccgcccctggatggtaggagctcgagataaagtgcggtagcgcgagagcttgggctatggcattatcttgtttctcttgaggagcataatatttataataaattggaaaagtgaagaaaagaactcattgcccgtttaggggagcttctaactactgcagcttctaccaaaagcagaaaatctcctaaacagtccagttttttgttcaaattttgaaaagctgtagttgtagtttctgaactagaaaccagaagctgtaaaacccagcttttccagattctcaaaagctgactatcaattagctgcttcgcagaatcttgatctccccaaacgggccctcagccttaatcactaggtggttggtctctctccttttctttgaaaaatatgatacaagagtattctttacctttttcatggtcaaagtagttcaaattgatggtatcatattcctattttctactctctccgtagcgaatataaggacacgcgagaagaatttgggaaaaattaagctagaaagaaaaaaaagactcaattgcccctcattaaagttccggaatcagttagctacatattggcgtaattaattaaagaccgatttgttcagttaacctaggccttaaaatgtatatttgggaaaatgctttatatcgtacgtacgatgaaaccgaaatatcggacgcgtcatctactgcaaatcggtatatggataggatgaaccatatcactgtaacatccatggccaatcgtttccttttgttcttacctcttctctttaaatattttttcttctaaattacttatcccgatctacgaaccgatcacactggtgtattcgctacaattaaatctttacaacaagatatatatgatatatcatgcaaaagaaaaacatatgttcaaacc

SEQ ID NO: 66651 - DNA, 7865 bp, Oryza sativa
ttagaccaatatgatgttaggaacagaagtgactactgaatctacccatgatttcaacctatcagattcatgcaaaatgcatcaaacctatacaactttctccaaacaggtccacgtgtgtagcaaaaaatcatgtgatgactgtaagtttgctttattttacagtgtttcattttcctttgttatgtcccaatgaaatatgcagcaatttctgttgttttacctttcttctgagagaagattctggcaatgcaagttcctgagctcgctgttctctggccttgttcctcctttcaatgtcattgttggtcttgcggagtagaaaccatctaaacaacggtattgcaaaaaaggaaccagcatatacctacaaagggccacatgttatcagtaatcagtatatcatcaatgcattcatcatacattcacaacataatacaaccaacagtttgcacattatgactttcagatgttcccctcacaaaaccaagggttcatgattgatttcaaccaggtgcttttcaacatgactataaagatcaagggattacaacttttatgcaactaaataggccgcatagagcccagccatacctgaagcaaaggaaacagttgcgcaacaaatgagataagtccaccaggtggcactgtcatttgcctacaaaacaaagtttaatgtaaaaaattagtaaaagtgaattacaattcaatggtatttgagggcagaatcacaattcctacttcaacaggttcccaagaatgatcacaccaaaaagattgagtcctcccaaaccagcaaccattgccctttcagatgcatttgctttgctgcaaaacgacaacaccacatatgaatatacagaggtacaagacaaactgcagatttcaaaaataacaaattgatgcaattaccctctaatgcatcaatacagacaattctcggctccaatgcagtgcattccatagtgtactaatgtgtgacttgattccaagaaaaaataaatttacaatccaaacacaagtacatgcacattatagggtaacaaaacacccttaagttagattttggcatcagactgaacaaatatttccttgaattgaaccaaaatggaccaaatagatagaggtagtgcatggtagagagctgcacaagttaggatgacgaggtagatgagctaaaggcaggaattggaaataatggagcttcatttgtcatttgatctgaagtcacagagggtgatgcggacagctttgatagttcgcagttgtgttttaggcagcttggggtatattttaggacctaggccaaagtacaatgttggaaggtagaacaggttccactagagttaaatgcaataacagggaaactacttgaataactcaatgacaaaaaaatgctaacctgaatttccatggtttctcctctaagtacttttcaacactgctaaacatagcagaccatttgttaccaacatattctctaaccccacttccttttgatgaagcagtacgttgcagtgatggaaacctataaagaatgtttccctgaatacaaaaacaacatcaaaatacactataagttgatcagttcaatcaagatgcattcaagttcactaccagttatgtaatgccaccttcagtaagtggtgggattgatggtgtaaacattaagaacaatgtagggatatgtcttagtggcagtcaatatatgcttaaattatgagaagaaagatggacctgttcatcaacttctgggtgtccctggaagcgtaatagaactggaagaataaatgattcatcatcctgtagttcagaatatcatatgcatatgatgagatgaggcttcacgccaacgaacaatccataacttacatggaaaattcatcacagtatttaatttatttagtaatgaatggaaaagtacaaaaaaaaccaataacaacaagaagaatactaataagcattttagaacagaagttatataccttggattgttctgaaattggtggcacatcaagatacggtgctagttcttctgccgtgacaactccaccattcgatgaaatatattgcccaatctgtatatttattcaaggagaagttagaattttgtaacagtacaaactagtaacaaataagagctgatcatgatagttagaaacagaaacagctatatggcctatgaaaagcttttaccatcttccacctcttatcttcaagaccatcatttggatcaccatctccaaatacaaatgaaaagatctgcataattgatttatgaacataaagttaacccacctacacatgacagaattacaccaaggaaatgaaatatcaagtcaaacccttttaaattacagattcaataaaattcatcccatcttccttttctacccgccgccgcctcctgtagtaatcagcgtccaagtacctgttgaagacatatgaaatattattgtgaacgactgaacgatagcaatgtgtacaaactacaaaattaaaagtattcacggtgcaaaatcaaagattgcattaacagctggatgatttagtatcatttttcatgcagtccctacataagagttattttcatgttgatttacgcatgctatgcatagtgaatgcataaaatacaactaacacatatgcatgagtatgactacgtttaaattgattgtatttttgccagagcatttattctgagatggttcgtttcagaagaaatactagcacaacagttggcacagagcccaggcaattttcaaccataaatgtgcaatagccgatgaagtttagcaaccccccaaacgcaaaagtagatggacattataattgtttgtgttccttcgcccaagaatgcactaagataatccagctatgttgaaactcgtcctaaagtgacaggagacttaccaaaataaatctgttggtatgatgatagtagagtcataggatctccgtcgcctgccgcgattatcttcatcactgatacaataagaagtgttatcactggactggaaataagcaaatgacagtatctctactaatgtccccaaatatatagaaacaactaataatggctaaatcttagactatagagtgagattttttattctgaattacatatttatggatggaattgaggagaacggttgataaatatgaagacattgtgcctgaattgctttgagtagaatagagtatagtaattaattaactgaaaatccatctggttatactaagcccacctcgagcttgagataatggcaatgatggtagtgtatacaagcacaatggaggcgatgagcgctgtcccaaatgacactcgcaccaaatatgcacccacttcctgcgaaaagttacagaaagaaaattcacaactgagccaacaaaatgactcgcgcaatttttatcaataaactttttgtttcatctctccagcagtccagcaccttagttttgtcgatcagcggctcgaccttcattctgaacgacttgccagcaagcttcgccctgtagtctttagggaagacgtacagcacctccccttcctccgagacctacacaagtcgcaaccgcttcatgcttagacagccacaaaaggcacggaggttagcaaaaccaaggacgcggtgacaacggagtacttagcagagctaaggaggcgcacctccaggaagccgccggtgtcagcggcgagcgcttgcagcgcgcgctcggcctgcgcgagctgcagccccgcgcgggacgcgacgtcgccgatggtgacgcggccgccgaagtggtcgacggcctccatggcgcggtcgcgcacgccggaggggaggcggtcggtctccacggcgccgccggggcgcgcgagccccggcgcctggatggtccccgcgcgggccctcacgtcgtggcgccaccgcggcgacggcgggtgcgggtgccggccgtggtggtggtgggcgacgcggaggtggaggtggaggtggtggtggtagggagagagggggaggaaaggggcgtggcgcggcggcctgccgcggcggtgaggcggcgggggcggggcgaggcggaggtggagggagagggaggcggcgggcgccatgggtggggggaggtggtggtgggggtttagggcgaggtgggcattctccggtgagaggagtggctgtggaaggcggaagggaaaggggggagagaggcggtggtgtgtgctggccgtggccacgagatcggatttggtctctctgaccggtggatttctgggtcggtctcgttcatggcctgcactagctaggcacgttaagttcaagctcagcaataacgctaagcaaaattgggtgaaaacagatcgaataaagttagttagacacagataatagacaaaatggatgatcaaaagttcaaaacactagaaaaatatcaaaagtattgggttgagtgattagagagaaaaaaaacacggtttacaaagacacttgtaagactattgctccctccatttcaggtgagaattttcagaatataccacaatatgcactgcttttaggatttgtcacccaattcgtactactttcagaatacaccactagagtggaattttttcgtttcgtgccctccgtccacccaaagacgtgcgtcgtcagttcatccatctcgtgccatttgcctgcacgaatttggccgccggcgagctcgtcctcccccacgcgtcgtttgccctcacgcatctggcgagctcgctcgtgttgtccccgagctcagccgccgccgcaccgggctgtcgccactgcgccctcgagccaccggagctcgacgccctccgccctccactgctattcctctctcctccgggcctctcccgcgtgcgccgatggtggcgacggacagtcgacggtgcaactgacgcgggcacgacggacgagcgatgacggggctgacgccggcggcgacggacgggcgacggctgggctgacgcaggcgcgagcagcggcggactgacgacggcggcgccaggaggacggaggacgacggcagcgccaagaggacggaggacgacggcgcgattgacgctaggggacagagtggtacggaataaagaaaatccgcactccagtggtgtattctgaaagtagtgcgaattgggggacaaatcctgaaagcaatgcgtgttgggtggtatattctgaaaattctcattttaggttgcaagacgttttgactttggtcaaagtcaaattgttttaagtttgactaagtttatagataaatatagtaatatttataatactaaattagtttcatcaaatcaataattaaatatattttcataataaatttgtcttaggttgaaaatgttactactttttctacaaacttggttaaacttaaagtagtttgactttgactaaagttaaaacgttagataattttggtcgacatgacgaatgtgttcggccaattcgcggtagcatatagaaaatccattatctaaaaagaattgcagtagcaactcgaaactttaagaaggatagtaccaagtaacagatgaattatttatgagatggataaaatgcagtaaaaaaaacacagcaacgatttctttttttaatggtgaatgttatgacaatgttagtcccaatcaagctacatcttgataatgaatctaatgtattggtttgtttaattttttgtatgtatacaaaaaggttgtgtattgtattgttctcgtatgtgtgtacattccagttttactattttgattagttggttattgtttattggctagtaacatgatatgcagtagtaatattcaaactaactatggatatactttttatgtagtgcattaagttaatgaatcagattgagcggactgttatcttctttatttactcatatgctttctgtttgtaagttatctcaagaaaatcaaatgatatatccatagtgatggactaattatattttttttaagtgatgaacgtattgcatatactgagagtctatacatagaataatgattgttttgttcatcttttttaaagatataaattttacgttaacttccgttattcatatttttaaactgctaaacggtacattttttttaaaaaaaaactttctataaatcatcattttaaaatatcaaataaatttatttttaaaatttataataattaaagctcaattaatcttgcgttcatctttcattttaatctatctcaaacaccacgaatcatactttgtctttcaatcgttcgcatcaagaaccagaaccaggttcttgcagcggcagctaaaagggggggtttttaactatttgccactcttacggagtgccactcttgagatgccactctttcaaatttttttaaagaattaccataagagagagaattaatctttataaatgaccaaatttgcctaagtggagggctacctcagctctgtcaacatgaaagcggatgtctaatgactctttggcccttggtttaaacattgtaatagctgactataaccaaatatttgagcaacatttgagattatatacaaacgtatctaaaaatatggtttatcattttttaaaaaatagtttataatgggcaaatgttcagtaatttgaataagttcaccataatataataatagattcaacgaggtcatatccgtatagaaataaaccatcacactagtttatagaatatatcagttcatattgaaatagaagtcataggatcattagtccagtacatctgatctgagaactactgaactagtgtggatggtctagctcatggatgtaaccatgtagaaatgtagaatccattatttttattatggtgaactggttcaaactactgatttttttcctatgataaacccttttttaatagatagtattttttttaagatacgtttgtatataatttcccaaatgttactcaaatatttggtgtacaagagtacatggtcaaaccaagggtacaagagtcatttgaatttagctttcacgctggcaaaactgacatggccctccacttaggtaaatttgatcatttgtaaagattaattctctttcttgtggtaattctgtaaaaaaaaagttagaagagtggcatctcaagagtgccactccgtaagagtggcaaatagttaaaaacgccgctaaaaggaagggagcgtattctatgcacacaggccctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgcaaccttaaaactgtcagattttttgttttttttgttacagctaaaatataatgaatttgacgttaagattttaaccctaagtgtaatacaactgaaagtatgtgtatgattttttctagattttttggtgatattttttagttggtgtgcacgtgtatatacacgtgagagcctgtgtgcataggatatgttgcgtaaaaggaatccaccatttgggttcttcccggggtaaaatatcggcccctcgttccctttcggccacgtcaccatctccccttccgaacagcttgccgccaccaccacaccacgccgctcgccgccctcgcggcttcctgccatccgcgacacgcttctcccgcaccgccgcacaccgtcaaaaaaatatcggcgggcgccgcgcaaagcgacctcctccccccttcacctgcgcgcgcgccgacgaggacacagtagcggccagccacccacacagccaccgcgccggaaaacgggctaaacaatggcgctc

SEQ ID NO: 66652 - DNA, 5559 bp, Oryza sativa
ggaggttgtgtttatcggtactactagacgcgataccctgcgctttgctacgagatatctgaataaatgcatgttaattatacgtaaaaaaatggtagatatatgtttaaataatatgaaaatgatgtagagataatgatttgacattacttgcatatttttcagttttaaagttataacaaaattataaatgatatgtcatatttgcatgatatttaaaatactctagataattataattgctagtggtgatgatgtggcacacttccatgttgagttttaggagttagtggatatcaacttaatagtaagataagattaattaatcatgaacttattttgagaataactttaccatgttagaaagtagtatgagtatattttgttcgattacacgaaagacccaaatacatgtgaaccccaaataaacatgtacacctataaatgacaacccctcccctctcccccaacccgaaccaaggttgagtgattttctcaaacctagctttggctggatttgtataattcgctctcatcggttaacctaatattgattataagttgtatggtttattactaataaaaatagtttatgtttcaaacttttatatgtgttcatagcgatggaaaaaccaacattgaaaaataaactacaatgaaagccccttaaaatcaacttcaaaattagttttaaattttattagttgtagggtaaataatttaaatttatataagttcccctttcatcttatactctatgcaatttcaataggtatgcgatattagcccccaggcctaattgccatattcctgtctcagtattgtctataacatactatggaggtcaaagagatacggaaaacactagtggtgtgatggtggagtcgtgggtgcatgactccacccatatggactcaaatcctaatgtccacaaatattacacacatgtaggtgtgttttcaatagaaatttattgagattagggttgtgccgctggttttcatctttaaagcatgtgttgcgtgtgcttcagtcatgtaatgaaaaaaaaaagtcgaagagataggccaggggcaccataccatatgcttctcctcatgctatatcgtttattgccatgccacgttggatatgccaaacaagatatattttagagtaatcttctaaaatttgtatatactttcacgcttgacattattgtcgtcccacgttggatgttaaaaggatttattttacaatagtcttctgaaacctgtatgtagcacatgacataatgataagcattgtgggtgtatttgtttcctcgtatttcttgtcacatttcaagatagtccgcttttttttccgtggcagatgctatatatatatttctttttatgtttgcaataagattataactctttctcttgtatctctatcataaaaatatagctatttctattgttacaaatatgtacatttttaagatgtggtgtacatatatttctagttgctccctcagtttcatattataattcgtcttaagtttttccgtagtcaaatttctttagatttgagtgaatttataggaaaaaattagcaacatctataacaataattagtttcattaaatataacataaatatatttgaatattatgtttgttttgtatttaaaatatcgctatatttctatataaacttgattaaacattagaaaaattaactagaagaaacgtcaaaaacaacgtatctttactacttaaaaaatttaaaatgtttccttcttccgtaaaaaaaatagcgaaaaaaataacaaaaaagagcaaaatttaaaacgtttccttcgtccgtaaaaaaaagcgaaaaaaataaaaaaaagcccgactcctggatccgattcccccttaaaaacgcgtcaaaacaacaaaaaaaagcgaaaaaaagtccaactccctagatccgattctcccttaaaaacggagtccgactcccctaagtagatccgattccccccttaaaaacaaaaaaaagctgagcaaaaatagcaacgtgcaatccttcgtgccaatatgagtcgatcccaggcacctgtcctctcggtttcaatctatacggtgatatcccatacatcttggtgaaaaaatctgtgtgccggatcggagatccgtttgcaaaaacggaacctatagaaagagagcattccattttctttgtatgattttaatttttgggtttgcgcttttgtatttgagtctctattttttttatttatatttgagtcaccgtaatcttgcaataaggtacttgaggttgcttttgttaaaaaaaatcaaaagaaaggagagaaccaaggcagaaaggtgcataaaaagaaaaagaaaagccgcacaagaaaagaaaaataaataaaataataaaaacaacaacaaaaaagtccgtttcccctaagtggcgaaaagaaaccatagatccgaacagaaaaaaatccgattcctatagaaggcaaaaaaaaaacaaaaacaaaagtggtgaaaaaaaaaagctagatccgattcctttaaaaacggaaaaaaatttctaagttcactttaggtcccttcagttgaactttttttgtttcattcattttgatatagagaaatgaatattgcttttgtcttatcacacctgattctgaaaaaaaacaaataaaatgtcattgcattaaccacataaatattgtgaatttttttcttaaagagctcatatcatataaactaaaccttaatcatataatatttttatatttgttataaatttttgcaacgcacgggcattttttctatgtcaaaaaaatattttaatttacagaattagtttgctctatttaagctttttaaaaattcctaaaatttgagaataacttttcttacttcatattaagttatttttagctaatggaattaattatatatttttatcttttgaccaaaggtcactgcaatttcatttcattattattattatgattacgattatcatttttgcgcaaccgtatgtatgattaaaattaccttcacctattacaacgcacaggtattattgctagtaatataaaatggagagagtatttccgtttgtggactgattcgaaaaaaaatattgatgaaaggttgaaaaataggaagcctatgcgtggaaaggcagagagagagaggccgggaaggcgccgtgcgttgcgaggactgtcaggcgccgggtcacctcgatccgacgtagatttggccaagttggtccctatcgcggctcgcctttcggcggcgacggcgagcaacgggcccgccaccgcaagcgggccagggcacagagacgtgcacgccgcggagcttgggctgggctacctggctggctggctggccggcgcgacgaaccatcctcgcgcgtgcgtgcgattgcgaacaaggggctagctagctaggtagagtagtcctctttggtcactgttccgtgcgaccatgcggccggccgtgcagttgattgagggccccccgtcaatgtaactgcaacccgattagcttagtgttaagagtaaattttataaaacttcaccagttatggttttatgaaatttagtctaggattaacgatgtgacattataacaacagttaagtttttttaacatgtatttttttcccataaatttcgtaacttacactgtatcttaccaataaattttaaagcttaaatccatttattttgtattctcgatagacgataactaggacaaaaatggttgtttatatattttaatctgagaaaaaatacgagtccaaattaacgtataagcaaaaaatgtaaaaaaataaaagtagaaaaagatataagggagataaaaaaacagagagctagccatcgcgtaatgaaaaaaaaagtgattgaaaataagcaaaagttatcaattatataaactcctcaaagttaatttacatttaaaaaaaaatctccaaacttcctaaattcacaatcacaagttcataagcacttcaatcgccacctctcttggcaatcgccttctcgagccaccgctattctcactatcattgctcctgagccatgaatgtagctagctaccacggtcgttgccatcgctaagtcgtacccttatcgttaagttctatcgcatgtagtgtttttgttggtccaccattgtcacctgattcagcgctcatgaggagcaccaccacctagattcagagctcccaaagctcacttcagcctcagctgcttccatgacgggtgtcgtatagatggccgcgtagagacatcggatgatatgggtggcacagaggaagagggggagggcagtgcgtggggagggataggaagaaataaaatggagggagacatagaaacgcaggtggtgagctgaaggagaggggaatagagaatggtggattgggtgcagaggccacttgacttaacttttttctcacttgtttgattcggctggcattggctgcctcggtcacttaagctgaccatgtgtccgtgtctcaaaccctatttttagatatgtccgttttaggtaacgtacgtcgaaatcgattttcagacagctcatggccacaggccttcccatttactacataagcagttttttataggccacctgtgcagcaaaataaagctatctttgaaaatagaccttttttcattattactccttcacaattttaacttttttatagtcaaacttatttaaatttaactaaatttattgtaaatcatagaaaattttcaacataaaacaaatatatatctcatattagattgaatgaaactaatttggtttggtgttatatagatatgttcactaaatttctctataaactcggttaattttctttaaaaaaattaccagaaaaaggttcaaaacgtgttataatataaatggagggagtagtgaactagtgatgaacagtggaaattagtgcgttcgagacacgtcgtccgttcttgtggtggttcagtgacactcatccaaaattgtggactcctagctttcgatctgctggaccatttagtcctccgatcacctagtccttcaaccatcttggccatacctatgcccagtttgcccactattaataattctcgctcccacaacttctcacagaatctaacgatagcctgagccccatgcacaaatgacaccgacaccattgacctcagctgtttagacactatgcccactataggtacaaaagcctagctagtactgtcactgctgccatgaggaggaagacattctaaaacattatgagcctcttcttttgcttttacaatctttgtcaacctctcactagtggcggctcatatagttaaggtttaggatttgatgttagcgtccttgacatgataatgagatggagacaatgccattaagaggagtaggaggtagtaacaaacatcaaattaaaagagcatcaagggtgagagcccaaagagtcaaagtcacaactcgcaaaacaagtgtggttggtgatggtgtattggtgtatatcgctttactcgttagatttagtagtgtcagatttt

SEQ ID NO: 66653 - DNA, 2681 bp, Oryza sativa
tgaaaggatgtttcgccgcgaagctcgagagcagccgcagcgagactagtcagactcagactcagcagcaacacgtttccgccgctcctcatgacaataccagggccacctcctctcatgtcatcaccagcgatatcagcatggatgcaaacacgatcggtgccagtgctgatgctgacggcaaggcagcggcaagcggcgttggcgcaggtgaaattgtcctcgccggagcttcgtcgacggatatggccatgatgatgtcggtcgaggacttcgcgccgacaccgttggcgccatccgccgtctcaccgttcaagaagaaggggaaggtgcacgagtgctccatctgccaccgggtgttcacgtcggggcaagcgctcggcggccacaagcgatgccactggctgacgtcgggcgcaacggacccgctcacgaagctccagcccgtcgcccaagaccacgccatgatggccgccatgtgccaccagctcacgctcgggcgcccaatattcgaccctaccgaccagcggatactagaccttaacgtgccgacgaacccactggcagaagcggtcgcggccaggcagcagcagcagcagcaggtcgccgctctcaacgacggcgcactctgcctcaacgcggcggcgtcggtgtacctgcagtcctggacagggcacagcaacgggagccacgtgaacaagaccaccgcgacgagcagccgcatcaacgacgcggccggcggcgtgaccacggaggacgatgaagcggacagcacgagcgccaagagagccaagatcggcgacctcaaggacatgaaagggcaggggagtcgttgccctggctgcaggttggcatcggaatttcatcagagagcaaagaaaagaacactcaagagaaacctagtcatgacaaggaggtcatgccgactaatgaactaagaaattaattaattaattaattagtgctaatctaatccatatatatatatacatattgtaggtgtacgtactatatcaatgctttatgtgatcgggatatatgtatgtgtatatacatccaatgtaagtatttacaagtagggtcaattcatgtgttcctaaaggtttgaggcaacatctagggacgtattgcttgggggactgtaaattaataggctagcaagcttgattctaaaaggtttccttactgtacgattctttgaggagccttgctttttatttttatttttttccttttattttttctattttgtaactaaccgattatttaatttgctgcttccaaaatgtatatatgcaagttgattttgtccttgtgttcactgcaattagacaagctatatgtgtgcctatatatgtttttttcttgcatttctacactatatattactctaaatatacgacgttcttaacttttaaacataatatttagctatacgttttatttaaatttattgtaaacataaaaaaatcacgccagatataaaggatctttaataatgcaaattagtaaagataaaaaaataatgtttaaagtaaactgaatgataaaataagttaaagcaaaataaatgaaacttacttcatagctaattttactgcagatatgcaaatgtataagccattcttaacaaatcaaatcacaataaaataaataatacttaacaaatttcatgtcaaaaagatatattcaaaaatggaggtggtactattctgcgggaggtgaggaacgtcaatttttttattcatatcgccacggtggagaagcttgctgatgttcgttaccagtccagttcgatggtgcatgtaaataggtcgggcaggcgcccgatacttataatatgtatataaagtgtatatatacgtatagacaacgtatatgtataatataaattttatgtatatgtattttttatgtataaaaatatatattcgtataaaaactttgtatatgtatatgtatacttgtattggtataatacaaagtttatatacatatgtattatatcaatataaagtttatgtatgtatatataaataattatatgtataaaaaatattggcgtataaaaatatacacgtatacaaagtttatatacgtacgaattaaaaaaaccgaaaaagactgccacccctctctccgtgcaacacatggctgcgacgcgcgggggaggagcatgcctaattagaattggaactagctaataatctgtcgacagtttttaaggctcaaaactttcaaatttttaaccataggatttgtcatcaacagttgaaatgggtactgttaacagtaaaatttggtaatcccaaagttaccatcggtttagagtcagtatcggcttcaaagttcgagaatcagccgatgggagtcaagtcgccacgatgtcgtgttcttggtggagttggatcaatcaaaggaagcttatctagaagagttcgagttcaagaaagatgcgacatgacagttatctattaattaggcatagtttattagtttccttttatctttaggaaagtgtgtttagtgtccgataaggactttatcttttcctttttagtttctttcttgtccgacaaggactagtatctccctatgggtataaatatgtacaaccggggtcattgtaatctatcaatctatcgatcaataatactctcggcgcatcgccaccctcttcc

SEQ ID NO: 66654 - DNA, 15263 bp, Oryza sativa
agattttatataacttttttaaaacatattataaccagtggcgctcaccttctcacaatatgcatacactcatcctatctaactagttgaactatactcactccatggattttgtataatttgatggaaaacagtctgataagcgaaattttctgagaaatcaatggatggaaggatgcatagacatgtgcactcgatctaaacttcacatgcataaaaattttttattattaatttgtgtggatttgcttggcaaaaatcacttttcacatagtagtgcatactgcataatgtagttccattacagagagcaacagatcgttagttagtcctttgctccttgataccaaaaccctcgttctgatatagactaaacggagagtactaattcttgattggaattcctataacctaattataggcctgtaaaaataatgccaaaacctaagtaggttctgaaattaccaaaatttggtaaaatacaatctattatattcagtctttgttttgtttgctattaaagaaaactatttttggcaaaaaaaaagagaaaaagaaaaccaaattttggcaatgtgatattatgcatgggcattagcattactaaagctgggctaaggcccaatggaatagacagggaaaggtgagcaagggccaggcttgacctcctcccccatggtttgagattttttcaatacagattattgtacagcttgtaagcaattttttaaacagaactaacattatcagctctcctaataaataatttataggattcctggctccaaccactgattagggcctaccaaattataataagcaattcaaatcccaatcgaacactattgctgtttcaccaaagctttggtagcaacctaaaccagccattcctaattccttgtcgatgaaaacaacacaaagtgaacttgaaaaaccttgccgttgcacgggctgtgcattgactacttttttcatatggcgaccaagccaaaaaaccaaacaaaattaacccaaactggcacagctccaccgtcctgccgaagaaggggcaggcatgcgtgcgtggagaaagctacgcacgcatggggctgcgctgtactgagccaaattttatggttaagttgtcaacttgttgtttgtacccatatcgcctaacctcccatgacgacgttgattcctcgcttcgatcctactccctccgtcccaaaaataaaaaaacaaaccctggtttccgtgtacaacgtttgaccgttcatcttatttaaaaaaaatattaaaaaaattaaaaagataagtcacgcataaagtattaatcatgttttatcatctaacaacgcataaagtattaatcatgttttatcatctaacaacaaggaaaatactaattataaaaaaatttcatataaaacggacagtcaaacgttgataaaaaaactcaggatttgtctttttttttttgaacggagggagtacatgtaaagtgagccgtcacacgtcatgtgtccgtccacggatccatgctactccctcagttgtttaatacttctagataacatcgtttaatttttttaataagacggatagttaaacatatgcgtcgtatattgttaaaagaataggagggagtacattctggaagtacgagagccctgtcacagctgattggatcggttcagatttggatgacaaggcaccgtgtgatagttttggtacagttcttttggttaatttcatcggccgtcaattctgtgcccacgctttttagtagaccaagcttggaaaacagaggcaggtggccattttcctgctggttttgtggttggtggaattttgcaatacatttttagtcacgtttcttatcatttatataaaaggcatagccaagtgtctaaccactctattcagtttctattttaagtcattctccagatggtcccaaatatcatcactcttcttgtggataaaggttgaagagtaaattattctaacttggacaaataaaaacgattgtcattgttttgcctacaactaataatatatgtatttagcaacttaaaaataaatgttaaaaaataaaccacgattaaaaaaggagtatcttgcatcaactggtaggtgcgggcgatctaatgcaagaacttaaaaaattagcatatatgtgcaataatttggttatgcgtatatattggttaaaatatcaatattccacactatactttttatgccaaataaaaaagaagccactcagtccatctccacaaggatctgcatatatttcttataatttcttagttataataataaaataatttatcgatttgaaactgaaaaatatatgattatcaaaagtaacataattttcgagcgattcgactaatcaacatattcttgggcgacaataatggcaaaacacaaaattgaacccatgagtcaacgatctagcagttaaccttataataccaggattaatcaaaggtatgtatcagagtgtttttgactaaaatacacatgattgccaagttcatgtaccaatttactcattttcaagttcttacactagatcatatccacctatcaagttcttgtatcatgggtgttatttactcaaaataaaaggaaaacatcaagctcagctctaaaattccagatttgatggtaccatgttattcccgcgctagaaaagacgggtagccaagtacaccaactagccgattggtgcaaagcaattaggaaatctgcccgtacatcttccggagttgggcgagcagaagggaacgaggccaccaaatggcccgcaagcccaccggccgaagctcgggctgcatgcaaagcgtgccgggcacagcgcatggtgacagctcacgctggctgtaggtcgtagtgcaccctgacgcgcggccagcgcgatggcccctcaggacccaaacgcaccgagagagaacgcctcggaccgtgatcccaggtcaggcgggactacccgctgagtttaagcatataaataagcgaaggagaagaaatttactaggattcccctaataaccgaattgtagtctggattagagtcctcagcgaaggaccgagcccaactcccatggaaaggggcacctgggagggtgagagccccattcggcatggacccgatcgccccatgaggcgccgtcaacgagattggttgtttgggaatgcagcccaaatcgggcggtaaactccgtccaaggctaaatacagcgagagattgatagcaaacaagcaccacgagggaaagatgaaaatgacattgaaaagagagtcaaaaagtgcttgaaatcgccgggagagaagcagatgagggccgatgatgcgccctggccgtatgcagaacggcttcggctggtctacgaattggctcagggcgtggactgttgttgactgcgccggcggccaaagcctgggggcctcgcgcctccgatagccatcgtcggcgcagccggtcaccgcgcccctcggggcactgcgttgcaacggcctgcaggctccccatccaacctgttttgaaacacggaccacggagtctgacatgcgtgcgagtcgacgggttttgaaacctggaatacgcaaggaatctgacaagtggcaggccctcgcgggccatacctttggccgccctgatcttctgtgaagggttcgaattggagtacgcatgtcgggacccgaaagatggtgaattatgcttgagcggggcgaagtcagaggaaaatctaatggaggctcgaagcgatactgacgtacaaatcgtttgtctgacttgggtatagggatgagaccaatcgaaccatctagtagctggttccctccgaagtttccctcaggatagctagaaagaccaatatccaatgtccattatttctctcctaattcatggagaaatctttctctggtttagactaggaaaacccctaccatcatatgcaggaatttgagcagctttgctcgtcacggtggaaattgtttctgttctctctttatgagagagagagagaaacaatggacattggatattggtctttctagctatcccgagggaaactttggagggaatcacctactagatggttcgattagtctttcggccctatacccaagtcagacaaatgatttgcacgtcagtatcgcttcgagcctccaccagagtttcctttggcttcgcctcgctcaggcttagttaaccatcgttcgggtctcgacaggcgtgctccaactcaaaccctttacagaagattagggtcggccggcggtgcggcccgcgagggcctctcactcgtcagcttccttgcgcatcccaggttccagaacccatcgactcgtaggcatgtcagactccttggtccgtgtctcaagacgggtcggatggttttggtagtagcacctcgatcatcataagaatcggtcttcaggcctctgctgcaaagcactaccgtattatcacatgtctaataggtaaggcttagtttgtacctcagtctaatgggtaatatccacgaattaaatttgaaaatatatattttttcaatattttgcgtttatatacatgcatgaaaaatatttgcacaaatataccacctccgtataacggggatgcgggaccgaggaggtgctgctcttttattccgtgggaccggcagtcgcgcagtacgcccgtgcggcaccgcctcacatggactcgctggagggcggtcccgcaccacggcgctgcgcgacaagcacagtcccgcgcatcagtgccgcgcaactgccctccaccacgctaaacagtgcagctcggttgtgtctggattaattatagacctaacggaggccaaaattaacaatatgactaaccagctagcttgtactttctcgaggaattaggttggaaatgatcgatggatggagctgaggagatcaggatggaataattaataagctaagcaagtgcttatgtattgtgaggtttgactggatcaactgcgtgcgtgcgtgcgtgcatgcttgacaggtgatgcttgcatccgcgacacacgcacgcgcgggacgggacgggaagcacggtcccgcgccatggcgccgcgcgaccggctccgtcccgcttggtgccgccctccgccacgctgccgctctcctaagctgcgggagcgagacggtgccgcacacccgtcctgcgcgatcgccggtcccgtggaataccaagcgcggcaccgtttcgatcccgcgttcccgtcgtgcggaaaaaaatatttgtgcaaatatttcctatgcagtatataaacgaaaaatattaaaaaaaattgtatatttttaaatttaattctactatccacgacctcatgggatgtggttccatggccacggcggagttgctcggcgaaatgttgttcggcccggacaatcagggggccttgtgtttactcggcccaggaggtggtgattggtatagatggccatgtgggccgcccggcacggcacggcccaggcctggccgtgcctgggccgaggcttgtcgggccggcacggcccgaccgacgcaccgggccgtgccgtgccagcccacgtgccgcactcacagcccaggcacggcccaacacgcctcgggccgtgccgggccggcccgaaggcacgatgggccatcgtgcttttcctcagaataagtctaaattttctccctcctattaggctgtgacattgtatagctaaaaaaaagtctattttacctccctcttctttgtgatgtggtatataaatagctaaaataagtctatttaaggtccctattctttagacattgacatttatatgtctatttttagtccctatactttgtgtaccgggtctggcctgccagcccatcgtgccgggccggcccgaccgtgccgggccagcccagcgtgctggtggggaggcccaggcacggcccgacggtcgggccgggccagcacgggcccgacccaagtcgggccgtgccgtgcttgggccgggccaaaaaggcgtgccgtgggccgggccttcgggcctcgggccttatgaccaactatagtgattgggagatgaggcgcacgcggcggcatcacgtaggaaaaagtacaccgaaggtacctcaacttgtcattgagttataaaatcgtccccaaccgtaaaaccagatattcaacgtcccttaactaattaaaaccggtcacaatatatccttcggtgattttaacactggttttatcctacgtagcggctgaatcaatgtgacccacgtgtcaggatgccacgtcagtctccctccctctctctctctcactcttctcttctcttctcttccgttctctttctctgggcaagccggccggcggctggggagaaggccgccggggcgaggcgggagaggcggccggcgccgcaacggcggccggcggcggcgtcgacgccggcgatcaccaccacgtctaaggttgtgttccaggacggctcagctccatggcgcagttcgtggcgccggctagcacggtgagggacgcgcgttgtcggcgtcggcgtccacctgcttcgtctgctgctccgacgagctccgcttcgacgcgccggcgcgcgcgatggcggtgcacgacgcgctccggctgggccagctctacttcgtgctgcccgtctcagcgctccaccggccgttctccgaccaggacatggccgcgctcaccgtcaaggccatcgcggcgctcggggcctctgccactgccgccgccgccggcggcaacagcagcagtatcagcgtgtcgtcgcggggcaagaacgcgagtcccgccagcaaacagcggcagcagacgacggctcgagtggcgccgatacgacgaggatcaacggaggtagcattgctcgccaacgcgcaggattgcagatgcagaggtcgagcgccatctcggaaggcgatgagtgatccaacttattaaattgctatatacaagtttgatcaaagattagttgctaaatgctaattagttaattagatgctcccacatttgtagatagaggagtccatacttgtatagtatgttcagacaatttttatactgattctttgcagcatgccatatcgtctttttttttagatgaaattgttcatatctccgttgatcctcgtcgtatcggcgccactcgagcagtcgtctgctgccgctgcttgccggcgggactcgcgttcttgccccgcgacgacacgctgctgctgccaccgccgccggcggcggtggcggaggccccgagtgccgcgatggccttgacggcgggcgcggccttgtcctgggctcctggccggagagcggccggtggagcgctgagacgggcagcacgaagtagagctggcccggccggagcgcgtcgtgagccgccatcgcgcgcgccgacgcgtcgaagtggagctcgtcggagcagcagacgaagcaggtggacgctgacgccgacgacccgcgtccctcaccgtgctagccggcgccgcgaacatggagccgtcctagaacacaactttagccgtggtggtgatcgccggcgtcgacgccgccactggccgccgtcacggcgccgccctcctcctctcccgcctcgccccggcggccttctccccagccgccggcgggcttgccgaagaagaaaagagaagggtgagagagagaaggaagggagagagacgtagcatcctggcatatggggtccacgtgggtcctacgttgactcagacgccatgtaggataaaaccggtgtcaaaaccaccgaatgacctattgtgaccggttttgtaagttgaaggatgtcatatatctggttttgtggttggggacgattgtataactcgatgacaagttgagggacctacggtgtacttattcccatcacgtatggttgctgctccagttagggcggcccagttaaacgtttcatccgtgagcggtgaggaagatgatcaggcccggcacatatgttccttttcaacgaatttttttgggagtacctatacatctttcgaaagatttttataatcgtatcacacagatttttaatctttagattaaaatccgatagatataataaaaagcaaaaagcaattaagaaacaccataatggacactaaattaccatatcctcaataaaaagaccaaatccaatacaaaatttaaaatttacatgcgaagattcaaaaattacagtgtaacttacaaaagttacagtgtaaatttcataaattacactgtaacttacaagaaaatgcactgtaaatttgagtaagaaaatcgagtgagagataagaaaaaatctttcgagtgagatatagcaaaatcgaatcgaaaaattaaaaattgagtccgacacattaaagaagcgggccaggttggatgagatttgatctagactgatcaatttgcacgaatcttgcaacaaaagatctaacggcaggaaaatcgactgagacataaaaaagaatcacacgacagagaaatagcaaaatcgatttttttttatttatgtttatcttttaaaagatttaaaaaataattaccgttttaatgttttgtaaaaatatattcctcccaccctatgggcatataaatcgccgtacggtagagcgtgctatgtgacgtgatacaagatgggaggacgcgttgtgtcaattcacgccctctcgtagggcgacttattttgatgacattgaccatagtttgataatgcatagagcgtatcatgacaattttgcaagcacccccctcccgatgataaaccaccctcaccggaaggggacaacctacgaaattaccatggcacgccctctcacggggtacatcacatagattgttctaccatagagagatttttatgccttgtcctacaatagggcaagagaagtatatttctattgttataaaaattgaagttgtttttgccggttccgtgtatgagtcggtttttaagttcgttcgcttttggaaatacagatttatatttgagtcgggttttaagtttattcgcttttgaaaatattgtataagaaatcttttttaaaaaaaaaactcgcatgctaacttgatatgattttttaaaaaaatatatatccaagcgaattctcacagtaaacaataataagattaaaatagccttcacccgttgcaatgcacaggtattttttctagtttatgtaaaactttgaaatgtgaatttttttttgaaatatttgaaaaacaaatataagaaatcccttttcaacagcaggggtagttttcgaagaggactacacaattattggtaggcctcaggctgacctaaactttattaatggtatcacatcccaaggaaactatacaggatattgtaatttttctctcgatgtgtgccgaaattgggtttggtcgcatggcgtcattcaatatttgttaagaataagaacaaaaaatccatcaagcaagtaacaaattacaaagccgttttgtcttaccaaatatctacagaacggagccgaacaagagcaacacgagatgatcgattttgttggcactttttctaacactatgcacaaaagtaatgtatctttatacgtagagctactcgtagtactttctcctctaagcatcagctaaactacagcaacagatcatggcgagagcatcacagtttcagcatatacattacacagcagtataacatgtctaccctatctgaaaacatcgtgaaaaacggaaaagaaaaaaaaaactccatgtcgatcgtgtgaaacgagacaggaaaccggcggcggcttcgtcttcgtcttcgtcccaacgaaaacgaccgaagcaaatcgggctcagcagctccagtcttctctggctctggctctggctgaaaccaacatgcttcttccaatatatttatatatatatattgattgattgattcattacacttcatattttcagaaaattctgtcatgctattatctcgtctggcatcgccacgaacctcgttcgcttctgaaacaccacaagaaaagaaaaaagattagttcagaaaccgtcagcaaaagcgacgaatgataaactgataataatcctctttagaccaattgtcattgttaatcggtatacgcatggtcagggagacaacgacaggtcaggattttgagcgtggggagaaattaagcaagaaagcaagtaacaggctaatatcaaagtgcaactgtaatgcattattgtgaaaatgatgaaggaaggaaaaggctaaacgtttcgctcatttcgatcgacctctctttaattatctcgagaaggaaaaagacttggcagagttagataaggatcactgatggtgatgaggttaattgcaaagaaagactagaattatcatatgacggttgcctgcagctgctaataactgagctatagtttaatggttgtggctgtctatttgacttttagctcctaacgaataaatcaaattggcgattttaccacatcactgacggcgactgaaaattttgccggagatatactgatggttatgaaataagaaacttggcatggtttaatccctcaaactttgccagtatgggttttaagccaagacagcgaactggccatagcccatatgacataataattccatgtttcttctgcttctcaatttctcatacctttcactttttctgaaggaatcaatttaagaacattttgctttgtaccaatctcactgtacatggagttatcatttccatgtttgcaagcacagatgaacacaggactagtattaattagtcatttcccgcgaatgcaaagaaaggtatgagaaaaaaaaaacagagaaggaaaatgtagtgccacgtataaaggaaaaaaaataaaacgtcacatttcgatcaagagtattaaagtagatatctgttgacagcagtggaaagcgtacagagaactctttctgaaacttcatcaggaccaaaaacatttttccgctggagatctacgactggactacggataattgtacgctgaattagcagccagaaaaccgagaaaagtcccctgattatccacagatattcaagtgcgagcatgacaagcaactgtattctttactgccactcatcgctcacatcaatccggtcaaaatcttgaaaagttctactactactactgctgcagtacgtactgctccgtgatttgtgatatgggctgtgtttagttcacatcaattgaaagtttagttgaaattgaaacgatgtgatgaaaaagttagaaatttatgtgtataaaagttttgatgtgatggaaagttaaaagttcgaagaaatattttggaactaaacacggcgatgatcgcgtcgtcccgtgcgccacgacaacaaccagcaaaccaacgctggattgggcggtaattgaaattgctaaagcgtgtcagcatcgacataaaacgcctcaagctttgctgatttcacgcgacgagagcaagcagcatcgtctcttttactctcctttttcttttctttttttcactttttctaactggctgtgctcctacagatctacaggcaaagtatgtacgtgctcatggagaaagagacagctttggattgattactactacagcttttgaaagtgtccgttccaaaagtaataacagtattaattaatcaacacactgtgtggatgtactgtgctatcttcttgggtgtactaagcacaaaaaataattgggttaagatgaactgactctgttgagattttgctgaaatagttattttaaccaccccaaatcaaatgcatctcgttgcgtgttgcgtcgtgctcggatgtgcgagtacaaagagaaaatagccatttgttgtctttgtcagagcatgacatgggacccttctaatgacactttctctctgttggatgggccccatcgttaatacgttagcctaacatcatgcttgacacactagtgattagtgaaccatgcagctccagatcgatgctcttcaggacgcgtaatcgtctagtacaagttcttcaaaatcgcgattatccaattcccaattgttgtttttttctcttttcaatttgagcaatgcatacacagcatcattttataacatttgatccaaatcccacagagagttgggttttcgatgattataaactgtttttttgcataaacatctacctgcaaatttatgtagccaacctgaaaattttggtttgctaatttttgacacaattttgcgtgggaggaggttgaggtaaaggtgttgctactcgaaattatgataatttagtaagacattttttgtttgtttgtgagaacgaaatatttttcttgactgaaaaattagattatgaaaaaaatcttagttcacactactattagggcgcaaagaaaaaaaatgccatgaaccataatattatattttctataactaccatcacacttcaattaatcgttctcgtatttacgcgtgcgcttcaccaaaaaagaaaaagttaagatcaagtaaaattttttttattgttcatggatttgtttcccccttttctggataagggttaaaacaggcgctaccgtgcatgagtgtgtatgcgtttttttgtaaccacaaaaaaaataaaacacaataataatcctgaaattaggtaatggagtactccctctgtttcgaaatgtttgacaccgttgactttttagcacatgtttgaccgttcgtcttatttaaaatttttttgtgaaatatgtaaaattatatacctacataaaaatatatttaacaatgaatcaaatgataggaaaagaattaataattacttaaattttttaaataagacaaatagtcaaacatgtacttaaaaaaagtcaacggcgtaaaatatttcgaaagggaggagtattattatatttttcaaataataatcttggagagaagcaatgcattacctccttccgggcggccttgacgtctcgcgacgagtactccggcgtgcgcggcagcgtcggccacctctccggcgtcctcagcagccctgacctctctggcgtcggcatcatgaacccggtgccccactccggcgtcgccgcgaacctcgggctcacctccggcgtccgcgcgaagccaccggcgacgccccagtccggcgtggggatgaaccgcgggctccgctcgggcgtccgcagtatccccctctcgggcgtcgcggcgccgctcgcgccgccgttggcgttggccgcggcgcacagctgcatgatcttggcggccgcctcggcggagtcccggctctcgcccatgagcttctccacctgcgccttggggaggcgcatcctgaggcggacggggccgccgcccggctcggaggcggtggacatcggggacggcggcgcggtgccgaccgccgccgaggccgggagggagaggtcggaggtggaccggcgggtgagcatcagcgactcgagccgctcccgcgcgccgacgtgtagcgcccctgaccacgcccgccgcggcggcgccgtggggcggggcagcgcgacgaggaagtagagccgcccggggcggagcggcgcgtcgtgcgcgagcgggcgcgcgcggacgccgagcagcttgacctcctcggactcgagcagctggaaccccgggtggtcgcgcagcaccgtgccggcgaacgccgggggcttcacccggaacgccgtgccgtccagctgcatcaccttggcgcccttgcgccgcccgccgatgctgttgcccattgccgcgccgcgcctcgcctgatgctccttcctccggcggctgggctgagctgcgtcgcgcttggatttttgcctccgaattggcgaattctcttctctcgcgcgtggccttgggtgtggggcaaagtttggctcgctttgtagtttgcggcgattgcgggtgggcgtgagaatttaaaaggggagggaaaagaaaaaaaggaggggaggtgtgcgggagtcaaagggggggtggtgtgagtattgggcttgagatggaccgaagggagaattctttcttattctttgtataaggtgtggtttgattttcttcctttgcaagggggtttgtaaacaatactctattgcccaccacgcggttaaaaatcattttaactttataattttttaactgcaaccatgatgacacgtttttgactgtcaagttgttaggaggtcaatgggtgatacatgtggtcgtgtttaacatggctctgtgttttcttactttaattttactaaccaaaaaccctgccatattatgaataaccctattattttgtttacttattattgtaagtaaaagtctaagttttaatacttaactttagagctgattttttcatttttttttcattgtaatttattttataatatttatttttaaatcattaagaacacgtatataaaagttttactcgtaaattgcctttaaattgttaataagcgattcacataagcataatcaaaacaataagaccggaagtattttgtttttgggttctgtaccaaccattataacaaggcaacaaagcagtgaaaaaggagtaaattttggtaaaacattgatatttttatataaaaacataaattgagcaaatttgttgcacgactacaaatttaacatatctaaatcaaagcgagcaaatcacaacatatatgtttaattagtgtcacttttatcacaaaattcaggttttagaggctactacaatctaaggaaaatcagaataatccactagctcgatggttaactaaatttatttagggaaaaaggactattaaatcacacggggcatattacaatcgtttttgatcaaccacgaaatagagttggactcaaacctggtctagaagcctgagtaacagtcccttctagctttggttgctcattcatgtctaatcaaattttgttcgcgttggatcttcgtaatgaaaatcgtcctttaacctttcttaaagaagtcgactaaatcttttgttgttacaaccaaaattttctacaatcaccgcatcgttcaggcctgcttgtttgagcatttttttggttgtgactcataccatgcatgtaacatagttttgaggtcagattcttgtacttcgatcttctcttagcggtaaagtcaaagaacaaaaaagaactgaattaattctaaaattcaaaattggttatggccaacctaagagcacccgcaatggtaaagtaaggtgctatctataaaacatgtacatctcagcaatagactagattaatagtaaaccgcctcaatagtatg

SEQ ID NO: 66655 - DNA, 4591 bp, Oryza sativa
atcctgcttaggataactaaaaggcaccacaaattaggcggatttgaaggaggacatcaacgtctttacaccatgatgtgatgttaatatgtgtgagattttctaaaaatcaactctttgtgtgatggatggagcattcgaggataaacattcaatcaattctttgtgggacagataagagtattaaaatgaagatatgccaaagtgtttaaagaaaaggagaaaaaaaagaaaatataagcatgccaaagttttagggattagaggatagaccactcaactcaacgagattaggggaaaaaaataaaaaggcaattaactaagcatgacaaagtttggaaaaggaaattagggaaaagggaaaaaaatatacatgttaaagtttcaaaagggggaattagggaaaaagaagaaaaattgaagtcaaagtttcagaaatgaaattaggaaaaaaaatagaagaaaaaagacatgtcaaaggttaaaaaaggatattagcaaaaaaaataaaaatgtcaaagtttcaaaaatgaaattagggaaaaaattaaaatgaaaattaggggaaaattttaaaaataaatgaaattagggaaaaaattaaaatgaaaattaggggaaaattttaaaaaaaataacaataagggcccatccgggttcgaaccggagacctcttgatctgcagtcaaatgctctaccactgagctatggaccctttgctgaatttattttggattttagtttactcaaagaaatttaatggcagtcttttctaattattgtgagatggtgatataatcaatgcaaatttcataaggtcactgtcactatactaaatagagcctatatttcttccatgacgactgcgcttacgcttgagagtggacttgatccttatccaaaaaggacaaacagaaacgcacgcacacaaaaacaagagaaaaggagccacctgaatcgaaacacagccgccagatcgcctcaaaaacaaagagaaaattccacgcgtgaagcgtttagactcgtgtccatcgatattgcggcgcgaaaagcaccgggcgtcctcctcccttcaacaaactacaaactacagtatgtatactattagagcaggtttaataatagcgcctgcggctggcgataattttttccacgtcagttagaatcaaactaatagctaacatgcacaataaataaactgtaacatatctgctcatcaatttatagatactattttcttctttaattatcttaccctctctcttcctttacttttctcgaccaatgactgtgattatcagcctctgtagtgcatagcagcgggcccacttctctcgggttgtgcgtgtagcccggcgactgtttagtcgccgacttatcccatttttgctcttctctccgcgccagctcagcatccaagccaacgtggcatttttatcgctggctttcatagcttattgcacctgttcttactagctcgtggaatacaggaatagcctcgtactatacaggaataaatgccattagcaaattcaacattagtcggccggtccactcattgaatagcttcgagtgtttcaagaaatgagtatatatcgcatttaagctctaaagtttaaaacggtgacataggctgtgtttagttggatccaaagtttggattttggttgaaattggagatgatgtgactaaaaagttgtgtgtgtatgataggttgatgtgatggaaaaggactgaagtttggatccaaactttggatctaaacacagccatagcttagaatataattgttgcaagtcattatatatataggacgagcgcgagattttgaaaagcagctaatgaggaggtatctgctgagtatatggaaaatgtggttttcctaagtttttagttatcttttcagattctgtttagaatatgggtgagagtatgaattatttgagatatcttgagtttctaggagaacctgtaattgcgaaaagcttctccgaaatctgtacatggctatagttagactatccaatgatcactagttacttcgtcggttatgacagaaggtagatgaactttcatcattgttgttttagctatggcaaagcaaatagatttagcaaagttcattcaattacaaattttagcattgatgctagtaaatatctttaaaaaatattgttggccaacatagaataactcatacaaaatcgacaattatttgtagacggagaaaccaagtttaattggtttcaacaatggagcatgacatctatcagtgttgagcctgcgcagctaccgtacgtacaagtaactaatctggtttaaaaatttgtgatatatcatgtcaacaaattatttactccctccgtcctattttaagtgtagccatgagttttcgtgtccaactttgatcgtccgccttatctgaaatatttttgtaattaatatttttattgttatgaatagtactttactcgtgacttatgtttttaaatttttttcaaataagacagacgatcaaaattggacgtggaaaaccatggttgcacttaaaatgggactgagggagtaccacataagcaggaacatattttagctaagtgagttaacgagtgagtggctggatagataaaaaaggcccccgcgttgccccacgcaggtgacacggccgtagcctaccttagtccccaccaccccttcgaccctcctcctccacttcgctgccacttgagggaccaagcgaaaaccgtacgacgaattaggatggctgcgatgggggcaaaagcgcaatccaatgcccagatctggcgcggagaaacgaggaaaaggcacaatggtgcattggcgaggagtcttggtgcggtggatagggtcaccaaagtggagcagtggcgtgttggggcagctgagatagagcgcgacggaaggtcatgactaggcctcctctgcgggcttggtggctagatttatatggatctggcatcccctcttaatcggctagagcaacacgagcaacaggcgggttgctatggcggcattagttttctggcatggatggaggccgtcaatattcatgcaaagggtttcggtgccaatgggcaaggtggaggttggtgcctataaggacgggcatgggcagagcatactagcatagtgaagtggatactatatgggatggagctgtccaacggcgaggagttgcacagtcagtgtcttgtcaaggaggctgagtcaatggtgaaggcatggagatcatcaaggagtaacagtggccggaggtggccgcaagaagtgggaggtggcacctgttgggtcgcacggggagacaaccgtcgggctgaacgatgaggaggtgatgggtgatgtgacttcaactcaagatggcagctcgatcagtcgtcacaacaggcacaattggtggatcagatggtgacggggtggttctctcttccatctgctaggcctcctccctctccttgagggcaagtactataagcctctacacacttgctcctgggtgccatgtaaactcacatgatgaggtggatgagagaaatgaagagagagagatgatgagccacctcttatgcaagaggcaatctctattcaaactccaaaagagatgagatcaagaggtcaataaattaataggaaacaaataaagtaaatttaatatggtgtattgggacaagtgtgctagaggtaatttattgtatatattgactcttaattaatgagttgatgatgtgaataagattgggaggctattagagcgagtacaataataggctacaagtcagctgtaagcacatgtggagtagagaagagaagagagagaaggaaagcgggctacagattcgtagccaactgcagcacaaactccaatatgtcgtgtgtacgagaggtgggaccatatattaatagtgtagtatatggttatagataactattgtatgaataagctattagattggatacagatgaattagagctaatagttggttgtactgttaaatttgctcttatcacccctactttaaaactttgctctgtaggtgttccccctctattgggagaaaattgacatttagccatattcaggatggggtttcgctggaatgccactcccgaatatggcttcgttataatgccattgtcaaatgaagccaacgtgctataatgccatttcaaccattttaactgatttccaaatgttttccatcattctctgacatatttgcccctagtcattttgttgactttgcaggggaaaggagaaaggggatcgatccccatccagtcgccggcggtggagcgtagcggcggcggctgcggcgacggggcatagctgcgagttggtggtcgccggctcctcgtcctcatcaccaccaccacgccaacatccgtcggctcgccgtgggcatgacggagagggcgaggagagaggagcggagctcgccgtgcgcgcgacggaggcgacgaacgtggtgaagtggtggggagttgcgggagggaggcataggggacgccggcgaggcactcgaggaggaggtcgtcgaggaggatggagatgggggtcggcgatgaggtgggc

SEQ ID NO: 66656 - DNA, 2709 bp, Oryza sativa
acggagaggaggaagacagaccgagccgtacggagaggaggaagacagagaggagagatgagataggatcaagggtattttggtcatctcaacaagaaaaaacattacaaaaaacattaaactgagaagaaatggatggaatggcattgcaacaagttacccctgtttgagggtggcattttaacgaaaccacttttgggagtggcatttcagcgaaaccccgttttgagaatggctaaatgtcaattttctcctctattggagggtgttcagacatccgttgcgaataaacatgaactcttgtcttcctcctcctagaatttaccttaaaaaagattagccaagtgaggtagtaattcaaacttcccttccatctatttatcgtgcagagtactcgatgcaaaaaaaacaagcagaaaataacacggcttggaatctcggggaacgaattaaacaaacgccattagcttccaaattaagcgacaatccaaccaacccgtcctgtcactggcactgtcactgccgccgtgccaccgtttttcaaatccccatctccaaaccattggcgcctcccatcacacccgcaaattacccattctacccctccattcctcacctcatctcacccctcttcaaaaccaaacctccatcaagtcttcgtctacatcacacactacacaaccaaagaaagaaagaaaagcgagatgccaccgcttactctcgattccctcttgcacggcggcggcggcgagccggaggacgagtgcgaagacgagttctccggttccgacgacgacggcgaggacggtggcggtggttctgaggaatggggcggcgacgttgatggcgagtatgacccgtactccccagcggagtcgctgtggctcaggatcggggaggacatcgactggagcgaggtcggggcggtgctggagcgggaggactccaccaagggcgcctccaaccccaagtcggccgcggcctgcagctgcgccggcgcgccggcggcgaggatgccgacgtgcgccggcggaggcgggacggcgaaggcggtcgtcatcgcggggctgcccgcggcggcgcggaaggcctcgcgggagcacgagcggcggcggcggctcggccgcgcccgagcccgcgcgcgggtgttcgccggggacgccgtggaggtggcggagcccgggtcgcccaaggtgtcctgcctcggcggcgtccggtcgcgggcgcgggcgcaacagccgtgctgtcccgccgcggcagctgcggggagccgccggtggtggtgcgcgccgtggttggtgagcgccgcgtgccgccggtgctggagcgccccgccaccgcgcgtgtaggtacggtggtggttgccggtggaagcaaaggtgaggcgtcgccgtcgagttcagaggcaatttggcgaaggcgacgccgcgacggcggacggcggggtcaggggtcgtgcaaccacgtacgcgacggctgaccggcgaaacgtacagtttggtcaggaattgtgggcccacctcctcgatgaatgtctatctgctttaagttccctgtgactgtacgtgaaagctgagtacggtggccgttcaaattggaattccaatgggcctcgatccatatgcctctccaatgtcacgctctgttttgttcatcttttgtgctaaatgtttcccaaatgttgctgtacaaatgcattgatacgaaattacagaaagaggtgcacataatacgccgccttatcacgagaaatatttgcatatatgtcattgtaaaaaagttggcttcgttcatatgcatcacttaaatgagcttagaaaaaatatcactctcaatcgaggagtcttcgttgaaatgtcatcctgaactattttgtcattggcctttttctttctcccttcgacacagacctcccttcgacacataaaaagctcatcggcagccaccgcaagctcaataccatgttaggaccttgtttgtaatatgaaggaagcattatattcggtataacggttaataaatataattaaaactcaaccataagggacggaaagttgtcattttcttatttttggtctttgttatgcatagtggctcgatagtacggcccatttagaagacgagaagttactactacaccatccgtttatattataagtcgtttgacttttttctaatcatttttttttcaaactttgatcaagtttgtaaaaaatatactaattttttaaatacaaaataggcatattattaaaatatatcaatgttaaatttaatggaactagtttagtaatcgtagatgttgctattttttttataaattcgatggtacctaaactgactaaaaaaaatcaacgtcttataaaaaaacggacgagcgaaaaaaccggacgagcgagaaaaaaaaaccgtaaatgtctgataaaaaaaagggcgaaaaaataatccgattgcgtgtcaaaaaagcgaaaaaaaatctctatctctatctctgtctctactacttaaaaaataataaaagatgtttccatcgtctgtaaaaaatagctaaaaaaaataaaaaaaggtctgactcctatccgattccctctcagaaacagaaaaaaagtccgactatagatccgattcttaatctataccgtgatatcttacacatcttggtgaaacaaaatgatgagcaagattaaagatctgtttaataaaacagaa

SEQ ID NO: 66657 - DNA, 1128 bp, Oryza sativa
tgtaaaaaatagataaatttcgataacatacgtgtgtcgtggatatggattttcataccttgatgggatctccacccgttacttgtatgtcacctaaatatttatcaaaaaattgaaaaacattgataacatatgttaatatgaaatatatcagtgcacaaacatacaataccaaatttgacttctacaagttaaagcaaaaaaaaaaaggtttaaccaaaaatagttatcatacattcgcagctatatttgttatttttcttacatcttacagaaattgaattgtaatatatttaatattaatctatcttgtcaatttattttaaatctgtaatgactatttaaatagcatttacggaactagaggatatcacctatcctcttgaagaataaatacactttcccgtgtgttgttggtatatttctgctcgcagaatgcaaaccacatccgatgctaacaaccaatcacggcctaacaaactagtagtgcggagtacgtgccaacattttgatatggcatagtctcagccagcaagcaaaaaatctgcgcttgtctcctttttctcgttttaatgcatcacatggcagaaagtgaccgtgcgtaaatcattcataactaggagtaggctatttcaagaccttcaattgctcacagtacaacgatctagcggcggtgatacgaaagagaccaccatctatggcacatagctctctttcccaagaagaagaacatgctgcagacctgacctgcaacctgcattcaggtgcggctcgcgcgagtggtcgatgtcaaaagacgctacctagtcactgtcaggatccatcgcgatcctccatggctgcgctccatgtgcccgccaagcgcacacgacaacgatctggatgaaaataataatcgctctcgaaacggcacagtgtacgagcggaaaaccgatcgagagctcccccatgctctgaccgctcgcatgttccgctcccccgttctgtctccctttccctcccccctgctaataatctcggcgtcgatggatcgatcgggtggtctgtgcgtttcacagtccgtgtagcccgcttcggccaccaccaccattaccaaccaaccaaccaaacaaccgagcgagcgatcgt

SEQ ID NO: 66658 - DNA, 2863 bp, Oryza sativa
ggcaaaaaaaaccgtagatctgaacgaaaaaaaatacgattcctataaaaggtaaaaaaaagtgaaaaaaatgctagattcgattcctttaaaaacaggaaaaaaagtcggattcctataaaggcgaaaaaaaacagaaaaaaaatcttaaaaagtttgtccaattccctaagaaagtggcgaaaaaaatggtttgtaaaaaatagaacgcttgttcgtataaaataaaaaatacacacatgaaaaaaaaaatagaaagggcgaaatttctaatcaatatatatctctactctatctctaatataatctaactatttttaaaaaaaatgcacgagagaataaaaacggttcaaacaaacgcgtgagaaaaaagtcagaaaaaagcaaaaaaaacacgctaaaaaggttttccatcttccataaaaaaaataaaaaaacgcgcgagaaaaattatttccatcgtcggtaacttttttaaaaaataaaacatgcgaggaaaaaactgtcagaaaaaacgcgccattttaaccaatggttttaaaaaaaccgcacaagaaaaaaacaccgtctattaaaaaaatcgctctgagtcggataggatccatcgattttttgccatctactacacggcttttatttcgtctatattctcttgtttttaaaaaaagcaacaaaaataacatttgaaaaaaaacaagcaaaaaaacacgcgagaaaataattggcaaaaaaaggcaaaaaacacacgagaaaagaaaagcaaaaaatggagaaaaatatggttttcgttataaagaaaaaagcaaaaagatcttgttagaaaaaaaaacttttagaaagaaatgcgtcatttctgaatggtttgagaaaatcgcacaagaaaaaaaacaccgtttgtataaaaacaagccgctcattaaaatacaaactcattaaaatacaaacattgccattgacataattattcatgaaaaacgtatattatcattagaattttttcacccgttgcaacgcacttgcatttttgctagtaacatataaaacgagggagtacctctcgcggtaagtactttttgtataacggcctttccggctgttgcaaaaaagggcggctttttttctgaaaaaaaaacctactcaaaagctgctcttagaaaaaaactgatccagccgtcaaaccggcaatcactcaatagattagcactcagagcaatctctcattatccaccattatttatgtagtttcaactgaacattcacacaagttcgaaaaagacatctggaatttacactggcatatatgatgcgtcacaacacaagcaggtacatttcccttttacagagtagctcctactaattcacatcagtaaaataaacacaccccaggggcatgctgttatttatttcttgactcctttcccactgtacagaaaaaaactttaaaagagtacttagctactagtatctgcgaatcaacatatcagaagcattcaaacagaacaccagcaccggatcgtgtgattgatcatcagtttcactgtcacccagcggatcaggttgggcgagcttccccgcccttctgcaatcagccgcgaaaaaacacaagcagaccgtgtggatcagttcatcattcattcataacccagaaattaaccaaatactcctaagttggaggagatcaagaccggctaattggtttgtttttaatttcaccttatcccctttggcggcggccgccctcttcgctgcatcggccttgtccttgtccgccttcctcctctccttctccagcttctccctctccatcttctgctccaccaaatcatgatcaaattcgacattcaaacgtcgtcagtcacaaacagcagtagcgatcaatgatcaggtgaccaccaacctgtatgtagacgctctcggcggcgcgctcctcctcgctgagcaccctgccggtgccgtcgctgaagtagcgcgccacgcgccggcctccctccatcctcctcgccaaaactgccgccgcccacgcgggttgatgaggcgccaccaccctcgccacggccgttcttgtagccatcttcttcttgctccccaagaacgtcttcttcttcctcttcttgctccccaagagtagagtacgacgacgacgcgtggatgatgactcgcgaatcgcgatccctctcgggagcttgccgacctcgacgtgggggcggggcgcccacctatttctagttaggtttttcactttgtcagtgtccgtcggatgctctcatcctgaccattttgcggcgcgaaaccgaagataaggatgggaatatgggattgagatgagaacgccggaactaaccggataaaagaaagaaagccaagtggtttggaaagcaactcgagtagtctgggcctaaaccatcctagtttgggcctcccggctcccggcccggccaaacccgatccatcggaagcacgcgaggcgaagtgattcgtgcagcgggttccaccaaccgcgcggcggatcggacggtggtgcgcgcctctcagccgccgagtccacggcgaccaccgcctcaccaacccacgcaaccaatgccatgtgaataacagaataagtgcgagtaagtgagccctgcggcgccgactcctttttttacgctcctctgccatttccaccctcttggagttggaggggagcacgcgccgaagcgacagcgcgaggtcgagcaggtgaagcgagtggggagggagggagatggcggggggcgggggcgcggggagtaaggtgtcggtcgccgccgtgcagttcgcctgcaccgacgtcgagtccgagaacgtcgacaccgcggagaggtatgttgtccggtatccctaaccc

SEQ ID NO: 66659 - DNA, 1095 bp, Oryza sativa
aggaacgaaactccagagtttttgactctgcggtctcttcggtctcaggggttctagagtcatcctctcagaaggccatctatggtcgttagctggcgacctggcattgctacttttggggttttcttgggagggtagtgtgactctgccttcttcccgctatttggagttgtgtttagctgttgtagtagtctcttcctttttctcggtttttgtttttattttttctctcttttcttgacataagtcggtctgactgattatggtgtgtatcaaacactcttttcttttaaatatattgacgtgcaatctcttggtgtgttcggagaaaaaaaaactccatgcaaaatgcagccttgcatgcggttgctggctgtcttgctaaacccaaagtgccgagtgcccacttcacttgcacggtttgacctcattttgccccgtttttaggactaaccgtgaaggcaaagctgaatagcctgccaccattacgccaccacatactctcaccagttgctgataaaatgtctttaggactaatcgtgcatgtagtacactttccggctttccgctccctgccgcctatctcggattctcggtgtgcatgccactggtgagtatacggattactataaggaatgaacacccattagctgcggaattctgtgtcaagggaccgattgccactagctatattttgactgacaaaattctaggagtactgacaatgtcggttggaaagcaaagaggcaatggctagagatccgaccgacaagtccgcaactagtggagagggtcagatatagatagaggaggaacgtggctaagagtagcactgcatactattaggaccctgtcaccattgccatcaccgcgaccaggagatgtcatcgaccaagtcactgccttttgccgccgaacttgttgggtagagctgccctcaacatggctggatttgaggtgaagaaggatggcggcagccaggactagacaggggagtagcccgttgatctaaaccaccttcgatccaccttgcataggtcttggtgacgtcagttggaaaggggaaagtcgtggggcttgcttcgatccacaata

SEQ ID NO: 66660 - DNA, 6363 bp, Oryza sativa
tggattagacagctatagatacccatgtagacataccattgaagtagtttactattaatctagtctattgctgagatgtacatgttttatagagagcaccttactttactattgcgggtgctctaaacatgcatttaatccacaatgtaaacacataaatgtatgtgtgaaagagaagcgggtagatgaaatatttagtttagcacaatattgtcatgatgtaatttttaaaattagcacaatttttttgatataaaatttaaaacatgtagttttgggataaaattaacagtagctccatagtttgcatatactaacttaacttaaataagtagttgtgtgatgatgttctcaaaatatgtttagttttatgaaatttagtgtgattacattatgttgaccatttctctaaaaaatgtgaccatttttcacagaagttaatatgatttttacatacttattaaccaagatttgcccattttaattaagaacctgtagccggttctcaatcttgatgttaattaatttattttttacgctttctattgtcagccactcagccttaatcttttgtattgttaatacgtagtagaactatatatataaagatcttgctttgaagattattctattgttattcaacttataaccatagacgtaaaatacgtttcatacaggctgtggagtggcgtaacaaacctcattcactcgaagaatttggtgtgaaaaggaccgttcaaggagtacctcgatattcacaagatcacagcatttactagctagagcaatagcaactagcaagccgtcacgagtaccctctcgtctcgtaggcgtaaaaccccgtctacctcgcgatttcgtgacagaatttacctctcgatcgtactctaagcttctttgaaaactcccaaaaatcaaaaccgcacatgtacgtgccatctgcaaaatttcgaatgacgttcaagcaaggcgcagcacacacgcccgacctgccacggcggcgccaggcgtgtactaatcttaatctcatatgtctgcacccgttttttccccctattcttttagcgcccgtcacggcacggatcgattgattggagaaacgtgcagcgccgagggcgaggggtgcgtggtcagtggcgtcccgttgatgcaggcatgcagggtgcacgcgaggccgtcaatctggccggccagcgcgtttcgaccgccgtcctcatctgcaggaactaagggtgtgttttccatgaaaaaagttaaaagtttgaagaagctgagagtttaaaaaagaaagttggaagtttatgtgtgtaggaaagcttttatgtgttatgatgtgatggaaagttggaaataagggagaaactaaacacggcctaaaagtaagacgtttttcatactaataaatgacgtgttttttataaaaattttctataacaaaattgcttaaaaaaacatattgatctattttttaaaattttggtctaatacttaattaatctcgctttaattgcttgcttcgttttctatgttaggagataagaggttgggaaatttttctcccaaatacagcttaggctatgttctttcacatatgttcccaactcccctcactcgttttccgcagatacgctttttaaactgctaaatggtacgcgttttgtaaaaagtttatataggaaagttgttttaaaaaaatcatattaatctatcttaaaagttttttttagctaatatctaattaatcatgtgataatatatcgctccgttttccttgtggagcccaacccctccaaaagaatacagtcatcgtgattgattattgtatcatgaggatttggctatcaaattttaaagcctcattacacatttcgtaccagggcggcagggcctctaattcttagctgcaaccctgatctactgtttgctcggccgcgcgttggcatgtctaacgcgttttcggtctgatgctgcctcggcacatgcccttcgccgttcccgtttaacatcagtgactagtggatcgcactgttcatagcaaaacattgtaccaaaggttatttatgttattgttgtagcaccagatctcgataacaaaaatagatagataagattatgtctaatgttttaagtgtagtcacagttgtaattgcacctcatctgaatccgtgatcagtatatgtaaccagattaatgtcttcaaaataaactagcatggtggtccgctcagattgcacgggtagcttcattatattttctctcatataatagcatatatgttttcttattatattattaaaatatattacaatgataatataattttaaattttacaataactttacgaaactactaatgtgtaatattcatattgtattttatatacgtgttagttattaattatttttaatatcaaattttagttatttgtaaattatatacattcttatatggactctagactcatcttttaatatttatttttttaatgctgaatttttattatttctaattgtatttctacgtggactctaaactcatctttcaatactctttaatttttaatttcaaattttagttacttctaaattgtattcctatattgactttaaactcttttttttcatgtttttcttaattttttattttagttatttgtaaattgtatttttatacggactctaaacactacttttcattttattatatttattccgaattttagttagttttaaattcctatatggactctatactctacttctaatattccttatttttaattccgaatttcaattattttctaattgtatttctatatggactctatactctacttttaatatttcttatttttaattccgaattttagttatttcctaattgtatttctatatggactctatactctacttctaatattccttattttttaattccgaatttcaactatttctaaattgtatttctatatggactctagtctcctcttctaatatttcttattttttaattctgaatttcaactatttctaaattgtatttctatatggactctagtctcctcttctaatattccttacttttttaattttgaattttaactatttctaaattgtatttctatggattctgccttttctttttctccgattaatgtgacaatttctagacaataagaacgaacgtggaggctcctttttctattcctttaataatataatagattaagaaatacctaattcggactgcaaatattaattttgcgcttacggtaaagagggtacggcttccagataaaagccttgtactgtagtagtacgtcgcaactgatttgatgctcgtgggtcgtggcagttttttcgacagctaatgacattatttgcttgaaccactctacgtacttatccgtatattctcaaaatacatatattctacttacgagtagcataatagtatatcgtacagccctagagtcggttagccacaggtagccaacacacacagtgttatgtgctaattttagcgaagaaactactactactacctgtaaattatatatctgggatccacactgggcagaccaaaccaaaaaatgtgacacaattcgtcagagactcatgacctaacaggtgcaaacgtggaccgaaactgtgttccttcttctgtcttcacctgcatgacaaagctggcacacccttctgaccttcctgcagcaactccaagggcaatggtaagctgacggctgctgatatgtgcaggagctcatgtgcgtgatccgttctctgctacggtcgttgggcatatcgtttcgctcacctgcagggaatctttaaccatataatgcacgcgatcgaacccgttttaatttagttctcgctggcttcgcgatgatgatggtgacgatgctatgatcgatcgaccccgtcgtcgttttcgccggtcgcgcatgccgtggcgtttcccccggatagcatcggtcgcccggccgctcgctccggttgtcgtcgtcgtcgtcgtcatctcctcatatacggactcgatctgcgtgcgtttgccgataaaaccacctgctcgtggtgtgtatgcgcaggagcggagctagagcgaaatggagggtggtgccacttgtttaatttaccctactttagatcgagtttaagctcatacgggtgtctaagtttatattaaggcggatgtatacatagtgaaaatagataagatatagctaaaaaaaatttgaccggatttttaggcacccctaatatataccagctccgcccctgtgtatgcgaacgcggatgtgttgatcccgtgtgccgtcgcgttgctctcgatcgatctcgtccacggtcaagctcgattgggggcagtggtgtcatggcatcacgtgtacgtacggtttttcagtcgcggcacggagctgaagccgtcgggagcgttgcgtgcgtcggccggtcagcagccggatatatatggtgcatggcggcgacggtggcgaccgcctaaccaatcagccgcgcctattagcttatacgaccgggctcgtatacatggtcaggttcgttccaaatatataactacgggttcgatcagctggctatcaaattttaccagataatcaactgacgataaaacaacaaacttgagtttgaacttacaacgttctggctgtttgaacttatcgccggttctttcgagccttatttatggctcggtcgttgttactggaggccgcgacatgcgcgcgaaggatctcgaagtcgcacgaggcgcgaatggtgccgatcatcgtagcgtggcgcgccgcagagcacgcaaaccgcgtgagtcatatgtacgtgtgcgctgccgtgtcccgcgcgcgcgacgatttcgccgcattccgcaccgtgcgcgccgccgatcgatccagcgcgcgagaggcgtcgacgttgcgtgtccctgcgccgcgcgatcgcgaggtacgaagcagtaacaaaaactacagtaacaaccaaaagctagcaaagcttgtgacaaggtttcggagtaaacgttccaaagacaccgaccggcaccgccggccggacgatgtaccggacagatggctggcgagcccgcgagcggttgttagagtcaaaacctacgacttgaacacatgaacagaaacaggatttggttaagtctgaaacccaatccaaaacctcgtcgttttcctttttctttctttctgtttttttttccagtttttcaaacgctgaacggcatttcgcgaaacacgattggcagtttggcaccactcctccgcgcggagagtcaaatataacaattaacaaaccggtcgctctgacagctacagagatacggtacagggacaacgcattgacaatttgggctggagcccaagatcataattccatcttattaatatgcgttcagttctataatgagaagagagaaaaaaaggttagtactggtcgcatcaccacgtactatgtacgggccggggactacggagagagtagcatcatcgtgatcatcatcaggtcgtcacctacggaatcaatggcatctccatctctcgggcacctttctgttgggttcgccgtcgtcgtaccggccgtccgtccacataactacccctgacgtgtgccgatatatgctcgatccgtcgatcgatcagcgtgccgtcgcgtgtcgcgtgaatgaacgatatacccacgtgatgtaagggcgtaaccgtcgatagattcgttcttgcgctcgacgccctctagctaaaaattaagccaggagtatacagtcgtttctcgctgagattaaaggcttgtcacacgtgtaaccaggttggcgcacacgtggcgtcatgactcatgactacacatggctcgggttatttggtcgtgtgtgacggtgacagtgttataggtgttgcacgaaggaagatgggagagaacgtgatagaaaaccacgtaacgtacgcatatatatacgtacgcacgggacaagacaagacctaccgctacttaaaaaaaaaagatttttgcaaacaaccaaaacaaattttcccaggcaaccgcccacccagtatatagtataaaggcctaaaaaatacatgatttttctagattggcctcctagctccatcttcacaagcgctacaaccacatgcttgcaaaaatattcttagtaaaaaaaaattcccccgccacccccaatcccccggttcaaacccctcgctaccataagccaattacaaatcacaaattcttcgtccattcagaaaatccaatcactaacatgcaaacatccatacatcatattcaaatacatagcaccgacttgcagtcaaacatcgatcaaacatggaaacaacaaacaaa

SEQ ID NO: 66661 - DNA, 2478 bp, Oryza sativa
tttgagcggttctcgttaactgagtcacaagtgacctatattaattcccgcaaaaagaaagtaacctacgcaattgagttcattttcgccatgagatggctacactgtcaacaaatttatagcccgagcatactagaagataaaaaaaaagaaggaaaaagatagctagagcagtacctcaatcccttcctggattgcacaaactgttaagattgaatctgaagctatctttctcttctacttggtcgcaaagctgtgacccttatgccagttagtgtttctgattttgcagaagccgttgccgttcttttcacattctactttattcttttctcatggagatatctgagactgttccctttgttcattcaattattgaggcaccttccttcacattgtgattgtgttgtgtaccttttggttctgtgacgctgataagaataatgcctcttttttttttttaactttgtcacatctattgctatcattaaaccaaatagaatggcaataagttatacctctctagttaatagcttatactaaccacaaatctgagttataaacttttagttacatcattattgtagttgtaactctgacttctgactacaccgtgaaaactgaagcatgtttttcgacataactttcaataaattaactatatcaatgtacaccgagtcaactttccttttcatagcaacagagaagttcaatgccatttggaatttattttgtggcactcttgtggttaaaggctttatatttcaatattgaccaacttgataggctgcgatgtcttattttcttgatgataaatgtgaagaaaagaaacccaaaattgtttggcctgatcatcttactctctctctctcgcccccctacgtttctttcttataccttgagttagtaaataccaaacaaaccagagattttgctgaggagatctactgaaagtaaactcattcagggctttattattcatattgcaggttgataagagaagctcataagaaaggagcaaacattgtccttgttcaggtatatttatatgatacatatatgtgtgttcagtgatgttgacaagctgcaacttgcaatgcttgttttgaaaattgaaccagaaagagcaaatgggtttggatgaatattcttatttgcaatttcgtttaaattgttatgttttgtttgattcagttcagggcctaaaaagattaatggaatgatgattatgtgcactgaatctatatgtcaatgctttaggaactgtttgaggggcagtacttctgtcaagctcaaaggttggacttctttcaacgtgctaagccttataaagggaacccaactataatcaggtaggcttgcctcattacttgattcttgtcaggagtccacaagcaatgtatatgttctatttctgtagttatccctatgcttcattctttcttgttcgataggtttcaaaaacttgcaaaggagctggaagttgtaatacctgtcagcttttttgaggaggcgaacaatgcacattacaattcagtagccattattgatgctgatggcactgatcttggcctgtaccgcaaatcacatattccagatggaccaggtattgcccatgtatagtttatgacagattcactatagactagtcatggactatctgatttaaacaagttagctatttcctttttggctaggttatcaagagaaattttatttcaatcctggtgacaccggcttcaaggtaaacatggttttatatttatatcttgataggtttgcacttgttagtagtaaaaattcactaggtgttaatgtgtaattggtactatgcaggctttcaaaacgaagtatgctacaattggtgttggtaagttatttatgttgttcagtgatattaatgtttggttctgaaagagcatgagcagggtagtaactaatgcaatatcacctgactatcttttatcgctaaaccattatcctggtaggaatttgttgggatcagtggttcccagagtgtgcaagggccatggtgcttcagggggctgaaattttgttctatccaactgcaattggttctgagccccaggataataacctagattcccgagaacactggaagcgcgtcatgcaaggacatgctggtgctaacctggtactgctatttgttttgttataccttatgttttatcagctactcagctttattgagaaatcaaatatatacctatttttatttacgatccttcggtagtttctgatcattctggatccataccaatcatgcaggttccccttgttgcttctaacaggataggaagggaaaccgttgagactgagcatggtgaaagcactataacattcttcgggaattcattcatagcaggtaatttcagcatcttgttcttttactgctggatgtgtaacaaactaaaatcattagcatatggttgtgcagggccaaccggtgaaattgtg

SEQ ID NO: 66662 - DNA, 1076 bp, Oryza sativa
tgcctgcaggtcgactctagaggatcccccgctcccccgttctgtctcccttcccctcccccctgctaataatctcggcgtcgatggatcgatcggttggtctgtgcgtttcacagtccgtgtagccgcctccggccaccaccaccatcaccaaccaaccaaccaaacaaccgagcgagcgatcgtgcaggcggcgtagcgtgaggtgaggtgagcagcgcgcgcgcgcgcgcgcgcgttccccaccgtgtcagtcgcgggcgcatgtggagagattctccggtgacgggagggtgaaagactgaaagcaacgggcgcacatggcggtggtgctgtgcatgcatgcgacgcgcgcgcgaccccgcccgcggccacggttcggctgattttgttgggtattcgcccctattcgaccgaggggtggtcaaaactcaaaaccccgcgaacatgttaattggcagcatcgaaatttctaatctgtcctgtccttccatacatctaccctggattcggatcaggccactttggcagtacccaatcatccagccatccagcacacgagagatggcccagatttaaccgtgtcatacatcattttagctatttgaacaagcatagaacagtttcagttcagattttgcctgcaatttctctccctttgatctgaattttcttgaactttaagacaacccaaatattgttaaagaaaagtagacacatacttcatttcattatattgaacttcataatatcttgcacgcataattgacaaaatgagctagagtttaagcccttgtttagtttccaaaatattttttccaaaaacgtcacatcgaatctttggaaacatgtatgacgtattaaatatagataaataaaaaaaagtaattgcacagtttacatagaaattgcgagacgaatcttttgagcttatctttgatcttatttttctattataatatataaaataaataaatgtatatttacttttattatggtgttttgaaagacaaatttatatatgttgtcctttaaactaaatatttttaaaattattgggggatcctctagagtcg

SEQ ID NO: 66663 - DNA, 9440 bp, Oryza sativa
atatgggaactaaatgacaataagaaaggtttgaaggagcacaaaatatcatatttacccgataatagaagtaatcgtacagacgtaaaagatggtacttgtcagcagggtcatgcttgttgacatacttcaggagcttgatttcatcaaggctctggtcaaaaaaatctttgttgttttttatgattttaacacacacatccattcctgtgtgtaaatcatgtgcttgtatagctttactgaatgctgctgaacccagatattctgtgacatggtaacgtccagcaatgacagagttgagaacaacatggaaatttttgtcttcttcaaaaccagttctgttatattgtcagcaggatataatggagttaaaaaatatcgttagagataaacaaattaacaaacgcaaacaccaagcatgataccaagtatcattttaatacaaatgaactaataaagaaatgccaagtaattaaggaccagaaaaagagcacctgttttttctatgcacaatctttagattaaaagtttcaaattcttcttcctgggcctttatctgccttacttgctcttgcaatgctgctgcttcctcatcatccaatgtggttccagtgtcctcttcttgagcgtcgtctagcttgtgatgccgagaattcattgtgtcatctatttcatcataagtattattcaaagcagatgatgcacttgaatttcttgacctaacaacatcagaagccatttcatctcgagagctccttagggaagactcactattctttttcctccatgtggcaagcatatcatctgataccatgccgttttgcaagtcatcaggatcattgatggtatacatatcaaccttctttgaccataacggtttaacatcagattcaacattttttccactatgcaatggtggaggaaaggagaatccaccgtcagcatatgatgcacctggtggtaaaacgcccttctgattatcaataaaattcaattgttcctgttttgcccctttcgcatttattcttttcttttctgtttcctgctgagaatttctttttccactaacactcagattactttcattaaagtattcaatatctccttcgctgcttcctccaatcagactttcacgcacctcactgccaatatcagcagcatcactgctaatgccaacaccaattgacctaactgaaccatgctgatcatcctccacaaatgggtcatcaggatgaggacgttcagaatcattaaggaattttccatttcctaacatgcctaattcactattctgtgaaacgaaaccctgccagactggttctgaatgcatcaaatttagttcttctgggtccaaaagctggccatcatactgagcaatcaaatcattatcaggaattccatgccccattggcccctccgaagtacctatttgtgcaatgttcttcccgtgaaaatattgttcgccagatatgtaagaatcctcctcaacaaatgattggtcatcatcatcatcctttgtgggacgatcatgccgatcaggcccacttgtgtgaccagttgccttctcattgtcactaggatagtcaatttcatgtgctaaaaaccaggtttcatcctcaattggttgccgggtgtacccaacatcgtcatcatcatcgtattcatcagaatcccagtattcatttggatattcaagtgaatcatcaccaattgttgcaaagcccgataccaagtcagaagtatcctctgcaataccttgactgacagagaaccagttattactaattgtgcgtcttccacctgaatttgtaaacatatagttcaaggtcaaaaacttatgtagcatcaaacatcagagaggctaagaatcatggaaaacaatctgatataatttcactatttaaaagtttgcatgtctgtattataaaaagacaaaattatcaactgagagttagaaaaaatcccataaaacattaaaaagcacatcaattagaaaaggcataagccaacgtcaaatattcctttaggaaagcaaggtcaaaaacacaaacaaaacactgtgacattatgctaaatgtttcacagtacacaaggaagaacacatcctggaatctactcagtgtccgtgaaacttcagtaatgaaaaatcccatattttgctcacatgaaaatggcctcgcaatgcctacttcagtgcccgatagaagtcatctaattatgtatcattcaaatgaaaagtaatacatgcgcttctgcaactacagctacttgagtagaaataacaaactcatgataccaatgcacccatgattttgaaaggtgagaaaatatgctcgctttttttcttgatgcaaaacctgcaacagaaggaatccataatgcggactgctcgactgttgtcgctatcacctaatacatatgatgcagattacatgtagatttagcccatttcaagttttgtcctacagaacatatgtcaaaattctggtctagaaaacaaccaggtgaccaggtctaggagagttaccaacatgaaatacagcttatagaaaatcgaattactaaaatacaatggtgttagaacaattatttacctaggcaacagaacatacaacatttacaagtatattgaaattccaaagagatactcaagtcatgagacatttccaattcgtagattttttttggaatttacgcagagaaaaagaacaattcaactaggtctaaagccattgtattgttccattttacacaacagaaggagaaaaaaaaatcatattcaacacactatagctgtatagcaggagtcagtaccgctactgttttttcttgcttcattcatgcatccatagttcaattcactaataatatgtcagtttcatggggcgggtgcacaagtatgcggtaggttttacagataatttgatgtaagatgagcatgtaaattcaaagcagactactgtggagcaatgtaccatgttgcttaaggggaaggtagaatatatttcatccaccttgtgttctaagtaaaatattgtgtttccatgtgaccactaaaaatgttatcatacctgatggtgttatttcttgtccgatgggaacatcaagataagacccaatcataaaagcatggtcagcactggggtgcttggctcctgacccgttatggttgaccttttcctcccaattcatattaactagcttgtcctcagacttgagcctcacaggaggtaactttggaagctcctcacgttgattgtctccaataagctgcagatcgaagcaacggtcagcaacctgatctgcgttctcctgggacttccctgagtaatactgcctgttcccctcatcaagctgccccttagttgcttttccaacacagtccgcatcaatgcttttcttagcgtctttcctctcatttccatcatggtgtgctgtatggtaactggatgatggattttctgcagggaatggaagcactgtcttaactgtacatccattcaagagctcctctttttctggaacaagatttttatccctggaatggcctggttcatttatttcatttctccctgtccctgcaacatccactttcccctttcctcttccaaaagaaaccttttgctcaagcacaggaccaggttgctcggtcccaacaccacgatctctcttctcagctacaacggcgccgcgccgatgtcttggcacctcctccgacaccaatagctctgccagttgctccatagtgctgtttgcaatgctaaaattccaaggatacagatcccctgtattgttctcctgagccaggccaatccccaaccctttcctcccatcagacccattcggcaggcctccaacatcaatctccttcacgataaactccctcgacgagtccgcgctcctcaccgatgcagcacctctaggccctgcattggaacctgcctcggagccatcttgctcatcgtcctccttgggctccgctacacgcctctgcaccgtcggcccgttgctcgcatcccctcggccatttagctcccctcggagcgcggcctcggccttggcgaagcggttcttctgcaggaactccagcaccagatcgatgttctccgccatggttccctccaataccagctaacccagaggccgaaccccaccgaaatgcttacccaaaaccgccagacgagctaaaaggtggcaaaccccagccacggggtcaaccgaatcgaagcttcagcaacctccccccaactcaggaggccctcccaatgccgcgccgcagccagccacagatcggcggcgcgcgcgcgcgcgtatccccgcgaatcgagccccgcagctcctccgaagcaccacaggaagaaccaacccaacccccttagccgagacggcggcggcccggggaggccgagcaggcacgggcccgacaaccctcaccacccgaatcgcggaaaccctagccgcgcgtccccccaaccccacgccggggaacccagggggggtgagggtgggaagggagggaggccgcggaggggatgaggaacgggggcgcgcgtggggcgaggtcagcgggaggtggggcggggcagatcgagagcggggcgcggccgagcggatccggcggcggcggcgagggggcggcggcggaggcggaggcggaggcggggaagcatttggaggcgcggggtgcgggggatcagggcgcggccggcgtggctgggggcagcatattcgcgcagctgtggtgggggcgtcgcgtcgcggcggtggtggtggtgtggtaaaacaaacggaaagggttgagccccaaaagaaaaaaaaagtaaagtaaatggttttttattacaatctgggatttttccttttctttctttttttttttctcacactatcgtttgggctcgtttggtgtttagcgctcgggcgtcgtggggagtgggggatggatcgacagtcagataagctagggtacgttgcaattggttggggcgttcaaaatttttttggacccggtggccgtggctgaattgggtgcgggggagcgacaacggtccatgaacccccatgcggcgcggctggccaggggagtgtgctggtgctggatggattgttgtttatccgctaataaaaacattgttataatcatatagtatggttttagtttttggttcatggataaggttttttttggttttatactgttttttttctttcacaacctcaattggactgatgggtagggcatagttatcgtaacatgtctattcctacagcattctcttatgtatacaagtttttctttcgaatgtattttagctgttagtatactttagtatatacccctccgtccctaaaaaagccaacctaggactttgatgggacatgatttggacaggcagtcagtcctaggttggctttttttttttacggagggagtaagttataggctcatatacatacaataagatagtgcaaatattactttcggctctataacaactaagatgtaaaagctaagcctctaccgcaactaagatataaaagccatgttataggtttgtatcaaactttattgaagtggtagtttcattgatacacgccatcatgtcttaaaaaccattagttcttttttttggaaaaaaaaggaaatatgagttgcccatgccttacccatccatttctatggtgaattcacataaatgattatgacatgtatagtaggatatagttcgctagaatgtgcatctcctgtcacctaatttatgtggtatggtgggggaatcaacattccatcgaccttagcaagcttataaaaaattctttactatttcatgttaatagaataagaggtttgttttagccggggtttcaaattttgaaactagggtttctgcccggggggaggcgaaagaaccgaaatttccgaatttttagaaattttggatttttttcatacgtcattttttgaaattttgactgattttgaatggatttgaataaaattttaccaaattcgcaaaaaattgtaaaaaactgaaagtttcggggcgagatatgagcatttcgggagggcggcgaaatttcatgccctggtttcagcacgtagtgctaacatcagtgataggcatttcaatttagagaaaatacaacaaatactactgataatggctctattccaaaaaatatcatcgcaccaacaaacttatcttagaaatgccatcatcatcagggttccatccatttcaccatgtgtttccatgtaagaatgtgatagggttaacgtagaaaaatagatggaaacccgacaacaatggtatttcttggacaaactagctcgtacgatggcattacaaagtgaatgaggcctaagatgcactcacgggcaccttgcttattagagttgtgtttgagaggagatgaatcatcaacacatggttaattgagtatgaattatttttaattttaataatggattaatatgtttttaaaacattttttctataaattttttaaagacacctttttttttccttcaaatgcaccctaatagtttaaacactcgatcatccgtgagtactgcatagcaccgggccgggccgcctggcactcctgcatgaacaggcgcgggctaagaaaagccctggccctcctcgggcccaaaacgagaggggcgtggcgcgcttggcgcgaggagaggggtgtggtggtgcggtttggccaaggaaggagcatcggacgcgccgcctctgccttttccttttcacatttccccctccttccctcctgccctgcctcctcggccggcgcggcgccccatgtacgtggctcgaccgacggcgatcgccggccctacccctaccgcccgcggcgcacgtcgccttccggctccgggattgttaattaccgtttcgagtgagacacttttgccccgcgtcgcgtcgcgattctgcagggattcatctgtcctgatcatctatccattcatctgttcccttacctaatttctctgcacagatccagcagtttgacagcaaagagaaacagagggatcatcgaggaaaaaaaaaagggctgggctacaagcacatccagatccaggctggagtaggaggcagctgagcgagtgttgttccagtggtgcctgccaacggaggtggctggctcatgaacattcacccgtacaaccagacaaccgtcagcaagtgcagaaaagagggacaccaaatttcaatttcaggtacatctgctattctgctttgggtcctgtttgtaaagtttaatattctgagaaacagctggagagaagatagggaagctgaaaaacccagtttctagcttgtttctagcttttaattcattttttggattctgcagctacagtttctctcaaactaagtgaaaattagaactgttttttttgggaggggtggggggagagcttttggcagtagcttcttctagaagaatcttcagctgccagaagctcccacaaccaggcccttacttcctagttgcactaggcctgtaaaggtcccatttgagttacaggccccatttgagttcactgaagattagcgcataattaataaaattttaattattttaacttaaaagcaatctctatatagatttttttttgtgcaaaaaacacgacgtttagcaggtttagaaaacgtgctaacgaaaaccaatgtgaaatccgtaccttaatcaagaacaggccctaagtaagaaaagctttattagattctacttttcgaactagtgagtaaagtcaaaccatattttattcatgtagtagtaacttgaatgctctcagcatcaagatacagcatattacagattggtgttttcacttccaatcttaatgagttcaggcgagcaacagcacgcatttgcaacttagaagattacacatactgacattagcatggtgaagaagacgacagtacataaccaaatgtgccatacgaccatttatctgtaaagtcaaccatttatctgcagccagtgaatcttcagtctgcaagtacgtccaatcctaagcacaagccaccgtcgtggctatacgaacgaactgcagaaaacacaactctttagcaaaagtatcacactggtactttgaaaaagtggaagttgttcgcaagagaaataaatatatgaaatcaattgtttgtagttttatctctaaaatggacagcaatttagataaatcatatttgctagtcatctgtaccaagtgacaaagtgtacagattaagaggatgtcataagccaatgtatttcagaaatggtagaaaaatatgtttgtagctaaaaaaaatcagaatggaagaagcgaagcctacaggacatggtggttctataggcactcttgtagccgcttaaatagagcacgagtcaggaaaagacgcagtttcagcagtggactcgggttaactttagtccctatatttagacactaatttagagtattaaatatagactacttacaaaactaattacataaatgaaagctaattcacgagacaaattttttaagcctaattaatccataattagagaatgtttactgtagcatcacataggctaatcatggattaattaggctcaatagattcgtctcgcgaattagtccaagattatggatgggttttattaatagtctacgtttaatatttataattagtgtccaaacatccgatgtgatagggacttgaaagttttagtcccatctaaacagggtctcaagcaaaacaaactgagcagcctaaacagtcaattaagtaatttcacataccatttcatgattattttgctggagcagaagcaagttcgacgctgaggatgaaggttgacatgccagcttccctcatatgtcggacatcgccattcatgagcctcagcaggtttctagaaaccgaagactcatgccttcatccgactgctccttattgtcatcctcgtacatttgtgacagcagatctgctgggactcctttgccctggtgcttgatcctgaaaaacattgatccacaagagttaatacacatcattttatacttcaagactgtcttaacagaaagaagagtaagcgtgcaaatgtcatgactaacatacctaagttctaggtctatgagatgaaggttttccccaatgctgttcttggtcaggctacaagagatctcaacagaacccccaacaggagagaacttcactgagacgaataggaagtcagagagaatctgctgtagtcgaacaccatccccgtagactgtttgcttcatatatctctccggtaggttgcaagagactctaatcccttttccctggcaagttatgagtacttgacttacagcagccacaaacacatcttgcaatacaaactcaaccatctccaaatccaagcaactagacctgtgaacacagcagcaggaaattagt

SEQ ID NO: 66664 - DNA, 539 bp, Oryza sativa
gtactggttacagcaacagttttttttttaacaaggctttccagtttccacatgcgtgtgtaacttctttgtaacatccagtgtgagtgccggcgcgtctttacatacatatacatacattatacatgcacatacgtacatatacgtgtcgtgaatgggcaggatctcttagggtgtgtttgaggagaagggaattgaggagattggggagttacgcaaaatgatgtgagccattagctcatgattaattgagtattaactattttaaattttaaaaatggattaatataataaagcaattttcatataaaattttttttataaaaatgcaccgtttagtagtttaaaaatcgtgcacgcggaaaacgagaatcaatctcccctatctcccgagacgaacagagccttaatttactcatgctgctgctgctgcgtgtgctgctggtgtacttggcccaacgccgacggttgcaactgtgcgtaggagtggtgggagagaaaacggggggtcgctacggtgacccgcgcggggtaccgag

SEQ ID NO: 66665 - DNA, 1151 bp, Oryza sativa
ctttcgccgtcgcatgcctcctccccgcctccttctactgttgtagccgtggccaccatcctccccttcctgccgaatctgggagggagagggagaggaaggggagggaagggccgctccgccaacctcttccgtagccgcaattgctctcgccccagtctacagttggatctgggaggtagggagggaaggggacagctacgctgccaccgtcctcctccctacaatcggatctaggagggagggaggccgctccgcagacttcccccactaatccaaagctattgccaataatcaaagtctatgctttaatgtgatctccttttgtgcactagttgaactaagcatggctaagcatctcctaaaccaacatctagtcattttaatacctaagttatcaatggcgtaagggaaacaacatatagctgagtaataggacccatcccacatgatattgtaaaacaatgcaatatttaatagaaatgcgggacatttgtaaattgggtacaatatgatcaattgcaatgtatgacctgccttgctctcgcactgatggaaccacaacaacgtcttcgagaaaccacgaatcgacgaaacgggcgaaatctacgtgacaaacaaagcacacaagcaaaacgtgctataagactactgaaacaggaaacaaaactatttttaatggattctatacatttttatgaatttacttagacttgaatggacttaatcggagctcggatgaattagttacgatttttagaagattctctgtgtttttactattaaagaaaagccttaatgtatttattgcgcaatattgccccagggatgacgtcagcagggggggaaggcgccggcatgcgggccccatgagtcagcggctcaagagagagagagagggaggggcgccggcacgtggctcgactcggcttcaaagccggcaggccaagcatggcgggcgacggcggcacgcatggtcgccggcgacggcaaccggcggcgcggacggcgacggcagacggcgcgaaaagcggcggcggcgaccgaagacgacggtgcgcgcgcggaggacggcggcgcacacgggagagagggaaagagggaggagggggagtttctcaccgaggttggccggcgcgagtggagacaac

SEQ ID NO: 66666 - DNA, 885 bp, Oryza sativa
ccctgagtatttttgagtcggtgaactgcagagatggatggtcatggtctggcatgcatataatactctctcttaatccctgaatacgatacgatctcatcagagacagtggagctcatgtgttgatttaccaaaattagttttctgtggtgcttgcagctgaaacaggtctcaagtgtcatggaagacatgcatcggaaacaattctcaaatgccatggaagagcaaaatttgctctttgcagcagtagttgttgtgttttcagaggctcagagatgcatcggtgcttaatttgtcaggccctgcttggtggaacggtggcgggaatgctctaggaactttttagcatttagctcaaattcaattagctcttactcctatttcagaacttgaactggtgctctttttcagaattttttttatagctttcatgcttgaaataatcaaatcaggtgatcaacagcagtctgactaagtgttgcaacatccattgcacgacttctgccgcttcatcctattcccagcaattttttgcaagacctgaatcctgaatttcagtatgagatctgcacctaccaagctagcaggatatatactctcctacaacaatagaaagtcaaacaagttctgaaaaacaccgtgtttattttggcttttgtcaaaacttcactccagtttactgatcacgctaaggttatagaagaaaatacattttggcaatagaaactagccttacattcgctggtattacatgtcgaacagatggatgcgcaataccagtaaataccgtttgagtcaaaattagttccttcaagagattggaaaactgtgcaatcaacacattttttaaccgaagaaggctgagaacaacatccgtccccaatc

SEQ ID NO: 66667 - DNA, 8793 bp, Oryza sativa
tgcaacattgacctccttcatctgctcttcattcagacctgtgttcttcagtgctttcctagagtaaagcatacctgagagagggttgttgattgcatgtctcatgtaggagtaagctttcaactttgttagtgcattctgctgtgaggcttgctgcacatgtagtgcatgttgcagctcatgactaggaacttgaatgaaacaaaatactccagtgatgacaccatctgcatttacttttctgttaacagaaagaaggcactcgatatacttcccgttccggtcgaagaagctgaatggagccttttctgtttcatcaccagctaatgcactgttgataagaatgcagagacttacaaatgcatctttattcttcacaagacaggaggcgttggtgctatcaaacacctcaccaagaagcatcttattgatcacctcatctctatgccacccggtcaatttcgtcatggcagcattccactcagagcaccatccaaattcgtcagcaccaaatatgggaggaataagcgggcttggattgtgaataattgctttgtagtctccctcaacccgagtaaatttgtccatgaccaacttatgaacagtcatatcttgtgcaacaaagcacacaccaacaacatggtcgtgaaggtcccggctggcacaggcattcacaaccaagataacagggccatcatctctcttggagccatgagttttcacctcaaatttcacttccttctcttctttgcctgatcaatcaaagaaatgtttagaaatcaatcaacccacaacgcagctgaatgtcaagtattaatgtatgagcatgacaatcaaatgtagcatatctaggcattgaacattagaaagcaaccccaaagtttttttgataaatcgaattgccaaataagcagaaacttgaaaaatactgggggaatagacaaaaaccactatagctaatttacccaccttgcaaagctaaatacagcatcctctggacaactggtacagaagattcctctacaacggtaagtatgtgtcttccaatagcctcatctactctcaaccctgtcaactcagcaaccttctgattccatccattgaccaatccattgctatctacagccaagattgggacagttgctgtttccatgagacgaaccatttcacttgtaactgcctgcaattcagcaagcccatcaagcttgagatcaccaacctgattatctaaactagcggcccttgttggcttgatgtcatcattcagtgtccctctaagtataagttgtaatgagtgaatagcatccatctcatagtcattccaaggcaagctcttcatcttgacaacctcaaggaatgccttgaaggacagcctagggtgcattcttctgctgtcatccttgtctgatggatcatgttttgcacctccccatctgatttcagcagctgtatgtgacctgaaccagaacaggatatccttggaatttattttagctactgccattccacaaatcatatcaccaagagcagcagctcctggatatccagcatcatgtaggctatcagtactcaggccagtggaatccctgtggacatctgacagccagaaggcaatatcacgtatctgagactcagttggagcattctgtagccgccacacttttcccccatacaaaagagcagcaccatcacatttcacaaggtccatgatgttgggagtccctgatactatactcagaggagaggattccctgagaagcatgtcagagagcattgtttgcatcctcaatatgcttttctcgcgtacttgcctctctaattcaaactccttgttaacatggacagcaaacacttgtgctaagaactcacaggcataccgcaatgggaaaggaacatatctggggctctcatggtggcaaacaaggagtccccatagtttcttcctcttctgctgttgtgcaggttgatcagccccaacttcatcatcatcctcattctcattaaccacaacagccatgacaagggatgcaatcgagttcatgttctccatatactgaagatgacaactgtgtggtgccctcagtgttgaaccacataagctaatatccaagtggagcgactcatcttcgataatcttgatagatcttgcacggcaatcacaaatcatccggactttgttcttcatgaaaagaaacctggctgcctgagggatatcagtagctggataatgcaggccaagataaggttcaagaccaggctttgtgatctcagcaaagacttcaccatggtcatcttcatggaacttataagccataactctatcatatcctgtgaggtcaaagagttccttgaccaccgtattgcatagcacctccatgcttccacctggcagtgactggatcttagagattgccttggcagcaagtttgtaagattgcaaagccccagcggcagttgctggaaattctgtaggtttcacaggctcaaagtctaccaccaaacaaccagttgcccgatgaacaatggcatagaaaggcttgcctgaggtcttgcattgaactaggatagggttcagcaaggaaacatcagcaaatcccagtgccttctgcagtgctgtggcacctgggtcagtgaaaagagaccatacattggtgccaatgcgtagctttgggggatcatcaacacttggcactgcatggctgacagttgtaagcatctctggtgcattctcgctgagcgctataacattgaaggtcttctcatcaagggccaacaagcaaccaaatggttggattagctttgctctctgaatgtgatgcaagtaagctatgaccttctcagaacgagcttgctgctcaggtccagtagttctctgtgcttcaaccaatttggagtaatcaaaggagtcgccatattcttcatattcagcattgagttcagcatcaagagttgtttgtgctaatatccttgcccgggagctttggcgggtcctgctggatgaactggaacattgagtaggtcttgaagaagacatcttctgccttgattacctgaatcactcaagagtcttatctgctgtataccactcctgctgaacaagataatataagttgaaaacatcaatcagtaaaacaaaaaagtatagcaatccactaatatcaatagatgcctcaatctagtggataaatgtggactatcaactttgatcaatgcctaaaaccacatgattagacttccttgttgcctgagcagttcagaaaagagaaatgtttttgtctttcaagagcttgagaaatataaaaagttagccctgctagaactcgatggatgaagtaagaacggttgacgaagtaaaataatacaatgttaaagatgctattgaagaacggtcaacaaatcttagagcattagaggactaaagtttctccaaatacaactgcaggcacttgtgttagcaaataagcatgacatctcctgtaaagccaaaacctttctgaggaatttccttcactaatctgtgataagatattctctactttgtatttgtcattcatctgattttcattggcattacatggccagtctttaagattttcaaaggcatgaaatgcaggaaatctagtttacattctaaaaacagtataaaaggaaagcttccacattctataaattactacgttgattggaggaacgctaaaacatatccattatacttattgtggtggatctagattatagtgtgggagattaataggatatatattagagctatttcataagaaacactgttgcatattagtttcgatacaaacatgttattagtatctaactgcataattgcttggaaattctgctagtttgatgtttagatttactctttttcagcctaatattccctctgttaacacatgtatgccactctgacatgggcatggtaaatggtaatctaatacaacttcgagtctttcaccactatacataaaactatttagattggcgctgtaaaaacagcaacaatagatctgttagggaaaaaaaattctccaaagtaatataatttttaaagggtttcatttaaaataataattgaaataagccgtcaaaggtaccttggactcacggaggctgcactttcactagtctcatggaccaaaaccccaactaaatctcatatgaaggtactatactgggccacatactgggatcagttttaggaccagttgcaaaagtgtgaggacaaggacaatatccagtttgcatggcggacttttgagacaatgatcatgcaaatcttcgccatggatggagatttagaaatatgattgattcctgattcttttaattagtccttatgtcaatgttttcatatggttttcttgtcctcttggtgtttgttactttcagccagacgtgctgcaaattttgtaatggtgggttgtaatatctgctgatgcaaagacccggatttcccattatctaaaaatctcatggaactatattttttaccaaaaagaaactacaaaccatattcagttgtagttactaataaaaaggtgaaatatcttagctgaatggaagttcacagacatcacagaagacggacttgctctaaacagctgaacttagcatgtccatgaaattagtatgatggactaatacgaatgatcagcatcaagtgcatttttatcatttggaaggttttatagaaagcataaaagagtcgcttatctaaaaaaaaactgaagccgcttattatattactgaaacaggttttataagtctttgctgtgcatacaacagtggctaaaaaaacaacttgtggcttaacttgtttgcaagtccaaatttggagcaaaaccccttaacaggacgagcaacatcgtttggagtttggactactcgctcctccaatagtaggctcttatgtagcaacattttcaattgaactcatcattttgttttctctttatcccaacatatggggattttgagttatggcttttctgacaataaaaaacaacaactaagcaaagccagattaaatcttctcaatatttctgcaacagcacacttctccaggatcagcaagttgttcctgctgctttccactacccctcacctttgttcctatcctcttcctgtaccaaggcttgggggtgagtcagtggacactgacgtggcacatggatagaagcactgaagcagtaccccctctaccaagaaccacccagtggcacccaaagtccaagaaatccaccactaaacaaatcctaaaaaaacccatctcaacagagacaagcaccgaattttatcctctttgcttgccatccatcacaaaccccaggaaaggggatttctgaatcatcaatcatcagttcatcacactcgcatacaagttcaagtttttttgttaatctcaaagatgctaagccctgatcacaaaaaatacgaactaaacaagagcaccctccagtccccaactcccaaacatctctcaccacatctcttgtcccccccaaaatcatcagagaaagagaacaccacactacagggcagcacagcccgttcctctccaagaaacgaacaagcagcagatgatgctagctaaggcagcatccaaccatacaagcgaagagcagcaaagatgggggaagaggagggatcgaccggggtacctgctcggctcagctcagctctgctccagtagtggcggagctgtggactgtgcgggaagaagaggaggaggcagacgagacaaagccaaggcagccgcactcgggtggcagtggcgagctgaataaataaatagcctagcctgtgatggtgtgggggctcagctagtcagctgtgctgtgcttaggccggggctcgcgtcgcatcgcacgcacgcaccggccccatccttcccccatcaccccgatcaccggccggcgcggatggggtcgccgtggggaggtgaggtgtcgcggatttacctcgacgccaacctggagttaattaccgccaataattaacctagggagatatatatatatatatatatatatatatatatatatatatatatatatatatatatatatatatatatatatatatatataaaatttgtgtggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataattaggtatatactcacaatttgaaaattttgaaaaatttgagtgattttgtgtatttgatatcatggtgcccgggcaccatggtgccccatatgagtgtcctatatatatatatataaataatacaaagggaaaatttagaaaacatgtaaaataaacgtagatcaactgattgagtttcttgcagtgggatctattcacctatgactaaggcaatgtttggctaatgtgatagggaaatgattttccacccaccaaaagacatatttaaatcttaatcattcattctccctctttcatttaatcctaacccttcgttcatttactaatcccaatcccactccctatttttcattatccaaacacaccctaattacttttttaagtagtagatgacgtgttcaatctcaaaatatactaataagtttgtattaggaaaaataaaattcagaaaataccattgcaagatggatacgtgaggtgtaaaataccattttacgtgataataaatgtatcaataagatgatttttttttacttcgtggattttttaacaataagaccaaataaattggccgttatatttatgaccgtgtttttattaaaggacaccaaaatttctgtatatatttacactatgaattatatgtagtgtaatataaattttaaatatttatagcctgatttttaaatcttacgaaacttcagtacttgcttatgtacttaaaatccttggaaaaattgctagtgtaacttccacacataaatagaaaagttaatgagaaagagatatgaaacatggagtacatacaagagagagttaggctgagttcggtaaacggtatctttcttcttttttaatcacgtttcctgaacaattaaatagcgtatttcatgtgattttttaaaaaataaatatattttttccaagtttataataataatcgattaattatgcactaatatgtttttttcgcatgacgtccaaaatcctagctaactcaacgggtctacctttctcagtcctagtaataatcacttaatagttcctaaaaaaatgtaatcgcgtaataaaaaaagtgacttagcaaaactgtttaacctgtcctgcttaacccaatagcctgcgtagtaaactagtactcctcccttctttaagcacaatccgtaagctgattgggacagaagaacgcatagaaaaactcccaacaaacttacaaatttagtaatagtacgcagctgtacaccagtggccatgatactctattggacgaacagctcggggttagtagagattactagattatagatcgagattagcgttagtgccatcattatcaccatcatctaattggggtttaattaagtagagcgagggagcagtggccaagagttggagttgcacttgctctttgggctttggttctttttcgacttcctttttcgttaactgcaaaagaatttcttactacttttgggtgacagtgcacccgtggccctcctaggggtttggtatttggggctttccacttgcggacatggccatgtgacccgcacgtgaacgcccatgcccccgcgtctggggctctcggatgctttcggctcgcaacggggtttggcttttcttttttttcttttccgcttttgaagactgggatcaggcacaattcatcgcgtgatctgatcctagctcctgtgggaattctgagaggaaggtcatatgaatctagtaaaaaaaaatacaatggaaactaatcttttattatgatataatttttaaataacttttgtaaaaaaaatccccagatagcatgagtatcacagaacactaggatttatggatgtttcaataaataatgcattttttaagcaattagtaatctagtatcacaaaaacatagttccattaattttcggtcacttgacaggtgaactccgtgtgttaatctcacgtgccttttcttcccctttcttagtctggtgacttggtgagagcaagtttaatactccgtttcgaaatgtttgacgccgttgactttttagcacatgtttgaccgttcgtcttattcaaaaaatttaggtaattattaattcttttcatatcatttgattcattgttaaatatattttcatgtaggcatgcaattttacatatttcacaaaagtttttgaataagacgaacggtcaaacatgtgctaaaaagtcaacgttgtcaaacatttcgaaacggagggagtagtatagccaactactagcttcaaatcatctatagctaatataataacacattcatacaatagttaactataaaaatatactcactctgttccacaatataagggattttcagtttttgcttgcaacgtttgaccactcgtcttattcaaatttttttgcaaa

SEQ ID NO: 66668 - DNA, 19762 bp, Oryza sativa
caacccatatcatcagtacttgagtcggtctcactgcttataaaaaaacatgcaaatcttccccgacctctcattcaagagttgcctttatgcaataatgttggctgccataatcaattttagttttttttttgtctcctctcttaagagctatcactcatttcatataggttgctttattgtttctgattgcgttttataccacttctcttatactatactcagatatgaaatagggaagatggataaatttgataggtttcgtgatagcgatgtcagtaatttgacgagttttgtgataatgatatatatgtagaatgatgtgttttttttactaagacaattcattagtactccatccaatgtaagtcattctagcattttccacgttcataatgatgataatgaaactatatagatatatatgtctagatttattaacatcaatatgaatatggcaaatgctagaatgacttacattgtgaaccggaggaagtagttgattaattaaatgccaaattcatagtaagccatatgatagaagattgaaaatttgtgaaaaagggaagcaatttcgcctcgtttttggatgcccacaatcttaaccaagaacttcaactcgtgcgcccccaaaaaacccccacctttctcttatcccctctatccgccgctcgccggccatctccctcccccaccaccaccaccaccgccgcctcctctccggcgagatgctgacctgcggccgcttcctctcctcctccgccgccgcctccaccccctccctctcccccttccggaacctaaccctctccctcctccgccgtccccatttccgcctcctctcctcctccgccaccgcctccgccgccgccgccgccgtcgagcccgacaccaagggtaaatatcctgaaccttcaaactcgagggaacacctcgcggtttgacagcgagagccgttctgagctgtgggtgtatgggtggtcgcaggtggcgcgggtggcggcgccgcgaagccgcagtggaaggcggcgatagacttcaagtggatccgggagaacacggacgccgtcgccgccaacatccgcgaccgcaactccgccgccaacctcgacctcgtcctccagctctacgacgagtacctcgccttgcagaaggtacaggagcctgttaattaattgtcatttgctactgctgctgtttgtagtttctgagatgctgctcttgcgtgactgcctgcaatacaagttggatggataagatttaagcttgcgctgtaaaattataatgcaaagctcgtgattcgcaagacttttaaactgttggataagacttttatggagcttgtcattgactcattgctgctgctgctgtttgtagtttctgattctgctcttgcgtgactgcctgcaatagaagttggatgaattaagattaagcttgcactgtgaaattatattgctttagtttgtgatttccaagagttcaataactgttcgagatgattgatagaaaaatttgcaactttcgtgtgaacttagacatgaactggttcttaactggcctattcatatggttaattcattggcatgtgttatgttactttctgactattagtgagttgtgcctattgcaaccttgtaattttgggggtagcaaaatattaggaagaaccaaaaattgaaactagaaactactctttttggccagtagtcatggctattaattggttatttcgttgattatattggatcactgattgattctgctttactgatcttgtgaactcaaaattactcatggcttcatggacttatccttgcctggacgacacttttgtttatggcgtaaatatgatactgtgttactgcgatttaacctattttggcatcaatgtctcattgttctaccgaagacacgtgtgtatctgcttgtgtgtatgcttgcagtgattgaacatagttggttatttaattctggactgagatatggtggcaacaattcctaattatgacagatggcaggaagttgaacggctccgagctgaaagaaatgcagttgctaataagatgaaagggaaattagaaccatctgtgcgtcaagcccttgttgaagaaggtagaatgtttatgaatttattttctaaaaaaaatgaaacagcgataccaacatagtaatttttttttataaaaaaattggattgttgcaggcaagaacctgaaagaagggcttattgccctagaagaggaccttgttcagctgactgataagcttcaactagaagcacaaagcattcctaacaccacacatccagatgctcctgtagggggtgaggaaagttctgtcgtcagaaaagaggtagtgggatttctgtgtatctaactctgtcttttcagtttgtccaactgctaattttcttttacttgaataatgcaggttggtagtcagagaaacttcaatttcaccattagagatcaccttcagctgggaaaagaacttgatttgtttgattttgatgcagctgctgaggtataactgccacaaatcaatgttaaacataactttgcagtaagttgttcaatagcacagttatatttgaactggacagaagccattacctgaacactaactcaaagatgatctacaattgtagctcctatatgagcagttgtacttcttttcacttgttcattttaccaaggttgtatactgtcattttcaggttagtggctcgaagttctactacttaaagaatgaagctgttctgttggagatggcccttgttaattgggccatcactgaggtctcaaagaaaggtttcacaccactaataactccggagattgtaaggtcatctgttgttgagaaatgtggcttccagccaagggcccaaaatactcaggtatattgatccaagatacctttacatcctggttaatagatgaattcagcttttagagctggttgtgttaggaggatcttatgcccataatttcaagaaaaaggtgagtaactttctctaggatatgcttttgtgctgtatgatgtggcatgttaaagtcgtagttggctcctaatttatgaattctctcctaattacacaggatcagatcagctattttgtcatctttattttcattacatgatttggaaatttcatcgatctttcatcgtgtgaaagtaaacatttatttcactagttaaccttctattgtgtttctgtaggtttattcgatcgataacagtgatcagtgcctcataggaactgcagagattcctgttggcggcatccatatggactctatactccctgattctgatttgcctcgaaaatatgtagcctattcacattgttttcgcacagaagctggtgccgcaggtgctgccactaggtatgcatattttcttgttctgttaagattatgcattggaaattgctctccactgatttatgtaatttgatcacagtatgttgattacatattgtatagatgtgtgaagatttgttcattggttattcaaaactttgagatactccctcttttttttatttgatgttggttagttcatttttgaactaacgaacattatgtaaaagagaatggagggcgtagtttacaattcttgtatgaagttgctaagttttggtcactgcatcctgaacaggggcctctaccgtgtacatcagtttagcaaggttgagatgtttgtattttgccggccagaggagagcgacaagtgccatgaagaacttatcactattgaagaggaactttatgcatcacttggacttcatttcaagtattccctgatcttctgaatttgcatgtcattataatttagaggcaacaatatcatgctctttcttgcagaactttggatatggcgactggggatctgggagcaccggcctacagaaagtttgacattgaggcatggatgccaggcctagataggtacggtgaggtaagaaacattactcaagccctctgcttttgaacttatattcaatttgaagcaattgccctaacttttcctaatcgaaacgaacagatctcgagcgcgtcaaactgcacagactatcagagcaggcggctgggcatccggtttcgcccatcacctgcagatcctccaccggcgaacgccaagaaaggaaagggcagctcaggcccaacacagtttgtccacacgctcaacgcgacagcggttgctgttcctcgcttgatcatatgcatcctggagaactttcagcaagaagatggaacggttgtgatcccagagccactgaggcccttcatgggcggacttgaagtgctctccccgaaaaccaaatgatcagcttgaaggtcaccacgtttacttcgaatcttgttttttttatagatttacagtctttttttcccccgaggatattggcaagtgaatgtgcagaatttcaaagaaatctgtggtcgattccaaatgttccatgcgaaattcgtggctgttagttggccaccgattgtcgattgttgttttggcaacatatccaggttaactatttcctccttgtcaaaatatagcaaacttggaatggatatatagtccaatgattatggacaaggggctagccagattctttggactagtatgctttccatcagttttaatagtttgctatattttgggatggagggagtagttgaacaaactcagtattacacttgtagttaactggtaactccacatatgcccattgtattggatatcccttgcgaaatatttcctccgtcccaaagtatatggtttttaggtggatgagacatcttaatactatgaatctgaacagatttagtactaggatgtatttcattcacccaaaatatgttatactttgggatggtgggagtatttgtccacgggagaactataccggagtagtttgtgctagaacaatagtactagtgctttgtcagtttaatatctgttcgtttacggctgtgtttagttcagcacaaagtttggattttggttgaaattggagatgatgtgattgaaaagttgtgtgtgtatgataggttgatgtgatgaaaaaggactaaagatctagacacagtctacatgatgcgaggcatgcggctagagcagccagcattttgaaatcatcaaccatgctggcagttttgctagcgattgattgggccacgtggtgtgccaaaatttgagataattatgcaaattacggtggtaaaaaaaaaatcttttccaacgcgctcgccttctcggcccttcgaggctgtcgagagcccttctctcatccatcgtctttgttaaagtatggaattctcacccagggctgcggaactcacgactctattagaaagtagaataaccaacttttacacgaattttcaagtggatgagatcggtcgagtggtctcagttggagatgctgcgaggccatggaaacttaaaataacaaaataaaaaataaaaaaataacaattagtagtagttaagttccagatttcacactgcaaacttaaaagaatacaaatggatcgataggaatttcatggtaaacagagaaaaagaacaacaaaaacaaaatctaattttaaatgaataaaataagaagcacaaagagaaacttagaaaatattgaaaaaaaaacaaaattgtacgtttaaatactaagctatatattatcatcacttaatctaaagctgatcgtctccgcgtcagctgattggttaataattcacccgtcaaattcgtacacttatcccttactgtgctgtggagcaagctcagcaagctatcagagcattttactttgcaaaattataatggcatggttccaatttacccttttagttttgaagaccatagtggtaacggtgcataggtgagtacaaacactctctctcactgcttaaaaaataattttcgcatactagggtcatttatttttctagacgaatataacatttggtaccatttccctgcatgcaaaatcagggacgggggacgatatggtcgtccgcttgcgaagatccatcttcacaggcggacgacataaggtgacatcatgcatcttcccaggtggagccttaagacatccgcttgggaaaatgtaggattatctcaggcggacatcttaagagctccgcctatacagtatatttatcacgatcatgcgtcgagtcccccgctatatctttgatcggttccccatgtgtacgtttacatcgcttgcacacacattgtcacttatactactcccgtacaatttcagctacaatttgttgatttctttgtgttgcaatcctggatctctattgattttatatgaatagattagattttgttgacaggttaaagttattaatttatcggttactctgttgtgtgaatttcgatagatactcctcagttctaactgaacttcagcctagagcatcagactaaccaaaggcagacatcattaaggcctcgtttggcacagctctagctctcaactccagcttacctagagctggagctgtgccaaacggtatagaatctctattttttagagcggagttgggtgagctgctccacaaatttgtactacgggggtggagctgggtttttactgctccacagctccactccaccccaaaagatccactaccttttaattttttagcctaattacaccaaaatgccactcaacaacccctcataccctctctctcttcctgttctctctcctccccatcctcctcataacagccggcgttggcggcggccggcggctcgatggtgtcggaaggcatgcagtcagcggcggcggcgacgcacgggcggcggctgtaggcgcgtaggcaacggctgtgcgtgggcggcggcggcagcagcggccgggcgcgggaggcggggcggcgcgtgtgcggcggcggcatttcgtcgaacacttgggttgaccgccggctgtggggtcgggggcgagcgacggcggcgcgcggtctaagcgccggcggcagcggcggtagggcgataccaaccaagtgttcaacgaaatgccaaccaggaatatggtggcgtggagctcctataggagctagctctcactggagttggaggttggagccttactaaatggggcctgagttctgactctgatcttcagcttagatagtcagactagccaaatattttttttcatttttttactccagttagttcatttatgggatgaggaaatgttggcatgtttgtgtaagatctcactgaccccaaaatgtgcctggttttctgtttcttttttcttttttaaaaaaactatgcgcctaccaatcttccagttcccaacctgaaagaagcaggctagctctagaagaggaccctgttcaactgaccataggcttcaattcaactagaagcacaaaagtatttattcataataccacgtatcctttaatttatcaaagattacaagtaatagattaacacatatcttccacacggaaaacggagctgattaattaagtattatctataaaaaaacttaaaaaatgtattaatatgattttttaaagcaactttcgtgtataaactttttgcaaaacccgtaccatttagcaatttgaaaagcttgtacgaggaaaacgaaggagatgagcgaagtgatgggaaagaacacagccttgcgtaattcgtgtcgaattcgtgtcaagttttggcctactaccacttgtcgcttgctgttttcggcagtgcataatccaagttaaaactatccgattcgaacccccgccttggatgattccgattccgattgcgagtctggaacaacacgaacccgcctcaaactcggtcgatctttcttctcctcttcttcttttcgacgaaacaaatcctccaaaatcttcacgcgaggcgcaggttgagagatccacccatggccagcggcgacgaggagggctcgggctcgcgctcgcccagcaaggcggctccggctccagctccggcgaaaaagaagaagacgaagacgacgacgacgacctcggcgatggccccgctgccactagcggaggtgaagtggatcctcgcgcagaagcgagagccctacaccaacccggacgacatcgagggcttcaagatcagcagcaaccccaacaacgacaacgacgacgggttcccggaggaactcaaggcgagctgcagggactccatccgcagatcgaacatcctccgcaaggtcgcggacgaccgcttcttcgagtaccagagcgaggtcagggccgccatggagtccagcggccgcttcttggtcgacgccggcttcttcgagcgcagggcgaggggtcgcgccaagcttaacgaggcatgggcgaagttgcgcgatggcctcccgctctccgactctgacagcgatgcggatgaggaggatgacgaagacatggcattgctggctgcgatgggtttagaattcgattgagaagagaaatcgatttaattgttattattattattaccaacaaggaaggtagtccgcatattcgcgcgggcttgtacagtagattgcgttgcttaaataattgtttaatctatttgatagatttataccgtataatatttaattcatccctataagcagcagatatctatagtcttcttcatcatctaagataatgtagacttagtctatttagaaaacatatataataaattaaatgtaaattaaaaaaaggtgtttttggaaaaaaataaatgtttaggggctaactttttttttatcaaatctgtttattttctactaacacttgtgttttatttggcataaacctagcccattttacattgatgcaatttgtcacttacagataagacagagcatatttctgacttagaaattactccctctattccaatttgatcatcacttaagcaaaggatgctgagaccaaaaacaacaaaacctccatggttctaaaattattttcatcaatcaaggtgttgattgcattacgctgtaaatatttcgtggagttacaccaagataatttttttaggttacaccaatagaaattaattttggctagttgcatgcatgagcttattcaacgatgcccatttactctttacacaaaagtcatttgttatatgatgattatttaagggagatataaaaaccttggatgagatcaaactggcatggaggaacgatggtgggagtagtaaatatcaagttgtacatgtaggggttgtttggttgcatgccacaagttgccacgccaaaagttagtcattgccacagttttttagctattgtttggttcatgacacaactgtggctagccacatattttctctatatggccccacatgtcatacactagtattttttgctaactttggctaagttgtggctagcaccacacattttgtggcagccacaccttgcctaatatggggtttggcaaagttagcaagcaaccagatatcctagttatgacctgaacaattaatgtatctggagtcatcttagcatggagttataatttttagatttttttctaatgataaaataattcataaatttaaaattcaaaaagtatgtgctctacttggagttacaattttaatttttcatgattttatagtttgggaagtacaacatataaaaataaaattgtactcatctgtaactctcaattgtaatattttattaacttgagaacttattttaaaattaaccattagtaagttattatgatttggtgtcacttaaatatatgcaaacttcaaaattagtaataataagaaagtgtcacaatttattacttatatacaagtagtgcaaatttgttaggttactgaatgaccacgatgtcgatcgtttcataccattaacatggaaagaaacaatttggaagttcatgatgtcgtttcatatcagaaacatgaaaagaaacaaaacttggatgttggaacggaaattttctttgaaaaaaacagcaacaatagtttgcaaatttcagtttggatcaaatcttaattgataaaatagtgccggagtggtagaagttgggggacgcgagagtctggtcgacatcaacggactcatggttatggctgcccttgtagccgatcatctagggcaactgggcaggccgatcgccggtgaaagagattgacgtacctagtcaacgtttcatggtgcgtgcagaaccctactgcctggaggagtgcgttggtttgtgattaactcatgccccatcgcgcgtaagaattgtggagtgtgttaattttttttatagatttaaagtgattagcaggcaaggaggatcacaaatggattaacttttttttttctcacaaatctaatctaacagtgtaaaataacgggttcaccggtttaagtgaaatccaaggggctagatgttttgcttttttcttagaatttctaagaatttatctaatttattagagcgccacttggcgtcttaggagcgtttataggacgcttaatggacttttagtatataatagatagatagatagataatagatgccatcgagtatatattatgtttgtcagtgttctatctatctattatatttatatatggctatcctagaacatgaacatgatgggaagtgaaattaccaatgttttattaactctgctatatatgactgttgtttagttgatgcccatctgtgttatcagtccaacaaggaagctctgcaacatttttcttgcgcttcagttaatcttgtttcttgtttaggtgtatttcttcacaaaattgtttgtcctgtatagagttattgcctatgaattagactggagtatgtccaaccaatctttagagaaccttgttgtatgcatgctatagaattctggataaatctaagaccctctcctgcactaattcaaacacttttgctggtttgttctcgtgatctcgtcagtcacactagttcatggagtggactactgatgtttgatcatggtatgttggatggttggtagtagattattttcctcttgaatcagtcagtccttactaatttgatactacttcaatggcatataccgcatatgtgttggtagcatgtcaaagttattaatttatcggttactctgttgtgtgaatctcgatacatattcctcagttctgactgaccctgtttagatgggactaagacttttaactccctatcacatcggatgttggacactagttataaatattaaacgtagactattaataaaacccatccataatcttggactaattcgcgagacgaatctattgagcctaattaattcatgattagcttatgtgatgctacagtaaacattctctaattataattaattagccttaaaaattttgtctcgcaaattagctttcatttatgtaattagttttgtaagtagtctatatttaacactctaaattagtgtctaaatacagagactaaagttaagtctctggatccaaacactaccttaagcctagagtatcagactaaccgaaggcagaattattgagttctgacttcagttagttgatttatgggatgaggtatgttggtatgtttgtgtaagatctcattgacccccaaaatgtgcctggttttatgtttcttttttctttaaaaaaaactatgcgcccaccaatcttccagttaccaacctgaaagaagcaggctagctctagaagaggaccctgttcaactgactataggcttcaattcaactagaagcacaaaagtatttattcataataccacatatcctttattaacgattacaagtaatatgaatataagataagtaaaagacattaaacttggacccctatgcgggtctccgcgtggactggaaatgaaggatcaccccgcccccgcgaaaatcgacggggacatatctccttccatttattttcttatggagaaccaattcaaaccattcccgtctcgtaacaggtgaattcaccgcgcggaaacagaaaacgggccccttgcccatctctactcttatgaagttgctaagtttttttgtcactacacgctgaatagatgtttttgtgcttttccagcctgaggagagcgactagtgccatgaagaactagttcatcactgttcaagtggaactttatgcatcagttggatttcatttcaatatttcctgatcttctggattgacatgcaagtcatgccacaactcaaaataataaacaagattaacgcaagcatacaagatgattatatatcagtaatcttattatattcaagactaatgatgcgctcgatgcactcaataggaaaacaagattgatggaaagcaaacaagatcattaacttttggaccaatcaaaattaatactaacaaatgatgagatcttaagacatattactagtgcatgtaaaagaaacaatcatcaatcttatactacctccttacctaatataaggatgttcactattttattataacgtttgaccactcgtcttattcaaaaaatttgtgcaaatataaaaaataaaaagttgtggttaaagtactttggataataataaagtaagtcacaaatataataaataataattataaaatagttttaataagataaatggctaaacagtgctagtaaaatgtcaaaatttcttatattaagggacggagggagtagtatatgtctcaatttggtatttgatttcatcagagacccatgaacgaatccaggtaatacgggaacaaattatcccaatccatttcttggtggtcgccgtcgtagtcgtagtcgtcgtcttcctcgtactccacgctcgcaccaacatcaacaagaaatccacggtgattctcccatgcccagaacctcctctcctcgacgaagtcctcgtcggccatgacgcggccgcatgaatccatggccctcccagcggtcgcgccttctcgtcggcttcgtcgtcgtcctcctcccggtgtcctccactcctcccaggcgaggatccgcgccacctccgccagcgacagcaccaccttcttcttcgccgtcgactacgtcttcttcgtcatcaccgccgacgtcggatcctccgtctcgccgccggcttccttgtggcaggtgactgacaccgccggcgatcgcctccgacgagccctcctcggtggaaccggcgaggacgcgagactacgaagatatataggcaggttagtttgtttttttgacatttctcagttttttttggtaaggtgggtatgggtgcaagtttgactgatttgttaccctgtgttaagctttttgtgaaaaggaagtttataaaatgccaaattaagttgaaaattccgtttggataatcgttctgttaaattttggttgaagataatatctaagagttttggttagagggctcctgaagttctttttgctcctgctattttggatgatgagtttatcttttgtttctttcttgttggctgtgtgcactctttaggtgcagaagctggaggtgttctcagaataattgtatcacctgatagtgctgagattaataaagcttccattatataagaaaacttctaactctctccatcctaaattgatcattatatataatttgcagttttgcagtgcacgcctctcctctcctctcatccccaccccgtcgagccgccgttgtactgagcgctacctcttcgccaacgccaccgcacatcggctcgccagccgccacaacaatgcggtgctcgatcatgatgaaggcagcggttaatttgctctgggccgttagccggagctcgcagtggcgccagggtttaatcattcggtttggacgtttctgtcggagggtgctgatataccgaaatttccgtaattttaaataaattttagtcaaatttaaataaaatattgtcaaatttacaacaaagataaaatttcggtcaaaaaataatactatcatataggtaggggggagtggttgtccgatatggccgtcatttccgaacgttctcaggtacgttctgggtctcatcggtgatatataaccgccgtgctgttcatctgcctccgcgtattccagaacgtttgctgctaccacactccggggcaaccggttcgcaattagttatgtttgctcacattagctgttcgaggaaatgcctcagtgatgcttagtaggcagtgcttatttttttgtcagtgttcgcacgtcagtacgtatattcacaatttatattaaaatcacggtttcagctctgtatcctgtgcgggcaagcagctacgagggccctatttggttccataggctaattattagccaccaccttttaaccctgaattatctctcaaggatccaaacaggtgggctaatttgaggctaaagtgaattagcctccctcaaaacattagcctctctaaggggtgctaatggggctaattttgtgtggggaccatcaaaaagtagctctctctccctctctctctcctctctttctactctctctctctccacattttagccttgaattagcctatggatccaaacataccaccctaggctaatgtttagcctaccaattcatgactaaacattagctctcaaaattagtcctgggctaatcttccaaacagggccaaggttttgtacgcacatcaacgcatggcgaatgcggttcctgttatcttgcattctgattcttgcctttaagctcataatgcactttaggctgcgttcgttaggagtagttcccaactcctcctcgtttttcacgcgcacgcttttcaaactgctaaacggtgcgtttttttataaaaagtttatatacgaaagttgctttaaaaatcatattaatctatctttgaaaaaaaattagctaaagcttaattaatcatgctattaattaccttccatctcctactacgtggggctaattttcataaagaagcttgcaaaaaggattttttttcttttgttggcaagagtgctaataatgaacatgagaagcattccagcgtggctaaaacaatagactagagggaagttcacttaaaaaacgtagaaatctctatttctgttatttagtgtctgttactctgtgtctttgtgttattgtgaaggattttgtagctgaaatgctttctgtacgtagcaacagagcaaggagatgctatataaatcggttgacagtaactgaagtaacaattgcatcattgcttattccgcaccagaggccccttcacaatttctacgcatttgactcttcacatatactcccttcgtccctaaaaaaccaacccagtactggatgtgacacatcctaatattatgaatctggacatacatctttctaaattcattggagtagaatgtgtcacatccaattctaaatttgttttttatgggacggagagagtatttacttctttctgcacttgcttgtagcgacccttgtattccacttccgaggtagaataccggtctatggctcattccttagtaagaactaacttaccaagaaatgtgcacaccagagtaacataactgaaacaattgtagcgaaacccattaaataaaaaccatagaaagtagcttttatcaacaaaataactaaatttacctcaacaacaatttccagtaatgatctttatcttgacttgatactgaccatgctttacttcgtatacaactcccaaatttttctccttgctgttcatcttccaagagaactttttcgacgcctaaagagttagctcaaacatctacaaaggataatatatatgggatgagtacgaatggtactcaacaagtccaactatagcaatccaataaatatatgcccataatgcacctgcataatacatatatctccaaatcccataatccaacaaggaaatttttatgcatgttcataaacacagtgtagtaaaagctcatattaagtaattataaaatctactgcatataaggcaccacagggattagaacctccgataggttcctttcctgccgcgttcgcagtttctacccgaaacagggagtgacatatcacaattcatacactctatagaggtgtgttgctgtacccatagacgccttaaaacttttaacgcccgcgctacaccgccaccacaccagggcctaagtgtagacccccgattttggaaatcggaaatcttctgtgtttatccgtaccaatccctggatcagtagttggtacacacatacatagttggatcacaacatatcacgaatgaatttagactaaaagagttaaatacttacattagggccaggtaggccaacaactatcagagaacaacagcggaagacaaaataatataagggcccggttaacatgccacaggcagtcgactggggaacgagacctagaacaagaccgcactccgatcatcttgtgggatacgcaagcgtaccgacaagagcttctcttcaacactctcctaaaagatatataaatagcaagggtgagtaccaaccgtactcagcaagccaccacaataacaatgcatatgatagagggtatttcaaggaatggcttcaggtccttttgcataaagctaattttacaattcttttcacaagcctaaaacctagcatagactgatcaaattttagtaccagtgttcactttaaacaacgacggttctgtctaccatccattgtgataccaaggatagcttcccgccattgaatcgtcatggttttctgaggatgtccaccttccctcctctcgggatgtggctccatcagcataaaattcatcatccaatatcccattccctacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctagcgctcccgggaaagagaagtctcacacgcatattaaattatggttcaagttaagttctctctctcacacactcatggcagtcctaccaatggcgacaccgatgtagggcacgcctctcggccctacctcaacggctgtcccattgtagcgcacctgcctcactcaggggtgaaccatctatacagggatactgcctccgctcggctatctaatccgctaggtctatactcattcgagaaatacggttgtacgggggtcgtttcatgcttaacttcatggctcggtccttaattgaccggggacggtactagccttttccagataccacccaaatcatccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcataattgactagggactcatacgtaatcatggttacaaggattttaagggtaaacaataatcaaggcatggcataatcacaagtaggatgttcatcattgcatgcaattttatttgtaaataaaacaatttcgcaattaggatcaacatgttcaaggaatagtgatgacttgccttgctcaggatagtccttattcttgatataattcttgatcaaccttcacctcctggaagttgctgacgttgccttacgactaaccgatacataaattctataatacgcaagaaaaaccaatattcaaataacaaccaaatatgcacaacaaaatatactattcatgtctgctaatggattccaatcatgctaggggctaaggtttcttaacctttctattgtcaacgtggcctatttaggagttaaccaacatagcatttatgggatacatatatatttggctaatcggtggtttagtctatcaaatggcttatggaaggattatggctaagcatgcatctatctaaataggacggttatatactagaggttctgttgttagatggatttaggatcaatcaaataattacagtgaatcatttgtattatttattttattgatggaagctttactttagttatgaacatattttacttgccattataaattataaaagggctaataattatccatgctctatatgttaaattcggaaagtttataatattatagttacagattatctcttaatgaacaatctggagttacaattgaactatgaacatatgaggtcaagatttataattagtacttatcaactattcatgtttgttatatactccccagtttgatatatgaaaaagataaattaattgtgtaactataatgggatgtacaatatatgtgtgcaacaacgtataaggttttggtcgtctactgtacatgagcttatttagaaagtgtactacccaatgttccaagtgattcctgaatatattgtagtttaattatacattagctagtttctatgagtgatattgtatatgtgatgcgacaagtttaagcactggttctattgggttactaataagtggtaatcaatttaggcatatatatgctattctatatggtattgcatcgattaatttacttagtgattccttcacatctagctctattattattctcctaaacaggttaaagattcatctatgtgtgtttatattgtagttacataatcataaggctacacttgatttaaatatcctataagccatggccatcgaatattaaataagtactagtattttcctatacatccattcatttgatacatcacataaaattagtttgtgtggttgttacagtggcaagacatgctagagacaaatattattacatctactctactgtacaatactaattttatttattaacatatttttaagttgactattatgcatcatcttgatattaattatttaatatttataaatatattttatcaaatagtgaattatatatcattggaaagcttatgattttagatgaatttaggttcaagtttcactcaaatcggagctaaaatgaataagttatgctagtgtaaagattcaaatttgaataaatccgagaaattgtaaaaaggcactgttcctaattcatttatttatactacaaccttatccacaagctatagtgattgacaggtggggcccactctaccctctcttctccttcctctctctcttttcttttcctttctctctctcttctttttctcttttctcttttcttttcttccttttccttctctctctcttctttttctcttttctcttttcttttcttccttttccttctctctctccctcccggcttctcccttcctctctctctcggctcaggctacccggggcggcgacggcggcggaacgagggaaggggcggcggcttaccgatggcggcggcggcgacggcggcgcaaggcgaggcgacgctcggcacggcacacggcgcggtgcggcggcaccgagggcggcgacgcggcggcgcgtggagagggggaagagggagaggagggggaagatggagtgaggagaggggaaaaggaggggaggtggtgagggtggtgtggaaagcaatggacggccggggagggggggg

SEQ ID NO: 66669 - DNA, 943 bp, Oryza sativa
ttttgagcctattaaaccgtcgttagcacaggtgggttactgttacacttatggctaatcatggactaattaggctcaaaagattcgtctcgcgatttccatacaaactgtgcaattaatttgtttttatctatatttaatactttatatatatgtccaaatatttgatatgatgtttttgggaaaaaaaatttgagaactaaactgggcctaatgggctttccccgacgccctgacggaaagggcaaaaacgtcttcggaatacagatgagatattactgcacgtttgcatgtttcagtgattcacctacatctctactgatccttttacagattattcatgttacaagtatgcacattttattccttcagccccaacaccacgcccttgcgatagaacggacgggcagcgagagggattagtaaagaataacacagtcaagaaacaggagtcatcgaataacagccatgcaggttcggaactggattgatcgaccagaaaaggttcggaaacggattaatcgaccaaaaggttcggaaacggaaatggactaatcgaccaggaaaaatgcccccgtccatccggtgattatactgatatactaatttgatatactaattttcagcccaggcagcaattcagcattgcgctgcggtaggcaagttgaaaaaaatatttataacaaatgaaaatctataaaactaaatgagcagatcaaaatctttgaaacgtggattggttggggtgcgccgggcccaagcagtagtgcaacgctagggcgacacgcgagagccccgatagcaagctaccgtggtgggccttcccccacaaaaaataaatttaatatcaaagtgaacacatagcccacatatcagatattaaactgataagaacagatactacacttgatcttagccaaaaggccgagaaaggtatgagttg

SEQ ID NO: 66670 - DNA, 8245 bp, Oryza sativa
ttcctgcagcccatacatagtgtagtatatcgtttagttaattcgttatgttataagttgttcaaaacagaaatgtatgaggatcaaaccacaatattgcaattgattactatttgtggttctcctcctatattcaataaaattgtcacactcaaaatgcgggtccgttaaaagcaaaagagattactatttgtgtttggtctagaccatcaaatatattgagaacaaatatgttatacatctccaattttaatatcacagttaaacgatttgccaccgatttcgatagtcgagttcatattgtcatcgtggattcgtgatcgagcttactctggcgcgtggtagccgaaggtgccgagcaccttggtggagtggaggcgggcggcggagtccggcgactggttggtgaggttgaagtcgccgatcttggcgtcgtggccgtcgaagacgagcgcgttgctggagcggatgtcgcggtggacgatcggtggctgcgcgcgctcgtgcaggtactccagtcccctcgccgcgccgtacgcgatccgtgctcgctggctccacgtcaacaccggcccgggctccgcccccttcacccccttcttccctgcaataataaaaatcatgaaaaccccacaatgagatgcaaaataccataaaattcggaaaatactacagcacggtatccggttcgaacagaataaagtattaactgatacaccgtttaaacggaatgatacctctgaggtatcacctgatactagtaaggtatcagttgatatctaggtatcagacgatacctctgaggtatcatcctgtccgaacaggatatggacctgtagtatttccctaaaatttatgcgtttcaaacggggttcctttagaacaattggtgcaacgacacgtgaatggtcgtcgttgatgcacagcatatgttgtgatgagtactactagtagtgagtttaatttggttttttttgtaccgtggaggatgtcgtagagggagcctttggtggcgaactcgtagagcacgatgcggttgttgagctccaggcagtagcccagcagctgggtgaagtggtcgcacttgagcctggacaccacggacagctgcgtgcagtgcgtgccgtgtcgtgaccgatagaggcaagaacaaaacacgtacgcgagttagtttttggcgctgatgaatactcttggagtagcatttgcacttttttttttcttgctgaatttgaaccgaatgtgcggttttctcgtttacctgcgcgcagaagtcggcttctgactggccggagccgccgttgttgtcgaacatcttgacggcggcggcctcgccggtgctcagcgtggcgcggtacacgcggccataggatccctccccgaccagcgacctgtcgccgaagttgccggtgagacggttgagctccgccagcgccacggccgggacgtcgatcggcagcaccttcgccggcgcgccgccggctctcggcgcgttcggccctctcggcggccctgcattccaaagtgtcatcacgacggccggcggcgaacattacggacaaattaatcaactaggactgcgcaattcgaacctggtgctcgcggtggcggcgccgccgggttggcggccggcgcgccgtggagctcctcctcggcgccgctgcaacaccacatcgtgcgacgcagatagctagacagacagcttagctagctagctgtgcaagaacgattaattcagctaataacttagcttaattagccgctcctctcgcacgttgaaggattcggagctagctggttcaacgatactactactatagcatatatacatcgcgacgcgccgagtttgccgcgacaaactcgcgcgaaatgcacgcacgcgggaagacaacgacaaggccggtctcgcgacgtgcgaccctcgcatagaatttttgatgcaccattatatttcgattttgctatatatttatcgataaattttctctcaaaaatttgacagatgtaattacagtacaatcatagtataattacactgtaacttgcatgtaattacactgtaactatagtgtaacttgtatgtcactttcaaaaatctctacgtaatatgttatttcggtaaaacagaagttgtgggaacaaatccttacacatatatgtgtgctgtgattttatttttcttcctcaccaaaacaaatcttgtaatagatctaaaggtttaaaattacatgaaacttatatacaagttacactgtagttacgtgcaagttacagtgtaattacatataagaattatactacgattgtactataattatatctgtcaaattgtcgataaatgtataggtggtcccttatattttgcccccctttttttagcccaaatacgcacgagagtggcggatccagaaaatcgattcgttgatgccataacttatttatcattgtcatagtatactaattatatttaaatcatgatgttataatatatggataaatagttttgttatatattttactacaagtcgtcggtatcatctgacaccggttcttatactgttggtctgctcctggtacaaccaaatagcatacatggtactagagcagatgcggttggtgtcaagctcgtacgtgtatgtacataccacgcatgtcgtggactacaacgaaccaatcatcgtgtgctaagcccatgtgtgtacatagtttagcttcatggagctaaagatcggttagtttaattattatgctgctgttagtaatcggttgagcaatgatttatttagctgggtagagattacttagttttagttctctagatttaatgcgaatacaattcggactgcaggctgatcaaccacgtttgcgccgcggtccgctccgttgatcgatccggcgtcgtgctcccatgctgccttcacgtcgtcagcaacaacggcttggccggtttagaacagagcaccacatgttttcgagtgagctagttggtgattttcagaatatcgacatggacccggcgtgtgaaagttacacacacattatattattgaagttattacaatgtaatcatactatatttatatttgatcgatagatatatagtaaatacgaaaacaataattatggtatcggatgatcaaatcacggtgctttgctgatatcacctcttctaccgtctgctgcaccgtgaaacaaacgccagctcagaagaagctcaacctgcttacctgcagttctttgccccagagatctccggtgtctaccaccggtcgtcgtgctcgccatgcgcagcgaattcaggagagatgggcggtgccatgggatttgtttatgattgattgactttctaggcttttaaagccttgctgttgcgcaactttgttcaggttgaagatgatacagttttaaattttcattgaccgggtttaagattagttgcggatgcaggcaaaattggttcaccgggaaatgtaaggagtgttcccatccagctagatggacgcaaggaattgcttgtttcagtttcaagcaatgcaaatagtacttttggtttggagggtactgcacgtgttaacaacaaaaaagaagttaatcagatataccagattaagtagacgcattggaagcaaagctacattccacaagtagcttcaataaattaatatctacagaacaaaaagtataaaatgtatagtagcatcaaatacagagtacaggatggttaaagttctcttgttacggtcgctgcttcaacatgtactttgtgcacatatatacagaattttgaagtgaaattcccatgacgacagtcttttaactcctgattagctcaagctgctttcttgcttttgtatttgtttgcgcagatgacatatatcacaaagttcagaaaactgagcccagcaagaagccagaagaaataatctaggtgaccttgattcaagttatcaggaatccatccaggatttcctcctcttgttgtgaagtacgcaaccaatgtcaaaatgaatgcactgagataattcccaagagctgttgtgacaagctgcagtgcgctgcagaggctcctcatggcatccggtgattgatcatagaagaactcaagtgacccgacaaatgtgaagacctctgaggcaccaaccaagaaatattgaggaatttgccagcagatgttcagtggtactggaacattttgatccaccaaatgttcagcccttgcaatgtccaaccttttaatctcaagaactgcagctgccgccatcgaaaagattgagattaccaaaccaatccccatcctctgtaactctgtaaagcccctcgggttgccagtgaacctcctagctattggaaccaagatactatcatagagggggacccatataatgacacttaccacatcaaaggtagatagagatgctggaggaatcttgaatggacctactgatgtatcaagcatcatcccttgctcaacaaacatggtggacatctgagcatagacagcagaaaacacaatagtcgttgcccagacagggaacatccttaccaatatcttcagttcttccacctgagtcacagtgcatattcgccatgggtttgtaaagctatctgctttcacatcaagatcagtaattgtagcagctttgtccagacatctgaaatgaatatcattgagagtatatatgttaggtcgttagtttctcggcaaatatggaaatagaggacgagcagatatcaaaagtcaaacataaatatttagctattttttctaaagcgctaggccaaaaggccagtatctataatatttaagtcgcaatttatcaaaactaaaatgttaaccatcacaaaaagaagaagagaaacactacacctaataactttcagaaaatatattttcctagttcttcaagggccaagagctgctaggaattgtgcactgagctatggtctgctgctgctgcaattttagctcagagaggaacacacctgagttcatcggtgtgctccaattgccgactcccttcaattgctgaagccccatcaggcaactcatacaagcgagagctatcctctggaacatgtacgttccacttgcgaaaggaggcaacaaccacctggcatactcgtgtaataggactgccgcctggcttttggaatctataaagtgatgttccagagaagaaacttatgatggccagccccatgaaaattgttggaatgccaaagcctattccccatcctatattgtcttgcacccaaaccagaaaactgcttgatatgagagcaccaatgtttattgagaaatagaaccagttaaagaaagatcccttctggattcgctcaactgggtctgtatcatcaaattgatctgctccaaaggatgagacacagggcttaataccaccagtaccaagagcaattaggtaaagtccaagaaaaaagacagtatactgcaatggatttgctggtgggcaaaaggacccttcgcaaggtggaggcatgaatgtaggaactgatgctgaaagagtcagtacagccatcccctacaatcaaaatatgatgtaaatataacaatgtaacccggtcaaattatagaatcagttcggttcagcagttcaaatacggacagctatgagcctatgaagagagcttgtacacaagaattacaggcctattcagtagacagtaaagaaacagatctactcagctctacccttcctagcagttcatttaagaattgggaaagagtacagcaggccatcttaagtttgagaagctgcatcacatactcactaatctgagagcgtatatatatataccacattcacaaaccatttctacattcatagctaataaatgtttcttctttcattttgaggagtccataaaagaactgatacatggtacaccataaaatatcaggagaaagatgacttacaatgaagtatatcgtggagaatgttgcaatagtccaataccttccccagtatgcatcagccagtatagctccaataaggggagttaagtagcaagttccctgccatgcagtcacattgctagcagcagaagcattaccatcatgcagtttctttgtcaagtatgtaacaaggtttgtggagattccataataggccaaccgctcacagcactcattacctgtggtcagtgatggtagttaattatatatcattgcagatgccgacataataatagaccttgataccttgtagattagtgttagaaaattacctaagataaatgggcatgccctccatctaccagttctctccttcacaacaggattcccagaaaagtcgacagatccatctccagtgtatgtaagttggttggattcctggaataaagatatttacagtgccatctcatcaaacaatttttgttgggcaataactgaacagcttataatgactatagagaacttttaactcggtaagaaatcaatgtgcattgacagtcgtcacagagtaacttaagtttaaatgtgcattgctgactgaataatgtatcaattcagtaagaccacaaatctaaactgtatacttgacttcaacattcagagttcagacgcaaaggaagcagctgtactgctgcagcactatgctggttcctaggtagttgcgttggcatgcggcagccaaaattatcgtaagtccttccaggacaaggatgccattttcccatattgcgcagtacaggagttgaataatccacaagccagaatttttttttgcttaaaaattaagaaaaatagaacaaacagatattagttgttttttttttaaaaaaaaagctataagtagggacgattgttcagcaaagttaacttccacgaatcgatatcgaatacatagaagagaaatatttcccttccaattttccgctcagccgaagacttaaggtggtgtacctaaacaaacaaccctaacatattcctcactcctcactgaaatcgaaaacagcgattcacctcccaaaaaaaagaacgaaaaaaaaattctcaacacgattcacaagcacgatcgctgattcaccgccggcgcgccaaagaaacagagggcggattcaaactcacctccgggatggcgaggagaccctgctccagggtggactcctcctcgcgctccgcacggaccaccgtcacctcggccatggcggcgggcgggcgcctccctccttcggtggatcagtaacctgcggcaagcaagtctgggccctggccttcgatggtggaatcgtatataggaagctaaaggatcaggaggaaggaggaggaggaagcttgcagatctggatatgtggggtctccgggtccaacaagacaaacggtgaagcgcacgacaagaacacccactgtcttaaggcgattcggggtcgtctttttcccctcccctcgctacgattgttctgtgatagaaacgggttctgactggtagttggtgagggtatcagagtttttttgtgggaaaaatatgcagtgtaaatcctaaagtgagtataacaaatttgtgagaaaaaaaatatgtagtgtacatcttaaagctgagtataacaaagatgatgtaaatgacacatgaatgagagaagaaatgaatagattcataagctgtaatacgtactctaataaactactattatgtgagaggtgagtaagttagatattaatgatgtaatatagatctataattgactgttgtgtgggtgggctattaggttggttattatatatgatattttaatttttaagctagtagtagaatttagaataaatttagaataccgtaaaattaaaaataaactaatatagatttatccatgttatcatgagtaaatttgtttctctcaatcaaaattttagctatggtcgtatttgggaataaatgcgtgacaagttatatcataatagtcttttggaaaacacgtacttcgtaaaaaaaaccgattttgggttttgatttatttttctttacggagggagtaggttaacctatagaaatagatttgtttaggctgtgtttagttcagcgcaaagtttagattttggttgaaattggagatgatgtgactgaaaagttatgtgtgtatgacaggttgatgtgatggaaaaggaggatccaaactttggatctaaacacaaccttactacagtagtaaccgagcagatccctactttctgcaagaggcttaatacggagtactataaaagtaaaatgttggtcactttaggtgg

SEQ ID NO: 66671 - DNA, 18070 bp, Oryza sativa
gggagcgacggcgacagcgcgcgcggaggggaggggctcgagacgagcggtgacacaacgacgttgcgcggcgacgcgatgcaacggcgacaagacgcgacgcgcggggctcgagagcgacgcgacggcgtggcgacacgacggcgcggcggcgcggggctacgcgcggcgggcgagcggcgcatggtgacggcgcgcggcgcgatagcggcgatgggacgggcgcgcggcggcttggggcgcgaggccgacggtgacaggcgagcggcgcagcagcgacggggcggcgggcgcgacgacaagtgatgggaaagagggaagagaagggagggggtgacgcgacggcggcgcggggctcggggcggcgcggggctcggcgcgcggtgagggcgacgggcgacgcggcgacgggacggcgtggcgcggcacggggctcggcgcgcggcgatggcgacagggcggcgcggggctcgagacgacggcaacacgacggacgcggcgcgcggcgtggggtgcgtggcagcggcggcgcgcggcgcgaggcagagacggcgacggcgcgcggcgcggcagcggcaacgcgacgcgacggcaggcggcagagagagggagaaagaggagggctgggttaggggaccatgtcgagcacctagagtgcaatgaacagtgccattttctatttaacccgattttagtttatcccttgtataatctcattctataaatcctaatttttacataaatgaggtttacccaatatatgttttaatttagatgaaagtttaccaaattttaatattacccatattttattcttatatatatttttctattgtattatttaaatgaggtctaattctaaaattagcccagataattttggaggctttgagggttctaaaatatcctagtgtggcccttattattacaatagcacattgaacttatagcaatatattttaacctgttgaatctatttattctataaatagtatattaagactcggtacaacattaatctaattttaaacactcacatattcttgtttatatataaggattaatttatttatatgaccattattttatatgagtgattttcctgtcatgagtaactcggcgacatgttgcaagtatcaatctatatattctggtggattacttatttataaacacgatcactatagtggtgatcatcatttcatgtgttcttatatttcatgtgagattcgattcaaatgaattagatttaatcttactatttctttagctaattgtgacatcaagctatcaatcatggttcgaatatttaatacctgatttgtaatttgtaatagaaattaatatttgacttaactatcttgtgcataattatttgtaggattaacaatattatattctcgtaaatttatctattacttaaattttagatccttactttactttctttgtaatcatttacggtttggcgagcaatagcaatcataacaaccagcatgatgcaaatgttttaaaaaaaattcaaaattttagtgatttttattgtcttgaattttcaggatgttacactaagcacacttcatggtgtatgccggcaaggctaaggtcacaagcttttcatcaatcccatctggcaattacctttgcgggtgattcccgcaacaacggcgaatcatcggatcccgcaacaacggcgatccacatcatctaatcggattccgcaacaacagcaaccctcatcgctagcccacgctcacaggattcgcggaagtccttaagcccgtaggataaagccattaagaaagaactactaagccagcctgtcccattccaggtcatatggtcgacacgatcgctacggcgcttgaatgccatataacagttgttgtttaaccttatgatgataaatatatgcaactgaatccccaccacatggcaagttcagaatacatctatagtatgatcgactgctccaccagtcaatccaatccatcagcatatttattttcattatagaaagtataatttaatgcaaagtgatacatatagattgcaattacaaaaatataacaagagatggtcaaagatgctggacttgcctgagatacccgaaatcgaagaacaaataaatcaatgaagaactccaagaattccaagataaatacccaactgtaaaaatatggcgaattagaactaaaaccaagaatgtagatattagtatgctgcacatgatatgcctaaccttaatattatagttgatctacaatgactataggttatcgacactcacctcaagactcgactagatgacccctatgtatgtatttttaagtagaatatggttaaatatatttgtatattttgatttggtaaagatctatgatttatataacagaatttagttttggactaaaatatctgctgttaaaacaaacatcactacacttttatttttaagagagtataattattttaattgaaagaagtttttactttacttgagagagatttatattcaataatcttaaaattcaataataccataaacagcccacatgaccaagcccaaaagaaaagcccacctagaccccgttcttcctcttctctccatttctcgttcttctcctctgccgcacgctctctcccagcgccgtcgctcacaccgccgctccccctcacgccagccgctgctccctgcctccggcagccgccccgcagctgctgcctgcctgaatcggttccgtggctcctcatgagtctatccccaaattaaccctagccatcaacccctctccaatcgatgctgctgctggctactgctctcaacgactgagattggaatttccccagccccagcgcccctgattcgagcatggctcagaccagccgtgtctccccaagctcctcttctctaatcccttctctcttttcttctgtgatgtgatctaattggtgttctcttgtgtggtaacctactgtgaatttttatgcttgtgaactagtcctaatgaccaacgtgatgatgctatactcaggattatcctgctgtctgtagggttccagattgattgatttgctatagatggatgatgactatatgctatggatgaatgaatgaatgcttacataatatatcctatgaaaatgcagtactgaaattaaaagcacactaacatgattttgtccttataaatgtgcttgcatatagaataaccgaatttctgaaattagtggcatattagcaggattaaatccctaaattaggtttattgaatgatgcagcaacttacatgttctataatttgataattatggcaagatctgtactatatatagttgaattataacctatgaaatctaacattgaatataaagagatggtgactgatttcttaaataatttactgctattgactatatgtcctgactcttgcctctgtataatttacttgattcgacttattcctgcagggagaaattagacttattgatgacctaactatactatggtttttattcagatattatacgctattgtttcctgagaattttataaactatgatagcatacacttaaactcaagatatatttgtgcacactaaaagatgtcattcttttctctaaatatgttctactcttccaactgacctacaattgatacctattattctgctaatggatcctatatcctctatttagtttctaaactaagaatagatcattgcctacccatttatgctctgtctatttaacttgaaatactagcacaatattgatcttaccttaagctcttgaggttaaatagaacagtgattatttctaactatgcatgtagtcaaaattcatcctatgatagctttactgaacattgatttatagaactatatacagatataatccttagctcaattgcacttgtagatcattagaaataaatcttgctgttaaatatgtactgagatggctggtctgtacttgaattttccttctaagactccactgaatttaggatgatattatcctgtccaactactcataaaaactttgcctagcttattgaactaaggatgcacattcagtaatataccccaacacctagtactagtatatccacagatcaacatggctgccatctactgagttcatttttcaggtttaatggatataactaagggcatgcacacaactcctaaacatactattgaagatgttcctgtagtgcgagattatcctgatgtttttcccgcagaattgccacggatgccacctgagcgtgatgtagagttccgtattgatcttgttcttggtacacaacctatctccagagccccgtaccagttagctcgtcctttccaagaagagttgaagaaacaattagatgatctattatccaagaagttaatccgacggagtgtgtcgccatggggcgcacctgttatttttactgagaagaaggatggaagttggcgtatgtgtgtggactatcgggccttaaatgctgcgacaatcaagaacaagtacccattgcctcgtattgaggatttgtttgatcagttaaagggagcgaaggtgttttctaaaattgacttgcaatctggttataaccaaattcgagtgcgagaagaggatattgagaagaccgcattttccacgaggtatgggcattatgagtatagagtaatgtcttttgggctgaccaatgctccggcctattttatagaggcgatgaatagcatgttgcatagctttctagataattttgtggtggtgtttattgatgatattctgatttactccaaagatgtagaggagcatgagcgtcatctgaggatggtactagggaccctacgagaaaacaagttctaatgtaaactgaagaagtgtgagttctggcttcctgaagtggctttcctagggcatgtaattaatcagcaaggtatctcggttgatccaagcaaagtttcaagtgttgtcggatgggaaaggccgactaatgttaaggatgtgaggagttttttgggtatggcggggtactaccgacgctttgtgaaggatttctcgattatcgctaaacctatgacgatgctcacacataaggatgtgaagtttcagtggacggaccaatgcgagcgtagtttccaacaattgaagcagaggctggtaactgctccggtgcttactttgccccaacctggcaaatgtttcactgtctattccgatgcttcatgagtaggccttggttgtgttcttatgcaagacggcaatgttatagcttatgcgtctaggcagttaaagaagcatgagcagaattaccccactcatgatcttgagcttgcaacagtggtctttgctctcaaaatatgaaggcactacctgtatggagaatcttgtgatattttcactgatcataagagtctgaagtacatcttcactcagaaggatttgaactttaggcagaggaggtggctagaattaataaaagattatgatctcaacattcagtataccctgggtaaggcgaatgtcgttgcagatgctctaagccgtaaggttgttcctctaaatgtgagttgtttgataactgattttgaacggatggatatctcctattgttatgttggagtggcgagtaccgagtcacgagtcattcttgagtccgccataccccaacgagtgctagaggcccaacaacacgatcggttgctgcaacaagttaagaaacgtgtaaaggaaggaaaaactggagatttcactttggattcctcgggagctgtgcgattccatgggcgtttatgtgttccacagaaagctgaagtcaaggaagagattttgcgagaagcacactgaacaccatatactgtgcatcctggggagaacaagatgtatcatgatctgaagaagatctattggtggaagaggatgaaagtggatgtggccaagtacgtggcatcatgtggggtatgtcagcgagtaaaggctgaacataagagttctgctggaaagttacaatcattggaagttcctgtatggccttgggatgatattgctatggatttcgtggttgggctacctcgaactccacgagggaaggacgccatctaggtggttgtagatcgtctgagtaaggtggcacatttcattcctatccgcaccacttattctgcgagtgacttggcaccgatctatacacgcgaggtagtgaggttacatggtgtgcctcgctcgattgtttctgatagggatgctaagttttcttctaagttttgggaatctgtgcaagaggcatttgatactcaattgaaattcagtacggcttttcaccctcagactgatggtcaatctgagcggatgtcacgccctgaagtacccctccctcgctctaaattcataaaataaatcgtccgaagaaattgtttaatttaacctagagagaaaccctaatttaataaatgcaaataataatcggaatcggcatgtggaatttttcttgggttctacatgtcaaaatacgctaacaggatttttagtggaattttcagagccttggaaataattttaatcaattaaaataagcaaagtgcaatattaaatccctgggaaaatcctttttcctttttatcttttcttttccctcctttttcctttttcttgggccgtcggcccagtccattcacctcccgcgccggccttccctcggctgggccggcccaagccggttcctccctccctcctctccccgggtcaccgacaggtggggcccacctgtcggccccttcttcctcctccagccgacggcaccgccgccgccaaaaccgccaccgacgccgccgcttgctccgcatccgcgccccactccgcgccccgcgcccacgtcgccacccaccatccccactcctcccactcgcgcgtgcaccccgcaacggagggatttgaattcgaatctctctctctctctctctccatcccccacgtcggcgagaaatccggccgcctcccggcctcgtccgcccctcccgagcccatataaaccatccccgcgttctcctcctcctttttcctttttccatcggccgctcccgagctctccaccgcgcccgcaccgtgcgcctacctgccgccgccatctccaccgctccggccgcctctagcagccgctagagccgtcgccgcactgcgccgtcgacgccgccgggttcgcaagcttgtgcgccaccccgtccgccgtttccccggtcaatctcgccgccggagcttgcttctcctcgcgctccggtgagcttccacccattgccgccgccttcgatcggttatgtcgtgcgccatggaccacctccctctctctaacccctcccaaccttctctctaggtcctcccggagcccgtcgccgtcgtcctcccgtctctcatcgttgctgttcgccgtcgctcctccctcgcgccggccgagcccctcggtgagaatcggtctccctctcttcctctctctccctttgccgcgccgcccgccgcgtagcgccaccgctagggtcgctcgcgccgccgcttcggccgccgccgccgtctttgcgccgtccgccgccgcctcccgtcgccggttgccgtcgctggcaaccgtgcgcgcgcgccgccgccctcgccttaaccggccggccggcttgaagccgagccgagccaccagccgcgcccctcccgccttgtgccgctgccagtggggcccgcttgccagccgcccctctctctccttgagtcactgacccgcgggtcccgcgtatcggcgccacccctccttgtgctgacgtcagccctgggatgaattattgcgcaataaattgattaagggtttttcttttatagtaataaacacatataatcttctaaaaatcataactaattcatccgagctccgattaagtccattcaagtctcagtaaattcataaaaatgtgtagaatccattaaaaatggttttgcttcctgtttcagtagtcttatagcatgttttgcttgtgtgatttgtttgtcgcgtagatttcggccgtttcgtcgattcgtggtttctcgaagacgttgctgtggttccatcagtgcgagagcaaggcaagtcatgcaatacaattgatcatattgtacccaatttacaaatatcccgaatttctattaaatattgcattgttttacaatatcatgtgggatgggtcctattactcggccatattttgcttaccttatgccattgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctagttaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagtgtaatcttttggaactggttagttcaggtggtggtttgggcctgttgcaacgtggtgtaacgttggacagtgattggttaatatggattaattactacaactgttttactgctttcaactgctgctttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttcccagttgaagatgactcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacagcggaccattcaaactctagaggatatgttgagatcatgtataatttcatggaaaggcagttgggaggatcatttgccgctcgtagaatttgcttacaacaatagttaccatgctagcattcgaatggcaccatatgaggcactgtatgggagaaaatgtcgatccccattgtgttgggattccataggggagagagctattttaggacccgattgggttcaacagaccacagaacggatagcagagatacggtgtagacccccgtttttataacaggaatcgttcgtgtaagcagtaccatttccctggatcaagtagtctggtacacatgagttcatagctgatataccaaatgcacatacatgagagtctagtgcgaattattacatcataagcccgcaggcatagtcttagaacatcagaccgagcggtccggaatacattccaaaagcagagtagataaggcagcggcacgccattgccacaggcaacgaccgtaactaagacctactgagcgctgtcctcttcatcaccctcttggtagtacgcgtagggatccttcgaaacttcatctccggcctcttattaagtttgtatattgcaagggtgagtaccaaccgtactcagcaagccatcacagcaacaatgcacatgataggggtattcaaaggatggctatggtttctttgcgcaaagccagttttgtaattcttttcacaagcctaagacctagcatagatcgatcatattttagtgccagggttcacatttaagcaacgacggttctgtccaccatccattgtgatcccaaggatagcttcccgccattgagtcgtcatgattttctgaggacatccccttcccgcctctcaggaagtggctccaacagcataaaaatcattatgcaatatcccatcccacacaagttaagaatttaaagtctagccaagtgtaatacatgtcccggtgctcaataaccgcgagcacggctattcgaatagatttggttcactcacactgcagtggatgtacactttacccgcactctgcgactgcccaacatatgagcctcgtcccaacacatgagacgtgtcacggcaaagcttttcgataacctcgcattggcagtacccgctccatgaacttttcatcctcatgcactctaggcgtacacagtttctagcagtgagaggagttctggcgcacccgggaagggaagactcacatatgcgttaagttataattatgtttaaattatcacatggcagtcctaccgatggcgacaccactgtagacacccgcctcgcggttctaccaatggctaccccaccgtagagcccctgcctcacacatcaagaaaccactatgcatggatactgcctccgctcagctatttactccgctaggtctatccccatactagaagtgcggttgtacgggggtcgtttcatgcttaacttcatggctcggtccttaattgaccggggacggtactagcctttcccagataccacccaaatcctccgtccgccccagtctaaaataagtgtttaatttcattcctactttcacaaatcatgtcatcattatcatggcaatgtggcgctcatgtctccacatgccgcatctcaattaccttcccaaaggtaattgcccaagcatatagcatttgataaagtatgagcatgcatgaatctaaagtagcatttctaagcatgtgtcatagttgactaaggacttatacgtaattatggttacaaggatttaaaggtaagcaataatcaaggcatggcataatttacaagtaggatgttcatcattgtatgcaatcttatttgtaaacaaaataaattttgcaattgggatcaatatgttcaaagaatagtgatgacttgccttgctcgtagtcctgcgggtcttgaccctcgctcggatccgcaactccctcgggctctacaagtacgtgcgaagaattgatttgaattccattagaattcaaataaaatccaataaagaccaaatcgaaaagtgagcgcgagaggcgaattctatatcaactacattattcgcgaaataagactatcccttatccttagatattttgtttttcctaagtaaattcctaagaattcaacacatttatttatctcttaaataaatctaaattcttaccgcaaattgattactcgtaaagtttaccaaaatagtctataatcacattaaattttgcaattctacgactataattaatccataattaaattctaattattttatattttctaaacttcttaattttactcaaatgcctatttattttctttctctttctttctttttctttctttttctttccctctttcttttctttcttttctctcccttttctccttttcttttttttttctttctctccctaccggcttctcccttcctctctctctcggctcttgtctcctcggggcggcgacggtgaccgagcaaagggagggagggggggctgcttaccgacggcggcggcggcgacggtggcggcggcggctgcgacgcacggcgcggcacacggcgcggcgcggcggcactgagggcggcggcacgaaggcggcgacgcggtggagaggaaagaggggaggaagaggggaatgggggggaaatggtgtgaggtggaaagggggtggccggggaaaatttatagggcgcggggagggggtggctggccctaatggcgacgcgacggcgcgaacggggcttgggacgacgacgacgcgtggcgatgcgacggcgcggggctcggggcggcgacgtgacgcgcgcggcggcactgggctcgaggcgcggcgacggctcctggcttggcgacggcgcgtggcggggcaggggcgtggggcgcgaggcgacaggcacgcgacacggcgacgggacggtggcgtggcgacaggcgacgcgacggcgacgcggtgcggggcgcgaggcggcgagcgcgcggcgcgaggcgacgggacaacggcgcggcgatgcgacggcgacaggcgacgcgacggcgatgcggagcggcagcggcgcggggcgcgaggcggcgagcgcgtggcgcgaggcgacgggacggcggtgcggcgacgggacggtcgcgcggcggtaggcggcgatggcgatggcgcgcggcagcaggcggcgatggcgacggcgcgcggcggctcggggcgcgaggcgcgtgctgcagggggaggggcagggcttagggaacctcgtcgagcacttacagcgcaatgaacagtgacttttttctatttttcctatttggttgtttttgctattcaaatcttgtcccaatatttctaattttcgcacaaatgaggttcccccaatgtttgagttattctaatcagagggttcacccgagattaatattattcctatttatttttatataatttgcttgaatttaattagagtaaattcttatcccattgcacctaaatttaattgttaccaatatggtcgcgataatattttatttatttccaacctcacctaatctttattttaaattatattttaatcagttattttgccaatttaattttagggtttattcctaattaattattccttattcacgatcagtaaactttgaaaccaaattccaataaaataggcaaataaaatcagcatgatgcaatttattaaaaagtttttgaaggcccatatttttagagttttgattttcgttggtcgaattttcagggtgttacatacggcaacacatgcttgcggctcaaagtagacagaagagctacgccgatgtcagaagacgggaattagagtttgaagtgggtgatcaggtacttctaaaggtatctcctaccaaaggtgttgtgagatttggaacgaaagacaaactcagccccaggtatattggtccattcttgatagtggaaagagttggaatcctagcgtatcgccttgagttaccagagtccatgaaaggtgtacatgatgtgttccatatttccatgctgagaaaatatttaagagaccctgaacatcatattaccgtagagtcggtgacaattgggcaagacttgacatttgagtctcgtcctgtaagaatattggaggaatctgagagggtgctcaggcatagaactatcaagtatgtcaaggttctctggacgcaccagaccgagcgagaagccacatgggaacttgagtcacagatgcgggagaagtatccagagttattcacgtctggtgagttatataagtcctacctatgagttcctttccatacttgtccaaggtataactggacgaattcgagggcgaattcgattgaaggagggaggaatgtaatatcccgtgttctagagtatgattgggcgaattcgagggcgaattcgattgaagaggggaagaatgtaatgccctagggaatattagcacaaacgcgcaaaagttcaatttttaaaccgttatttgaataggcgatcaggaaccgtagatgcgtagagctcgcagagtagtgcaaaatagactataagtttataagtttatagtaatcggagtccgatcgaagttccggggattaaaacaatgtgggtcgttagatcttttcagtctctttatataaccaaccaaaagaaaaaaaaaaggaaaaaaagggatcgagagatcgatcctgtagccctagccgccaggctcctgcgccctgccgctcctgccgcgtttctaccaccaccggcgccgtctctacgccgccgccgttggtgcagtgtcgccggtcgccaccaccaccgtcgccgctgtgctgctgctccgttttctgctgctgttcggtggattgatttgcagagcagcaggtttggttctgcttcttgatttgtgtttgtctccagcgtggtgaagtcccaatttctcctactgctgtgtgtcctgaccagctacttcgtgagttgctgcagtagccaacaactagggggcagggcaggaagagcagagaagtcaaggaattgggaggaagagaggcaaggttggggattttattttccaagatttcacaaattgatctcaaagttgatttttctccacagtaaggctgtaagggtaactccttttagtcctagaaattcaatttgcacgtgggaatcgattaaatcgccggttgagagtgttcatagtcgctatttatgggctggaaaccgtattttcaaaactggcgttaaaccatcaggattctggttagttgtcctaaatatagattgtagtcagcgtcgatatctttccaacggtgctagtttcactcgattccgataaacggtttaggagaaacagcaaaaacagtactgctgaccaggtccagaaatcaggacagcagttcgtttttcttaatctgggatttccagaggcataatctgattttgtgctcaacatgaaagttgtagacaattttgtctagatgtctgaagttgtattatttgctagtttccgttagacggtttgtgagttacgcataaaacagtaatggaacaactataggttatttaatacaaatcggtaaaaggtttatatgttctaggtttcgattttagtaaatatcccttgtaaccatcgttagttgaatatagtggtttatgcgtagttttgctccacaagtgtggagggttccaacgttggaggagttgagtcggagtatcgaaggagttaaggcaagtacaaaacggacttatgtaatggacaaactgagttgttttgtttggcttaacttgcataattattattcaattgcttgaaattactgattgtatgactctgacgttatgctacttattcgtgtttcgacccatattcaaattcatgacgttattcatgtttcattattccggatgttctgtttacattattcaagaaccatgcgtagacatgggagtgcaatttgggtctttattcatgatccttgagaagcgctgatcacgcttgctcggcttaccggtaatgctaagaggatattcacacctgcccgagagggaactactatattttgacttttttgatttaaagtaaagtaaatccaacccttcatattggtttcttaatgcatatatcatgtgtatgttttactagttcaagattgtacttgctgagtattctttacttactcttgtgtttaatttggtttttaggtacctaatgacatcgatcaacatggggcgggagtagcacccttggactacacattattattgcacacaactgaaatttagttttagattatactttgctcagcataagttttgcatagaagttgtaagggtcattaaggttctgattcttatttttcacgtgggatttgtggagctaggatggtttggattgtgtggattatatcggtattgacttttcttataactgcctgtcgtggatgtccatatttttaggggagactggcgaaatttctaataattttaggattagtttttgagtgtattttggtatggcattctaggtacgtggttactgggggtgttacagcgtcaaccaagaatcatgccatgatgtgatttcagttccattttaatcttctaattacctgccatgattttaggtgactgatatctggttcccttctctagttctcttgttctgcagctgctcctctggattctgattcaaggattctcccgatggaactctaatttctcctctttaaactcgggcacctccagattgatttgtactatggcatactaatcctggaactaaaactcctttctttacttgaaactcaggtacttcttcttggctcttgctctactggtactgcttcctgccatctttcttgatctgctgactgctactggtgattctcttcctcctcttgaagccgtccccttgctgatctttgctccatcttgcttcttgacttgagtttcttgctccttctaaatctgaaacccttgttcatccaagaactgcacacccctgcttctccttttactcctctgacctccctctctctcttactgattgcttttactatggatgctatgcagctatggttaattgatgtattgatttgtgctggatttcactgagctactacagctgttgttgctcttctaagcggagccatactactctactactgttgcaactgctgctaatgctgttcctcgaggttgtctcccagccaaaacaacatgatggctagtctactagctaggctaatatttgtatgtaatttgtgagggcatggtgatgcagctgcttgcatgtcggtttggaaaaggatttgctgccacatttttcacctaatcaatttggggtgaaaaaggtaatttcctctttgatgtcattttggtgattacatggaaactaaagtcagtaaattataattactgcaggaaattggttttatacgtatacctatggaattcttacattctagtccttaaggtttcataatatttaagattttactagagctcgagggctgattggtaattgctctagttttattttcattttcacaattcctctattgatttgtatataatagctatgagttgagtatgttacagaacatttgcaaagcataatatggatgtatgcatgcatgcatgtatgcagatatacactgatcatttgtgaataaagtgtcgtaacttctattgtgatttttattgtgcatatgtgtatctctcggtgactactaatgtgcgctataattcatgggtagcaacgcgacaatgaacaaaaactaaattatcccactcctcaccagattagtctaactaacaataaatcaatgatgcatatggatatgacttgataaatagatgacaaggaaacgatcgaaaaaaaatcatttaagatccataatagaacaacaatcaacatatttataggtcctagccagcatcgtggctcaatcgacaccgctctcagccagtgtgaccaagtcattagcgtgactaagactatagctaaaacccgggatgttacatcctacccccttaaattaagtgaataattttattttcaatacatcctaccccttaaattaagtgaataattttattttcaattgttgaagtaatttttttttcacacagtagtatgtattccttagtcctatattgtttgctaatcaactatgacttattaaggatattctgtaacagtctattacagaagtaaattctaagaattggtaagatcactatggttcagcaccctacaatctggcgtatttgtttagaattctagtatgtcaaaactgatagtatttccaatgatttttaacacttttgacaaccttcctggaatttattcttttctctttttttttaccagtcaatctacccaaacaatcttaccccaacagtataatctctaatatggtttcggattgaagtaagcatggtataagtagttattgttaattgaattaagaaaaaagatcaatattccataagacatgatatatgttggacaccttaatattacaatgtgatgcagaagtttttttttaactagggtccttagattaatttgcaaggcaatgatgaaaaatgttcaatcaaaatatgtccttagattaatttgcaaggcaatgatgaaaaatgttcaatcaaaatatgc

SEQ ID NO: 66672 - DNA, 957 bp, Oryza sativa
ttttattgaacattcatttgcttcagtacatgacgaattgagcgttttacagctacgcatggaagctgttctctgcttcgtgccgaaagtaaactgatcaataaaagacaggctactagtatacaataaagttcctgtgaaattaatcgtcccactctctttcagcacgtataaacgagactgagagtagtactacaaataattgtgtgatttgtgaccaaacggggagaagtgccttccccagaacggcattagggcgacgagagcctacggctacgtacatgcgcaaagttattagcaaatgcacacggaccacacgtgcaatattcttgagagtgattggagctaatatctgctccattgctaatatgatctacgtgtccgtctacatgtccgtgtcagctacatggatgaaggggagaaaggggtaagtgaagcgagtttgtcacgatttgcacagtgtacctaccgcgtgtgacgttggccagcgaaagctcagtcgatcgatcgacggacgacgacccatgcgccaatgatagtacttgccgtagtaccaattcaccagggagacgagagtacgagacgcagtctgcatgcatacataatttcgacgacctgcagatcgattaaaggcggccaatgcaagcttggcgtttgtccgcgccggcactgtttgcgttagctgctatagctaggctccgcgtgcggccgtgcagagtatggggtggcatactgctacagtacatgctacgcgctgtgccgcggatcgcgacggcggcatgacgacgcgcgctgtatcaacctcgataaatcgtcgcgattggtaggagagggatcggagggagccaatgcaagcttgccggctgtgcgcgatgatggggtgaaaacagatacggaaattcccgatcgaccgaacgacgttttcgtaatatgggtaccgagctcgaattcgcccta

SEQ ID NO: 66673 - DNA, 14371 bp, Oryza sativa
ccggctcacgggagagggcgaagatgacgtcgacgatgacgtcaccaccggcggcggcggctcggcggctcggacggcgcacgctcaccggcgaacggcggcgctttggcacgaactgaggacaccaacgggtagcggacggcacggcgaactcaccggcgaccaaagcgacggcggaagaccaacggacggcgacggcgacgaggttgaaacggcggcgctcttcggcatgacgacggcgacgatgctccggcggtctccgacggtggcgaagcggcggacgaggacggcgacgacttggcgagcacgacggcggtcttcccgagcgacgacgatgactggaacggcggcggcgcacggctggagcgacggcggcgacggcggcgctagggcacacggcgctagagcgctacgggcgacgagaggcgaaggcgagggtggcggccggtagaggagacaccgggggtccttttaaaggggctaggaggcgacggcgaaggcccacggcgaccggcgacgcgaaggaaacttcgggttcgggagagaggaaagtcgatccgatttgacttcaaatctatcgatttccaaaccgatttagccgatgattccaaaagagaaaaggttgaggagatctcgaggatcatttgccctcttttgattcggccggagaaggaaaggggcggccggatttggaaaggaacggcggcggcgcgaaactagggtttcgggcggcggcggccggaggttgacgacgaccctgacaggtggggcccacctgtcagcgggagagagagaggagagcggcggcttggactgggccggctgggctgaagagagagagagagcggttttgggccgactttcggcccaaagccaaaagagactttttaaaacctttttcaatttaaattatttatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggctcttaaaataaattctaaaaattccatttaaacaacaatttatatattttgaattttcagggtgtgacaggaaaggaggagcgggccggcccaggaaggggcgccgagcgcggggagagagacgggccgacggcccatctagagaaaaaagaaggaaaagaaaaagaaaaagaaaaagaagaaaggatttttcctgggatttaaaattgcactttggtgatttttaattgattaaaattatttccaaggctctgaaaattccactaaaaatcttgttaatgcattggaaaatggggaactcaagaaaaattccaccacgctatttccgattattaattgcatttattaactagggatttagctctaggttaattaagataatttcttcgggcaatttatttaaccaatttttaaagcaagaaaaagggggggatacttcagggtgtgacacttctccaacctctccaactaccagaatggaaatgggatgaaattgggatggatttcatcaccggacttccaaaaacctagggcggttatgattctatatgggtagtcgtggatcgactaaccaaggtagctcggtttattcctgtgaagaccacctatggaggaaacaaactagccgaactctacttcgctaggatcgtgagtctccatggcgttcctaagaaaattgtatctgataggggaagccaattcacctctcacttctggaagaagctccaagaagagttggtacccgattaaatttcagcaccgcgtatcacccgcagacagatggacagaccgagcgtctaaatcagatcctagaagatatgctccatgcctgtgttctagattttgggaagacctgggataagagtctcctctatgccgagttctcctacaataacagctaccaagccagcatacaaatggcaccctatgaagcgttgtatggacgcaaatgccggacaccgctattgtgggaccaagttggggaaagccaagtgttcgggaccgatatcctgagagaagctgaagctaaagtcagaaccattcggcataatctaaaggtggcacagtctcggtcgaaaagctatgcagataaccgacgccgtaacctggaatttgcagtggatgactttgtgtaccttagggtcacgccattgtggggtgtacacaggttccaaacgaaagggaagctagcacctcggttcgtgggtcctttccgtatcatcgctcgacgcggagaagtcgcttaccagttggagctgcccgcatccttgggtaacgtgcatgatgtgttccatgtgtcgcaactcaagaaatgtcttcgagtgccatccgagcaggccgattcagagcaaattgaagttcgcgaagacttgacctacgtggaaaggccagtgaaaatcctggacaccatggagcgcaggaccaggaaccgggtaatccgtttttgcaaggtcgaatggagcaaccacgctgaggaagaggctacttgggaacgtgaagacgagctgaaggcagcccatcccgatctcttcgccagttcttccgaatctcggggtcgagattccgtttaaggggggtaggattgtcacgtcccaaaacgactctaaaatatatcttttaaattatgcctagaataattaaaatccttgtgaaagcctccagcaattaaaatgtgcaaagttaaaagtcaaatcaggcttagaggatttttgtatatttcctaaaagcctaaaatgtgtaaataaattttagtggaattttcagagcacaaataataattattaagaaataaacaaagttgaaaaatttttataaaaagaaaaaccctaaaagtccccctttcctcccttgggccggcccagcccatctctcctcccccctctctatctcctctccccgcggcccactcggcctctccccgcgcgcgcgccgctgacgggcgggcccgcccgccaccctcgctgacgggtggggcccacccgtcatccccgacctcccgccgcctcgcccgcgccctagcgctgccgccgccgcgaatcccgccgcctcccgccgtcccgcgtgcagtgaagtagggggaaatactcctcatgattccctctccctttccccccatttttccctccctctctcgcgttcaaacaggcggatttgcccccgcaaatcttgccggcgccattgatggcggccgacctcccgcgccggtttccttcccctccggccgctctctcccccttccaaccctatttaaaccctccccgcacctcctccgtccatttccgcctctcgccgccctttcacctcgccggattcgagctctcgactttgctctctctctacacgatcgccgcccatcgtccggccgtcgtcgtcgtcgccctggaccgcctcccacctcggggccgcctccttcggcttcgccgcatcctcgccgacctcgtccacctttccgtttcggtcgccgaccgccggagcgctgccgaccccgtcgacccgagccgcactgccgcctccctccgcttcggccgcctcctccgtcgccgccgtcgccccggggtggagccgtggaccgtcgcctcctttcccccttccctcccctctctcggccgccgctccgcggcgccggtggtcgccggcggcaaccatcgaggcgcgggggcgccgcctcccgccgaccgcgccggcttggccgccctcgggtgcgccaagtggctgccgcgtggggcccagccgtcagccgcccgcgccctcgggtgcggctgacgcgtggggcccacggcgccggccggtgcgagcccgggtgcgcccggtccaccgtggaccatgaggctgccgcgtgggccccactcccgtggacccggtccgcgcgcccctccccctcggctgacgcaataaaccctttttaaattaaaatttaaatgaagaaattcgcaaatattcatttaaagagcatgtaaacttcaaatggccataacttggccatttgaactcggaattggaccgttcaagtctctaatttttccttaagaagtcaagaacccatttttgtgctttgttcctgcttgttatatggagtttattaaagtaaaagcccttttcttttccgttggtcgtgcagacgctgcagcttcggaagatccgctcttcgtggaggttgaagccaacgtttgggaaagtgagcaaggcaagtcatatcatccttgaacatattggatcccattttataaaattattttgatttaaattattgcattatcgctttacttaaattcccgcgttatcattgttttatttagccatgcctatttacctttgttatgaacttattattattgttattgatattattaccttattcaccctagattaaacaaaaccccaactagtggacactctactcatggtacccctagtatgaatttaggtagatgcttcgctggttaattaggcaacattaggtggttttacaactctagactttgggaatattctcatcacctggacactatggaatggatggattattgtggaattggattcacacctccccctctattcaaaatcctcaaaatggttttaggctggggtcggggtgcatggttttgatagtagcacctcggccatataaggactggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgaacaatgtacccaagttagtgttttaattcttaaaaccagcataacaactaaaatatggaacggttggcctgggttggcttgggacgagctgagacccagggtcgggttgccagttcggtctgaatcatcgtaggccttgggttaaggcaggttcgtgtgggttcacggccttgattaataatcttgtatagctctaggatcgtctttataaaatatctttggacaactaagtgtcctttaaatcctgtttactacaaaccctaaccccttatattataacccccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccatcaagcgcctgtggtcgtcgccctagtcttccgctgtttttcgtttgtcttcttgtgtgctgggccttcgccgcccatgtaataaattaattatttacgcttccgcttgttaaactctgaattgtatcaacttttggtgtaccttgcctcctgggacaaggaataatacacgcacgtaaggaacagccgttgggttatttccggtcgtgacaattggtatcagagcctccttgaccctaggacgagatttagatcccaagccttagcaatattttcgaaataaaaatccattcttatttgtgaaaatcctctagtctctctccgtcttgctgcttcatttatcatcaaaagctgatccctaaaatgtttatttctttttctcttttgtctttgtttgtagatggccggcagcatcaaccgtcgtggcctggacctgactggcttcattttggagctgcggggcatgtgcgttgtcctggggtatccgcatggagtggactaccagggcaagcagctcccggagcaggagggtgacgatgcagagccccacgctgcttgggaggtcactgcagtgatcctcactggctcacccgagaggacttcgttggcagtcaccgcgggtggagattctttctccgccgcttgctagagcgccgtgctcctcgccatcggcactcttcaccagcgctacctggacgagttgcagcactcgccctaccgctaccaccctcgtcgaggaggagcccgcgactacgtgtcacgtccgataaattcatcccgaaataaaaatcattctctaaaaggaataatagaattaattaaaattcgaaaagaaattggcaaacactaaaatacgtacaagaaaaattcaaatgtggcctggagaatttttgttaaattctccttggtctaaaaggagccctcaaattttagtggaattttcagagcacaaataataattaagaagaaataaacaaagttaaaatgattttataaaaagaaaaaccctaaaaagtcttctttcccccccttcccttcttgggccggctcggcccacttccctccctctctctctcctctcccccgcggcccaatcggcccctcccgcgcatgcgccgctgacgggcgggcccgcccgccaccctcgctgacgggtggggcccacctgtcatcgcctacctcgcgccgcgcccgccgccgcccgtgccctagcgccgccgccgccgccgaatccgccgcatcccgccgtccccgcgcgccataaagagggggaaatcactccccgtgattccctccctctttccccccactttcccctctctctctccctcggattcgctcggatttattcccgcaatcgtcgccggcgtcatcaatggcggccgagatttccgcgccggtttccttcctccccggccgccctctctcactcccgtccctttataatcgctccccgagcctctctcctccgtttccgccactcgccgctcgctctttccgtcggattcgtgctcgcgccgtcgcaccttctctccgccgtcgccgccgagctccggtcagccgccgtcgtcgctccggacttcctcccgactcggcgtcacctccatcggcttcgccgcgtcgtcgtcgacctcgtccgctcctccgtttcgcccgccgaccgccggagcaccgtcgtcctcgccgtcccgaaccgcgccgccgtcttcctccgctccgatcgtcgtttccgccgccctcgtcgttccggggtgagccgtggaccgctccgttcgtttccccctcccctcctctctctcgggtgccgctccgccgcgccgttggtcgccggcggcgcccatcggggtgcgggtgcgccgcctcccgtcggccgtgccggcgaggccgccttcgggcgcgccccgcggctgccaggtgggcccggccgtcagccgcccgcgcccgcgggtgcggctgacgcgtgggacccacggcgccggtcggcgtccgccgcgtgcgcccggtccaccgtggaccgagaggctgacgcgtgggccccactcccgtggacccggtccgcgcgccctctctctcggctgacgcaataaatccggtttttaattaaaatttaaatgaagaaattcgcaaatatccatttaaagagcatataaacttcaaatggccataacttggccatttgaactcggaattggaccgttcaagtctctaatttttccttaagaagtcaagaacccatttttatgctttgtttctgctgttatatggagtttattagagtaaaagccttttcttttccgttggtcgtgtagacgctgcagcttcggaagatccgctcttcgtggaggttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattattgttattgttattattacctcgttcaccctggaataaacaaaaccccaactagtggacactctactcatggtaccactagtatgattttaggtagatgcttcgcttttaattaggtaacattaggtgattttacaactctagactttgggaatattctcatcacctggacactatggaattgttggatcattgtggaattggattcacacctccccctctattcaaaatccccaaaatggttttaggctgggctcggggtgcatggttttgatggtagcacctcggccatataaggaccggtcttcgggcctctgttgcaaagcattaccgtacttccacatgtctagtgggtaaggcttagtttgtggctcagtctggttgtaaaaaaaagtacacggattagagatggacgaagtcgggggtcgatggacatctctaggacaaatgaaggctacacgggctgcggttcggtagtcgagatgtcatggcacagggccggtgtcctgctgctaggggctcagtcctgcttacctgtcccggaggttccggccgtaggtgggattgggtcggtactcttgtctatagctaggatgggttggaaactatgtcacgtctttcgtctgtataccgtggtggtatgtggcacgtggttgcacgtgagaaagatgtgtcttgtgggtaaagatgtacacctctgatcagagtataatctattcgaatagccgcgccctcggttatgggcaagccgagcaatgtacccaagttagtgttttaattcttaaaaccggcttaacaactaaaatgtggaatggttggcctgggttggcttgggacgagctggaacccagggtcgggttgccagttcggtctgaatcatcgtaggccttgggttaaggcaggttcgtgtgggttcacggccttgataaataatatggtatagttctagaatcgtatttacaaaatagctttgagcaactaagtacctttaaatgctgtttactgcaaaccctaaccctttatagtataactcctttgtactcccttgcatttattctgcacttgtgggtgtgtcttgttgagtacggtggttgtactcagtcttgctcaatttttcccgaacccagaagaggagttccttgaagatgaaggctttggtgtctagctcgtgcctgccgtcaagcgcctgtggtcgtcgccctagtcttccgctgtttttcgtttgtcttcttgtgtgctgggccttcgccgcccatgtaataaattaattatttacgcttccgcttgttaaactctgaattgtatcaactttcggtgtaccttgcctcctaggacaaggaataatacacgcacgtaaggaacgcccgttgggttatttccaggcatgacatgtgtccacactattaatttggtatctctataccatgatccataagacattatcatcaattaatacatgtgttgatcatataaacgtatttgttccacatatgatatttgatcagggatcctttagaaatagcaacacataacataaagagtctgatgaaagaatcacatattcattaaccaataatgagtttatctattttaagaaacaaagtcggataaatatgtaaacatagtgtgtgacacgatcatctctatgattgcctctagggcatatcactaacactgaaaacctttcgttttgcccacgagacggttagttatctagaatcggctccgctaaccggtttagttaacaaacccatcttgctttagcttttgctagatcgaggtggttggcgactctaggatcaccacaaggcgtttagatgctgcgatcgtgtgcttgtcaacttgtcacaaaaagttgccaacagtgatgttaacggtttattagtgaaaaacataatttataaatacaagttttatatttgtattctaagcaatttaaacgttaatgctgaataaaaaactccattaaaagtactctaaaatcaagtctaaaatattgaaatacaaatatatagatggttaaatagaaaatttcagcaactcaaatgcgaaagcaaaacaaaagatgaaagtactaaaatagaaacataagaaccgaacaaattgaatgccgcgcgtggataatctttgcaactatgcaacttgccatgacaaagagtgaaaaacgcagagattatatcagcacggaaacgagaggagacttcagaaaacggcgaaggatgctgcccggaaaaaataaactcccttaaattcctatgcatatcttgtgctccgcagaccaagtaaaaacttaattaagcacatgcatttgacgccttttcagtttccaccatatccaaatgttcgttctccacaagtcgtacgtgcacggctcaaactcaccttttttttatttcaggtcaaatgtcctggtaagttaaatagactgcatgtttaggagaacaatacccttgtgtcttttacgaaaacttttcagactagacctctatattttccttggcacaggaaccatactcgctctaagttagtagcgcggaatcatcttctctcacgcatcgctaatattatattatctcacgaccaatgagtttaaatggaatattctaaccagtgatgggaggttctcggttaaatctctttatcttgcattggtgtagaccggagtttccaatagacaaaaagaatttagaagatcaaagccctcctaaagattaagatattcttatggtacttacgtcgggcagtagttttaacaagagataatctgattaaaaagaataggaggaaacaagacttgttcttaatatcacgaagagaaaactgttaaacatttgttctttgattgccgttttgcccacgtggtttggtccttaatccactttgcttgtaatattactttacataatagtataactcgtatatatgtttgggtgtaggataagaagaaaaccacacaatttgtggcaacgaaaacaaatgttctttttcctaaattttttgtccaatctttgatcaattatatcattgtatattcctctcaaaaaaattatatcattgtgttgtattcgttaaatttcactaatctataggtattttaatcaaattatcacaaaactatatatttaacaccaaatttatcttaaacctatagatttaaggcctacatattttagagtttaaatcctagcaccattattactttggagctataaacattgtagttttgaactaaattttgggttctggtagtgagtagtgactgtatcgtcggtgtagaagcattagccaaatacttcatggcattataactcatttttataagttagatacataacgatttatgaaagcacggtatcaatttgaaaaggtcgtctatcaaatgattaaattggttccggattccaaattaaaatacttgctacgtatgcagtatgtcgttatcaaacgtgatggatctggttatccttattagcacgaggggttacttcagctttgtgggcgaagttaattagttgaccataagttttaacgtttacttgtacacataccgtgctttcatatctttatatggtacgcgtacacacataccgtctagatgacctcttttacgtatatatataagttagaggtcatatctttaattaacaagccacgcagtgttgtttcaggggagagagagagagagatgcgttcttgcggcatcagaggtgtcattcgccaccatctggcgtggctggtgctaattttgtgctcatggcaggttgcagctgctcaggctcagcaagcaccaaaaaccgatccagtcgaaggtaggcgtatagatggccaaatgggccgcccggcccggcccggcccaagcatggccgtgcctaggccaaggcttattgggccggcacggcccgaccaacacaccgggccgtcccgtgccagcccacgggcggcatccacggcccaggcacggcccaatactactcgggccgtgccgggccggcccgaaggcacgatggtccatcgtgcttcctcatagaaaaagtctatttttggtcgctcaactttgtgggctgtgtttaaatggctggaaaataagtctattttgtatacctcttatcttgggccttgccttatatgattatttaagtctattttaaatccctatattttttttatttgaccgggccgtgccgtgccggcccagcgtgccgaaggtgcggcccaagcacggcccggctgtcgggctgggctggcacgggcacaaccccagtcaggccatgccgtccttggccaaacagccgtgctttgggccgggccgtgggccacgggccatatggccatctataggtaagcgagcaattaatcatgcacgcgtacgtatatacgtatcacgcatgcatatgcatgtctctctagtttggttttcctccatgtagctagatcgcaggagttgtaatttgtggttgataacattgatatggtgtccccctcttgccgccttgaaacgaaagagttagagaaatcttatatatttatataaagttctatcctatatatttttataaagtccattcctaaccgtagtaattattactatttatatcttttcttattaagccacatcatccgaattgtttttttattccttcgatagttggtagtatattgtgcaaattatctctcatattttcctatcttattaagtcatatcaccttagttttatatttaagatgatgtacttggccacatcactattgttgtgattttaaatgaccaatctagtttaaattattataaataacatcttaattgtacgtagtatttttctacagtagataaagatggttaattcattaatcgcctagctagcttccatccgcatgattaataatggagagtttaattaaccatgcagcggctgctctgaacacgatactggggagatggggcaagaaggcatcgccggagtggaacatcagcggcgagctctgcagcggttttgccactgataaaactgactgggattactaccccaacatcaacccgttcatcaagtgcgattgcacggacagcaacaacaccctctgccacattaccagactgtacgcacactctctttatctttatcgtggtttcatcatatgtgctccacgcagtgcctgaaagagcccatgcatacacacgtatatgctgcaagtatacaaattaaaaaacatatatatataaacaccagattattaatattaattagtatctccaaggaatgcgtagaggaatcagaaaagtctatcctaaattcggtacatatcttccttaaaaaaattgtacatatctgctggacccaaatggaggtattaatttggtcctccggctgtatatatgtatcccaaacacagttctcttatcagtatttttacttgttttttatgcaggagggtaactaatttgaatgtagttggtcaaatacctacggagctacagaatctcacacatctagtggatctgtacggtatccaagacttctcttcttaattaatcttgctactagtcgcatcgggaaattcactagcttgtaattagcgaattaatttgtgcattctcgtctagtaattagccgatatactagaaacgacaattcaataatccaatataataataacattagatattacttacaaataaaaagaaaacaatagcttacaaacgatatagcattagcttcagctctagttccacgcacagctcaactgagatataagccagatgtcttcttcctcaaaaattttcttcaactgagatttgatgattattgtatggcgagtacatggaatactccataagccacacagaaaaaatacaggtgcatggtgatacaaaggaaggtatgatagggttcatttgcaaaagcaacattcagcaaaacaatataaaatcaacactgtacaacatacctatgctccataggcccaaccatctctaaacaaccaaacccgactacactgactaaagtccatacaaagagctaacaaattatcattaccaatttatttatcattaataagtagtgtgtgactaatcacaaaaaaaacactgttaggcttgcccataaccgcgtgcacaactattcgaacagttttactctggccagatatgtactaatgtacccacaagacaattccacaacctgtcaccatgtcatcatgtgcccacgcttaacatgtcaccatgtgtgaaattctaacaagaccattcgcatagcacaactcaaagtag

SEQ ID NO: 66674 - DNA, 26868 bp, Oryza sativa
aggaagaagatgagaggggaggggggagtaggtggagctcgtcggggcgggcggccgccactgccggacctccccgtaaccccgtgggccacggcgcttggaggctggagagaggaggggagacagatggagagggaggaagaagatgaggaggtgagtatgacatgtggggcccacgtgggtcccacaattttttattattttgtctgtgaagatgacatgtgggtcccacgtgctttattatttttccagatcgaattggcacgtaagcgccacgccagtgccatgtcagatgaagaccgggtcaaattagccacgtaggcgccatgtcagccaaaactgctattaaaaccgccgagagatctcgtttgcctggttttcataagttaggggacggatcgtacctggttttgtggttaagggatgaaaatcggactgggtgacaaatagagggactcaaagtgaacttattccgacgcctctactagatgagtgaaaccaatttaaaagcgctccatcggccaaagaggagccgagatggtggtcttggacgctatctagactgcacacaagcttatgagcccatcctccacagcaagcatgctatggccatcgaccttgaggccaacaacaggggaagaagctgcccgagcagaacgctatttttgggagcggcggcttgtggccaaatcatgccatgtggccgtgagctagccaacgatgatgatggctaagggcgagccacttccatcttgccataaacgagacgacgactccctcacctccttcctttatgcccctctcccacccatatgtcctcctctcctctgttgctgtggcccccttcgtgctagccacccaccacgttgttagccttcccttcctatggatgggctggcgagctcaagctcatcaggacaaataggctcccacttgagcgccaccttcgtgatcgcacagtctacgattgattccagtctcgatacccctcaaccaagatcccttccgttactgtcggtcaccggcacacactccctcatcggctctatcctgccatggaagttgaaagggagaacagggtgagagtgagggagagagtggggtagagaggaaaagagtaaagacagagagagagagctgactgatatatgggcctaatactttttattgttttttctaactggcatgtgggacctgttaagtttttttgttgttttatttttcttctaaagccatgtagacattacgtaggataaaaccaccatctaaaatagtcaagggactcaaattgcactaaatttagaagttgagggtgctatatatctgattacggttaagggctgtgaaaaaactcgatctctcttgacggggtctaaagtgaacttttttccatttaataacctttgctttgcctctctgggctatggcatctgctccacttcatccaggcccactttaactaaacgagaagaggccaaagcttaaagctgtacttgcagtatcacgaacagtcatgagctatgatatcgtcccgtatcatggcgtctgccaagtgccaaccatgaactgtctgccctttggcactactgggggttcagctttccatacgtgccatctggcggtgccaagtgtccatccactgccaaagaccgtgacccggcgaagtggcgaacaccaaaagccaccggatgattacccgcgcagctgtacgtccacgcacgcgcaccgcgcaccatccgctaattgccggtgatcagctcgcaggcggcgcggcacggcatgtgcgcgtggtcgactgctcggttcaccgcaaagctaatcacgcacgcgttaagttgctgcgcccaactgaagtcgccgagagcgagaggtgactgacgacgcgcgcggggcgcgagagatcgatcgaggtgaagcgtcgggcgcgcgaggtgccgagagacagtagtcaccggccgatcgaggtgaggcgtcggcgcgcgtcggcagcgcctgcacgggaaaacgagccgaaaacggcacggcgtacgtacgacggtgcgcagtcgtagtacagcgcagctggcagccgacgggaggggcggtcatatgtcacgcgctcgcggcacttggtgagtgggactgaaaagctcgccgttgtgttattccggaggcccatgcctaataggttgttttctccggtggaacgtaactttctgcgttggacttgttcgtgggtagttctaatgggcgatcgatcgccctaccgatctggtagcgatcggtagcccccctcctcccttcacctggttttcttttttggcactgcattacttttctattttaataaatttatacgcctaaagtttatacgcctcaagtttacacatttaaagtttagagatcaacaatttataagtcaaaaatttatatatctgattcaaatttgaatttgaattcaaatatttttttatatatagtatttctatacatctaaagtttatacacctaaagtttataagtcaaaagtttatatatccgattcaaatttgaatttgaattcaaattttttcatatatagtatttctatacatctaaagtttatacacctaaagtttatagacctaaattttatatacccgattcaaatttgaagtcgggtatataaacttttgatttataaactttgggtctataaactttaggtgtataaactttagatgtatagaaatactataaaaatatttaaacttgaatttaaatttgaattggatatataaacttttgatttataaactttgggtctataaactttagacgtataaactttaggtgtataaattgactaaaataggaaagtaatgcggtgccaaaaaagaaaacatggagggagggaggggggaggggtggtgatcgctaccccctcgcccctcgcggtagcgattgatcgtgcattagtgtttccgcttgttcgtccacagcctgagggggagaggcagcgacggtccgatgtgcactcaattgcatcttttcaaaccaataaatataaatggattattctggccgattttgctcttagagcaagtttaatagtatagcccactaatagctccaattcatctatagtcaatctaatatccaattcatacaatagttgcttactatactattagtatatgatcctacctgtcatacacacattgtgtcttggagtccgtgctgcagctggctacagatctgtagcccgctgctcttctctctcttcctttatctctttaaaatatgtttatagctagctggcttatagtctgctattgtacctgctcttagataacttcacaatgtacacggctatgcgttggattttacaccctcatttcacattataaaatattttgataccttcatttctcattagatttgctaacatcggtacaaatttgataaatatatgaaggatatacatggatacatgcataaatctattgaaatcaaaacatcttatattataaaatagagaaaatactataatgtttacggtaaaatatctgtgcaatcacgatgtacagcgacgtgatccactcatcgtagagttatcaggacgtgtaccggttgtgtgctcaattatcgtctttaaggctaatcatgtgccatacttctggagtacagtgcaatccagcatgctctggtaccacctccactaggtccctttgtatatcttggaattttttgcattcacagcacgacttaggccgagtttagttttaaactttttactttaaacttttaattttttcatcacatcaaaactttcatacacatacaaactttcaacttttccgccacatcgttctaattttaacaaaacttctaattttagcgtgaactaaacacacccctagttgtgttccaatatattgcatcacatttgcttggtcatcgaacggaagcttgcagtgtacactgcattgccatatggccacgcatgctcacatggattagaggaagaactggcggtcaacttgattcccacatgttattattcatcaccgttctgaatcgacaacgattaattacctgttcacgtcgatcacagacgggaaacgaagatatttttttggtattcaaagctgcaatgatcactctaaattaatggaaccatgtgaagaatttggatcaaggatttaaggtgatgctgaatatttatgtactatagatatgagacgaaagactcgaaattttccagataaataaaaagacctgggtcgctgtccattttggaatatctctctgaataagactcctagcttagatccagatcgagaatggtttcatccacacgtatgtgccttatcaaagctttcaaacgtgcttcaatacaaagggtatccttcacatccactacagtagcacgcacctgtatgatttattgatttggatttatttgacccacggccaaccagatcagataacttggaagctcttagtccatggtgaatacacagtatccactacagattcgattttcccatgcgaccaaaatcgaattttgtaagcgggtgggtggctagcccgcaccaaagtgtcgtctacgaaaatcaaatttttgtatgtggatagagaaaccatatgtgaaaaatttaattttcgcatgcgggcgcttaagccgtccacgtgcgaaaaggaaaaatcgcaaaaaaaaattccaaaaatcgaaaacctacttcgaaaccctgaccctagaatcctcttatcgtcgtcgtccttgtcctcttgtcgccgccgtcgttgtcctcgtcctcatcctcccgaccgtcaccgccaccgtcgtcgccatcctcctcgtcctcccatcactgtcgccgccattgtcattgtcgtccttttcctcctatcatcaccgttggcggatccgcacgggcacgccgggagggggggggggagggggagcagtggctggatccgcccctaccatcgtcgccgccggtagaatccttctcgccctagcccgcttatgtcgccttgcccaccgccgttctcaccctcgctcgagcccaccgccaccactgaagcccgagagctccgctaaagcccaagcccgccactgtcgtgagggagtgtggatgggagagagtggggagaggagtaagagagttggagagggagggtgaggagtggtgagagagagggagtgtgaggagtggacgagagaggatttagtgggagagggagaggaggggaggaaacaagagtgatgagaaaaaagaggagtattttcgcatacggtcctgttaatataaaatatgcttattttcgcatgcggttcttgaactgtgcacggagatcgatttttgctgacgggatcagttttatgatccgcctgcaatataaaggggttcttatccagaaaaatcaattatgtagtagtgatcctctgcatataaaactcaattcttaggatcaaccactgtaaactacaaacacatgatctggaaccttgggcatcgagaaaatgtaagtttttcatctagttgatagtgtaaaacagagtatggccatcagatcgcctggtaacgagggactagctgcacaacctactatacccgctatgccaacactcgcaagaaatttcacatcacctcatcatcgattgcatatacacaagaagaatttagactttagtagcagcaagcgtcagagttgttcaactgcgccagcatggtcgaaactaaagagccatcatatacttatcatcattctttactcgtacaccagataattaacaccggtgacttttttaaagagaatatttaacagggatgacttttcctcaaagcaacatttggaaaatgttatactccagtataaataagaagtcgcaagtaaaacaatcaaagtaatcatcatcatcatcatcatcttggaaacgctccaagaaaacaaatcaaatagataagcttaaaaaactacaaatattcggacactctttttttatgtgcggtctgggaatgggcgtagcgccgtccttgaattgcacagccccaaatggccagatccacgcatgttttgttcatcgattaaacacgaccaagtggaaggacaccgacgacctgggctcacacggcgtgtggacgcatgatctctaattccccatctcccaatcgtgatgcacgccactacagtaccacacctacgctgacacaaatcgacatatcttaattagcgattagtcttctaccactagcactaatataagagcaagctaactactagctccaatgcatctataaccaatctaatatctcattcatacaatagttacatactacagtattaatatctagtcccacctatcataaacacactgcgtcttggagtccgtactacagctagctataaatctgtagcccgctgcttttctctctccttatttatctccttaaaatatgtttgcagctgacttatagcctgctattgtacctgctctaagagcttcatcgtttattcatattctctaataagagcaagtttaatagtatagctaactactagctccaaatcatctatagccaatgtaatagctaattcatacaataattacttattatactattaatacatggtcctatctgtcatacacacattacgtcttagagtccgtgttgcagctggctacagatctgtagcccgctgctcttctctctctttttttatctcttaaaaatatgtttatagctggcttatagcctgctattgtacatgctctaagtccttttaactcagtaggaaataaaaattaatttataaataaaacttttatatatcgattagttcgtagcgacttaaaaactaaagctaaaaggttatgttaaaaatatcttaaaattaacttaaaaattaaattctaaactttatatttaattttttgttttggcttattagactaaccgatcgggctctaagggtttttttaagtgtaatgccatctcaaaaggggaagatgaaatacccgatcgagcaatcgcgcctagttgtccaatcggcctgcttctcccggcatcctggcaaccaaacccttaatttaacaactcgatagcaaaccggcggagtaacgacgttgcccccgtgtaccaaacgcgtgtgtggattagaacagattcttttttaagacctattattaagaggataggttaagcacatccctgtccccgtgtaccaaacacgtgagggtacgttctcttgtgctgaatagctaaatgatttacgatagttatgggcgtacatacaaattaactaaatattaaatattgtaaagttgaaagttagatttagaacaaaattatatgtgcattaatgtatagaaagtttttttaaaagaaaatcgtgccgttaagtattctaattccattctattcgggaaaaaagaacacatcatgggacgatgttggtgattggtgaaggcttgagcggcatacacacatgaagctgtgatactttttatgttcaccctttcataatcgtactaacctctataaaaaaacactttatttcacgctattcacttgggcaaaaactatttatttatttatttttaagacagaggtagtatcatttattacaggtgcatatgtagtacttagccaattttaccctggtgcatcgtatatcaacaaaaattgcctcttgaactctactatttttatatgtagttgacgttgatccattgagataatgcggtgatgtatgatcgttaagggagaattcggaaaaaagaacatcagggcaatgccttatatggggaggaaagcatggtgaaaatttgctaaatattgtgaaaagatgaatgagagggtctacacaaccgttattctcaaataccatcctttttatattatgtagttggcattgaagtaatattcatcttatcatcatctatcaactttgagcgctcacatcattttttaattatttctttaaaaaatgtgatatctttctaaaatgataccatattatcaaagtgcgttatattctaaatataagcatgaaaccttcgtttatataagcctacgattaaatgtaacgcatacattgctagctatgttatttatatatttaattcgataaacttagaggctactccttgatctaattagcacgcactactatatctcacctatgcatgatttgagatctaatccttgatctgtccttcctacgaccttcttctttggaataaaatatttctagaaaaaaaatttatctgtccttcgaccttcttctttggaataaaatatttctagaaaaaaaatttatctgtccttctcctatggccttcttatttggaataaaatatttctagagaatttcacaaaggaaattcaatagaagttctgccaaatccatatgggtttcaaaggagagagccttcccgtctcctttttttccttccatccaaaaaattccaaatggagtagtagttcacatttttacaccgtcgtcttcgcaaatttaatactactatacgaaggaggaggaagctctcgcgccgcggtcgctttccttcccctaaattaaatcccgtgcgacgcgtagagacctcctcctccgctttctcctccaaagcccaagctaatccccctcctcttcctcgtcgccggcgagagctcttcgtcttctccaactcgaccggaagcaagcgcgcttccgatccgccatggtgctctcccacggcgtgtcgggctccgatgagtccgtccactccacgttcgcctcccgctacgtccgcacctccctccccaggcacgcacgctcgcctctgtctcgagcgccattggcgccgatcgattcggtgattgattgggagttttaattttggatccgggcggggcttgcaggttccggatgccggagcagtcgatccccaaggaggcggcgtaccagatcatcaacgacgagctgatgctggacggcaacccgcggctgaacctcgcgtcgttcgtcaccacgtggatggagcccgagtgcgacaagctcatccaggcctccgtcaacaagaactacgtcgacatggacgagtaccccgtcaccaccgaactccaggtactcctcccccccaccttgcttttccgccgccgcggccgccacccccctccctcctcatcccgttcgtcgtttcgcgttcgttattacgccgcaaattcagggatcactgcggttattaatccctctcgttttaccgtgagatttatcccaaaattttgatccaaacttatttttggtttgatttgatttgggtttgggtggcggcgtagggtagctgctgggttttgatcagctcgttccaatgggtgcaaccggccaacccagttggtggccgtccgtttcgacaagtagtcgcggtggatttctaatcctcccacttggccgctgatctggtctagagattagaaaactagctacttagaaaaatggagtacaaacagctcgattgtccgcgtgagccaagggccatcagcccatcacatactcacatgcgccttcgcccattggctctctcttgactacaataatatggatccttgtttaccttctctcagactgtacgtttctgcttttccgtttttaaaacgaaagttgccaagaactcggggaatcgtaactcatatgcagccatttttcgccagtatttaggctgtgttcttcccatgagttttcaactcatggaaactcatctccccgtttgatacgggtttcaaaaaagtttatataagaaaattgttttaaaaaatcatattaattaattattcaagttttttattactaatacttaattaatcacatgttaatttacccctccaaaagaacatgtacacagccttagcatggataggtcgagatgttgaagaatccctttgtaatgctttttttttaccaagttacacgaaaaataaaataactttaaattttaataatcctatagaattcctgcatccggcacaaccaacatgttcgtcattaagcaaacagtttcgtttgcctgtgttttataagggtgagcgataaattaagcgatacacagtagactttttgattgctttggagtgtttgtaaccgtagtcgtaacggcaagaacaagtaggtccctttgaagcaactatatatgacccgattgccagggtcaaaaatgatgtgacagaaatgaaaaacccattcccagcgtgtctgtcaccttgacgcgtactcactactgacataaaaacaacgattagtgtctctttcagtagttaattaggacagaaattgattcaccgattaaagaaaaacagtactcgtacatgttcgaggatccctcgttcctaggaggagaatcgaatttggtcggtcctggacaaatgtcacgtggtgactcttggtttctgagtggattggaaacataaaacataaaactcagtttctaattggactaattagatctgacactaccttatatttagatttgtagtattacttggtgtctaatcatgtatttgctatattttgaggtgaaataaacacattgccagtattttcatatgagtttttggtcatttcaatctgctgacctgtcaagaaaaaaaatgtttttcttctaaattttatccttcaaaatggaacatattctatgaattttccgccctccaagtgagaagataataattgtagtaattaagccaatgtccggtgattacgtcttatgtgtggacagatgcaaaattttcgctgccgacgtactctctgtgtccaccaataattccttgacaatatgtcccctgtcctctcattttctttgaggctaacgggcgggtgatcaacccgcccctccctctgtactcctctcccttctttcctatcatcgtaaaataaaaaaaaccacaaaattagtaaaaaaattagaaaaaaaatctaatactcttatacatgtgcataaactttataccgtaaactttgcacacataaacttactttatgtatagaaatattttatatatacaaatatttgaatctgaatttaaatttaaatcgggtatataaacttttgacttataaacattcgctctacaaactttaggtggataaactttagatgtgtaaactttaggtgtataaacttttgacttataaacattcgctttacaaactttaggtggataaactatagatatgtaaactttagttgtataaacttattagaagagaaaaagaaaaaaaacgatggctggcagcgattgatcgctcattaggaaaaccgtgggatattgtctattgtcaaggcctagtgggatttgcctttctctgtccactaagcagccccgtagaagaagggtaacggaacgaggcggtcgtcggttttctgacggaattcatgtgctaacgaccaaccaaatgtcaagccataacaagctgtggaatggggatggaaacaatgagttcaagttgtattctgggtccataataattgtccttttgcgatattgtgtcacgtagctgctcttagccatgtgaggggttaggtcgtgatgtattctgaaaatgtttcttttcatggtaaaccagaagaaagtcgagaactaatttcgttacatggtgggggtacatgataaagctgttatcttgcgctccaataatatacacacgcacgtaagagccacgtaaaccattcatgtccttttcccctgtttattttagtcacagattttccgaggatgaaaaaagaaactgtactagtttcagttttgttgattcaagatcactgtttaactttcaagtaaccgaaatctcttcaaatttcaatggtggggttataagttaaaacggtctgagagagtgtgctgaaggacggaacaacctggccagtgctaatcacttggtctgtagtactccatcggttgggatgagccctctaacagatattgcatctgttttgttatatggttctatcggatgaccgagagttgattataccccgtaacagtttattactacctccgtttcacaatgtaaaactttctagcattgcccatattcatttagatgttaaatgaatctagacttatgtatgtgtttagattcattaacatctatatgtatgtcggcaatgctagaaagtcttacattgtgaaacggagggagtagtaacttaaaaattaactagctgggtggccggcgcaattgcgcggctagcacccaaacaaaatcatatatatttttagtatgattttacttaaaatgtattaaatagctatttcattgtcttaagactttgaaagatcaaaccctatctcctcgtgtttctaattatatagttttaaaagtcacaccaattactatccctcatgtcatctctttctttatttgcttgctcaatctaccactatttctattcattcttcttggaatatttaaaaattggattttatagtttttaaagtttattgtcacgttggatttcatttttataatttctagatatcccgtcaaacgttgccattatactcctctacggcccgtccactgtctcttctctttattgtcattgagattttaaaaatcgaacataattatcgtttggtttcatttttactttctagaagtcccgccaaaccgtcagtggctttgcgattgtactcctctacggctcgcccgctgcctcccttctttattgtcattgagattttaaaatcgaacatgattatcattgttttttttacttttcagaagttccgatcctttaaaaattggacttgtagtttcatttttaataattttaaaaagtcccatcaaacgatgccactatgcccctctatagcctgtccgccgcctactctttattgtcattgtgattctaaaaatcgaacatcatgatatcgtgggaatttattttttatttttcatttggtgttttattaacaatttttatacgtcgtatcaaccgccaccactctactcatttataggtctgttacttaatttatctcgtcatgtgttttagatgatcttttctttcaataatctttattttttatcaaaaaatttagtcctaattgaaatattatttttctttttctaatttcagatttttttaaaaattttagttaataccgtattgtgttcttttaatgtttttattttttatttttaatttcagttgtttcaaaattgtattcctacttgaactctcttttattttttctaattttggatattattttatttttattctaaattttaattaatctcgtactgcgttcttatatggattcttctttcagtattgcttatttctaattccgaatttcagcaaattttaaattgtattcctacttgaactcttcttttattttcttttgctaatttcggatttatttatttttattccgaattttaataatctcgtattgggttcttatatagactcttcttttaatattctttttttttaattccgaatttcagctatttttaaattgtattcctacttggactctcatttccttttctaattttggtttttattttgaaattttattaatctcgtattgggttcttatatgaaaacttatttctatattgcttatttttaattccgaatttcagctatttttaaatcgtatttctacttgggctctccattccttttctaattttgggttttattttatttttatttcaaattttaattaatctcgtattgggttcttatacggaaacttctttcaatattgcttatttttaattccgaatttcagctatttttaaattgtacttctacttggactcttcttttttttttctttatctccgattaatgtgggaatttctagctcccacagcgaacgtggtgcctcctttcaaagctgttttaataatataacacatagatagatagatagattgtgggtaaaatcttttatatatgtgtgtctagtgtcctaagcaatttataagccaatgataacaaaattacgttgtgaaaataaatcaactttaaaattaagttaggaaatttaaatgttggagcattcgcgtatattgtttgtccacagcttttctaattttcactactcactacggtataataatggaaattaagaatccaaaacgtgcatattactatccattttttgttataaggtgccttgattttttttctagttaaattttgttagcgactagtgaagtcaacttgcactatgttggaacatatctttttttgtagcaattttatatatagatttttctctagacgtggttgggagcgcatatacgtcaaatatcattccacatttcttcaagagtgatcaaacttcacaaagattgacaacagcaattttaagtcataaaataaaacagaatgaaaacaatattgaacatggttatgacaacagtaacatttcctcttatatggcatcattatgctagtttcattaacatcttctccacatttagtcaaactgtcagagtatttatggctcaaaatttgaatttgagtgagtgaattacgttgtagcaaaatgtgtttattgatgtaaattcgtaaaccattgctataactgcatagctggtgcttcttctcaactttcaactgaatttgctgtttgcagaaccgatgtgtgaacatgattgcacacctcttcaatgctcctctaggggactctgaaacggccgtcggagtcggcactgtcggctcgtctgaggccatcatgctcgccggtttggccttcaagaggaggtggcagaacaagatgaaggcagccggcaagccatgcgacaagcctaacattgtcaccggcgccaatgtccaagtaagcagatggccatctccatttaccactcttgttaacgagcacgcgtaattaacccacatttgaaatgcaggtttgctgggagaagttcgcgcgatacttcgaggttgagctcaaggaagtgaagctgagtgacggctactacgtcatggacccagctaaggccgtggatatggtcgacgagaacaccatctgcgtcgcggcgatcctcgggtcgacgctgaacggggagttcgaggacgtgaagctgctcaacgatctgctcaccaagaagaacgctgaaacagggtaacgaatcaaacagttcatttcttccaatcctctgcacaaagccacaaagtacttatatgccccaatgcacattgaaaactgaaaagtgtttgctgcatagtaaaaagctaatgcagagttgctgctggattgatttgaatgtgcagctgggacacgccgatccacgtggacgcggcgagcggcgggttcatcgcgccgttcctgtacccggagctggagtgggacttccggctgccgctggtgaagagcatcaacgtgagcgggcacaagtacggcctcgtctacgccgggatcgggtggtgcatctggaggagcaaggaggatctgcctgaggagctcatcttccacatcaactacctcggcgccgaccagcccaccttcaccctcaacttctccaagggtaaaaatctcctctctttgttttgacagttttacggtttcttgaatcttgatggctatgtcagttcggttcatctggttacatgcatgatgcacgcacacaataacagaatggcacaatcttttttccaggttccagccaggtcattgcacagtattaccaactaatccgcctaggctttgaggtgagaaaaatgctatttcttagtactctctctccgtttcaggttataagacgttttgcttttggtcaaagtcaaactactttaaatttaactaagtttatagacaaataaagtaatacttataatatcaaattagtttcattaaatcaataattgaataaattttcataatatatttgtcttggttaaaaatatcaccactttttttctataaaattagttaaactaagattaatttgactttgaccaaagtcacaacatcttataacctaaaacggagggagtagcttttatcactcttacacaatcacaattaacttgtactcctatgtgattaatacatataatttgatcacgtgatatttgcaggggtacaagaacatcatggagaactgccaggagaacgcgatggtgctgaagcaggggctggagaagacggggcggttcaacatcgtgtccaaggacaacggcgtgccgctggtggccttctccctcaaggacagcgcccggcacaacgagttcgagatctccgacttcctccgccgcttcggctggatcgtgccggcctacaccatgccccccgacgcgcagcacgtcaccgtgctccgcgtcgtcatccgcgaggacttcagccgcacgctcgccgagcgcctcgtgctcgacgtcgagaaggtgctgcacgagctcgacgcgctccccgcccgcgtcgtcgccaacggcggcgacgccgccgccgcgtcggcgagcgagagggagatggagaagcagcgcgaggtgatctccctctggaagagggccgtgctggccaagaagaagaccaacggcgtctgctaaagcaagtcagctgcgcagcggggatcgtatactattattatggtccacttcgtaattgcgacttcttaatttttaccgtgtcgatcggtttaccgtctcaagtctgctctcatccgattttcggattgatgctgcttaattatgtaccaagttaattaattcttagaggacggaatagttccgactcaatacgaagcattgcctgtataagtcgaacacgggatcatgcattttacgttgggtgtgtagcagtgaattgatcagtgatgctccatctctactctgaacgtgctacctccattccaaaaaagaaaaaaaaaacttttatgaacgaatttgtgtatgaaaattaccatctccgtctcgtaatataataaattttggttttagattgcgtaaagtaaatctcttatatgatgatgatgatatgaaggtagtacacatttttctgagactggacggtagactgtctggtactgggagagaagacaccaacaaccaagggagaacgagacgttcctggcacggcgtgggttcgcatttggactggaattctctcatcgtaaggcccatcagtcatcagtagtccatcttaggccccctgtaatttttctgattcatttttaggaacaaatgcaccggatttacttgaaaaaaaaaaactgaccaagtacactcgaccgtccaaaactgataggacggctcagattgctcactacaccatacatacaactccctgcaaccaacgttgcgatggtgtcaaaatcctggtgatgtttcttgatcatcttcttacgacaatcgcacaaccatgaaaagaaagagtgttcattgagcggtaagcattgagaatgcccgccgatagctctgagcgcaacccaccacagttgtcgcgactccgggcatgcgaccaagagattatcaatcgtctcttcgcattgatcccaaagaacacatcgatccagatatgacaaaccacgactctgaaggccggttcactgtctagcaacggttaagggcgaccaaccaaaggaagtagcgacaacgagggggcgccaaagattgcaaaattggcttgtgctggagatgagttcttcaaaaaaaaaaaaaaagagaacacgataagctgagcgggaagagtattctcctgaggtctcccaccgccaagatagagagtccggttcttcggaaagctgcactgaccgaaggcaatcccaaagcttgaaatactccagaatcgcttgaatacccaacaccgaactgatgtcccggatccatcttctgtcagtcaatgcctcggccaccgtgcgacgattccgaagacgagcagggacggctgcatagacagccggcgccagcgactgaattatttttttaatcttaatctttgctaaataatctagttcaataattatattgggaaaatgaagtaacttataagagtggcaaatagtaaaattcccctatcatatgttccacttgacatttcgattttttttaaaatctgagatttcgaaatagattatatcactatggagtatggagtatgggcatttcatattttcatttcggaagggagatttcgaaaaaagaaaaacactacagtggctgcgcacccgccgcatccgagcctctgcacgccgcatcctctccgccgacgaggacaccggcccggagccccacctggccaccaccactcgccaccttcgccgcctcaactgccggccgtccagtcctcggggatgcggcagtgtgtgtggcggcccggtggctgtgctatggcggccaaaatcgaaatcaaccgccggatttcctgcgctccaccgcacggcggcctgacggtggctgctcatccttcgcgccgagctattccgccgccggtgagttctccatgaagctttgctgacctctattcggaatacgaatccgtgcgatccagtctgattcagagtggattcgcgcgcagacacgagtttcccgggaacaagtctgattcagagtcggatttctcttttcagggcaacaaattccggtggtgtccgtgtccgtttcagtttgcgttggctaacttcaggtatatgaaggtataccttgtgcctctcacttcatcaaatgttccaactcggcaagttttcaagcagacgacgaatttcacctttcaagtggggatcgatctgttccaatggcggcctgtagcatagccaggattataaacttaggggatctagcaaaatgtcccaaaaatttgtgctgcctactcttcagagttgtgtccaagttcctagccctttctcccagtttactgaaggaagtggaaaaagatgatggtgatcagccatcaatgacagagagtgtcatggcaaatttaccagagctgcatcaggacatcttaatggagatatttgccctcctggagatccctgacctcgtgcgcgcagggtcggtttgtaactcctggcgctccgcctacaatggaatgcgcagcctaggtatctataaattgtcccagacaccgtgcctgctctacacctctgaatctgctggcgatagcgtcgtgtctctctacagtcttgtcgagaagagggagtacaagattactctaccagagccacccgtgcgtagtaggtttctgatcgggtcctcactgggctgtctggttactgttgatgacgtatccgagatgcacctggtcaatccgattacaggggaacaaatagctctcccttctgttatcacaatcgagcatgtgaatcccatcttcaatgagtccggtgctatccacatgtatgagtactcatggtacagtgcatcgagggtttatcattctgagccatcaattttctcccttgacgagctgcgagaataccttcttgataaggcttttgtgttttctgatacatccacagaaaattacctcgtggtactaattcacaatccgcattcgcaactttcgtttgcaagggttggggatgataagtggacctggcttccaccacacactcactatgctgactgcatctacaaggatggcatattgtatgcagtgaataaagtgggagaaatccatgcattcgatctcagtggccctgtggtcacaatgaagacgataattgaaatggtgccaggatatgcttgtgataagatgtacattgtgcaagctccatggggtgatcttctgcaagtttggaggtcatatgagtacattgagggggattacgaggctgacttgcatgatgctgaccctgcaatatctgtggagaatactgcggaaattaaaatatttgttgttgacactgtggaaaaaaagcgtgtggagatcgaaaacctggatggtcacgtgctatttcttgggcataaccaatcactttgtctcagcacagaacaatatccacatctcaaggaaaattatacatattttactgatgacaacgatctttcgttatttggacacaagaataatcgtcgtgatattggattatttgatttgaaacataacagcagggaggaacttgtgtctcctcagctttggtccaactttcctgctcctgtatggattacacctagtttcacaaagttgaacttcgcctagaagaagcacctttaaggctagttttttatttatggatattagagttgtgtatgtttcttcttgttctgtgcaatttatatgtaaaattatgattggagaactaaagtgtgaatgtgaaggttaagttgcttcatatttgttttgtaccaacctttattatgtttatttaaatttctgctatgtgaaagtctaaacaacaggtcttgtgcggtagccacttgaggggaattagtgaaatatacaaggctaatgtgaccaatgttattttggaaaatggtaaagctgtaagtactgagtctaaaataacttaactctgagagtcttgaatgcaaaattggcaggatgaccgggctaattttattttgaactacgactaattacccttacaatgtttgcaagtattataaagtgtttatgttctttcttaacatgtccattaacctcttagttttattctctgctatctatgactaattatcctgtcatgcagcatgtccattaacaatgtatattttaatggtaatctgaaatagtggataatgctttttgttcttatttatgtttcttcttccaatgattttggacttttctttttctagtaaattgaatatatttggggtcatggatgccacaaagtaaaaatatagagttctcagattgcacatgtaacaaatatttattcatttttgttctgagttttgacaatctaaacttactacattttcctggaggtatgatacagaagccatgtactttgatgaggatgtgagaaccgctaaacgtcagcagttagaatgtgaaatcctaatgagtcactcatttccatgttactaattcaagttatgactaagagaaagtagtttaaccagctgatggtgtttggttattacgaaaatatgtttgttttttcttaatattcttgcttgttcatgacatttcaaataatggattgctaatattcacacatacattccaacaaaggtgctgcaaaaatttcaggcactctaggataattgcagtgataattgcatatggctattataatatagacatttgtctcttcctaattagagaggatgatatctgtcagaaaaatgtaaatggactgttttatttgtccttatttgatcaactggtctcataaatcttgggttttgcagcacacatgtcctgctttcaagaaaatgttagaacacctgcatcatgtggttctcaacaaattcaaaagcgatctagaccaatcattaaggagcggcgggggatttgcagcatcagctcgttattgtgcgcagtcatcaatggtgaaattaaatgctagatcaaggtaaacaaaccacggccaagatatattgggattaaaatattttgcaatttgttaaacgtgacatgcattctgacctgctttctgctgctattttttgtcctgcaaatccgattctgcaaaagccaaatctccaaagtttggtgctcatttgatagttttattgacgatgaatgtctaaaccgtatgtcgactagtattatgggcctttgcttcttgatcttgttttaagcctcttgtgcttgctcctgccaaccatactgtgtaaatttttcaaatattatatgcttgtcgatagtttgtgcattcagattatactagaaacacaacagtattcattataagtaaattcctagcagtttgaagtaatgtgatttgaaactcatcattccttaaatctttggtctacaatacatgacatcaactctctgcattgtcatgcagattctttggttaagcatgcagtgtgggacactacagaagttaggggcaaactggagcaccatatagaagctcatgcaacatctgttcggggtacaaaactggctgaactgaaggctaattatgaggttatttttcatactcagtgcacagtatattattgcaatttcagcatgctcctagaattcctcatttcatgagctcttacagttgtttttttaaaaaccatcctcatgcttggatcttttgttgccgcaatgttcagaaaaaactcttggatgcgcttgctggacctgtatagtcaacctggaaactggtgaaaaaaaactcttgggcatgtattagaagactttataggcatgcaactgaaaatgctattttggcattctcagcttccctctctgagtttgaactagaccagataactatccataagatggtcaaggaattaagagaacatgcaagaagtatagtagaagagaaagctagaaaagaagctgggaatgttctgatgcgtatgaacgaaaggtggaatttagagggaaaaaatagtcaaatctctcttacattttcaatgattttcagattatactagccatttttgcaatatttatcttatccgtacccatttcattggactgtagattttccactgttgagccgtgataaggactccatgcctaggacatggaaagggaatgaagacataagtgcaatcactagagaagcacgtttagcggtatatctttttttttcttttaatcaatattgcaccatttattgggtatctgatctatggtgtagaaacatgatctgtttatcatctttacactgcaggcagctaaccgtttggacaataaaccagataaaatagaccggactctaacaactgctcttttagatggaagaccgctttcacagaagaggagtattgaattcgcatctgatcctattgtctcaagcacatgggaagaggtgctggcacttagatttagaaaattgtgattttcaaggaaatgtgatgaataagtcgtaacattttcacatctatacaggtgttagaaaaaatacactgatcacaccagtgcagtgtaaatccatctggaggaacgcagagactgagtatgctgttgcagaagcaatttctatgcaggtatattccttggccatttctgctcaagtgcttatccaattgattgcataacactgaactattttggtcaaatggataggtaaaacataattgaatttgttgttttcttattatgaaccatgaagcctggcctggtgatttcagagggtcctcaatgctcttaaaaaaaactgaacttgataagctttttcatgaaatatgttctttttgtccattatgtggaagtccatttatgatatttccatctgatgttggtgctatgtgctgaccaaattcttccaaattttcttccagcaggaagcacacaaacatagcaataattggctgccactgcgtggactattctacttcttgcaattgtaggttacaacgaatttatgtttcttctaaggtaatcatctcaatgaagtagcttgcttatccttgtaaaggataggattctctgttgcattaatgcataaactgagaaatcccaaacttgacacttaacatatataactgctaaccatttttatgaactcctggacacgaaccctttgtatcttctggggctcttcgttgtcttcgtggtatcctatgctgcatggttgcaatataacatcacagcctattttcgccatggtacaataagattatacacatctcgtttcacataaattgtatcccagtgcattgaaccaaagtcgctgttgcttaagaggagttaaggctggatcaccttagcttgtttcatcatgcagaattcttctcttaaatttctttttttaaataatggatagaaatttggcctctatatccacaagtggatttacgcagccaaactcctcttaaatttctatctagtgcatttcagttcaactgaattacttgacacgtattattcgaactaatctctgggttgttctttcatatgcagctgtcaggtcttctgacaattacatctggttttctccccacaataatggacatcataacagcagtcatcaacattagtcacaaccagaagagctccattaattctccattgtgaacccattgttccatgttcctcagtttaaacaacacatcctgattattctcctgttctctggacgaaagtcatttttcacagaaaggagttaaggatgggctatcttagcttgttcattttatgatgacataagttactacagtgattgatcaaccggcaactaattttatgatgacagaagagcatctcacacgtgttatttgttactacagtgatcattgaagagctgaagctttaaggaacaagtgtacatatctgagttgtaacaatctaggcgaatatagagattaagactacaactcgaatgtgcaaacatatgtatatgtatagatgattaatgcacaaaaattggtcaatccgtatctaatttgctaatgtgattattgcacaaacatatgtatgcagagaaatgactaagagttatctcctcgagatctcagctttatatgctggtgaacaaacgatgaaaggaaatgatgaagtcgaatctgaatttcttgagaaatgatcactcttcccaccaaccagctggcaatgtgtgacaaaagtagttgtgcaactgaagatcacgagccgtagtaacatagatgcggcagtcctcggcctcacatggaacaagaggaaacttgctgtgcttcatgtggcagtgaagcaacatctgcaagtgcaaattataaccgtgtaagttgttgttaagaaacacacaaaacaatagaagaaaatattgattgtaagaacagagcatcactgaatagaagaaaatattgattgtaagaacagagcatcgctgaatagaagaaaatattgactgtataacacaaaagaagaacagagcatcactgaacaactgcaagtacaaatcacaacattaattaattgttgttaagaaacacacagcataataaaacaaagcatgcattgctgactatacaacacaacagaagaccaaagcatggactactgacctggctgcctgaaaccctgttgctcccagtgaagttttgttcttgaaagaagcagatgtgacagatagttttatgaacaatggtacgagattctctacagtaatgaatatactggtcttccacctcaaatggaacctcctccccgttcaccactcgatgttggcgctgcgcctgaggttgaggtggagcttgtggtggagctggaggggtatgcttcttttgaggaaggtgaatccaggcttggttgcctgttcgattcgttgtggcgcccttgcctccggccttgccatgggctaagcctgttcgacccgttgtggtgcccttgccatgggctggtgtaggtgccacctctgacgaacgccgggcgtggccaccaccgaagaaactcatcattctctcaacagctgtcgtgatccagcccgagtcagtcggtggcgcgaccgtggccacctctgtcgacggcgacgtcacggccggctgcggtgcctccggcgcgcactcgcggcgctggtctgaggccgcgcgctgccgcctccttctacccataactcctctccggtcggcgagttgacggcggcggtgggcggcgctatttcttgtctcgtcgcccagcgcacgcgttcttggctcgccgacaacgggaacacggctggtggtggtggcgacggattcttgaagctgtgcagaggagctcccgacggttcttggcgtggcggatttcttggtggcagagtcggtgtcgtctctggcgacgcaggtgttgctcgcggcgatgtggtggatttcttggtggcagaagcggtgtcgtctctggcgacgcaggtgttgctcgcggcgatgtggcggatttcttggtggcagaggcggtgtcgtccctggcgacgcaggtgttgctcgcggcgatggtggcgcaccgacccacgtccgccggcgtgttcttgtagcccgacgcaacggttcttcgcgcggcggagctccccgcggcacgggtggtgtcgtccccggcgaagctcccggcggcgcaggcgtcagcccacggggatggttggcgcacgcgcacccgcgttcgccggtgggttcttggtgcaggggagctcccggcgacagaggcggcgtcttctccgatggttcttggcaccgcggacctccgagttggcgcgcgtggaccctcggtcgccggttcgggagttcttgggggaggaaggtgatgaaggaagaagatggaagatgacggcgaggttcttggtggcgaggaagcgggatgggaggagttcttggcgagaaggtggcggaggaaggcgatggattttgacggcgatttcttggtgaccacaagggggaattcttggcgagaagaagatggaggaggaagatggaagtcgaggccgaattgttggtggaggaagaagatgagggcaatgtttaagagtttatggagcgggaaggcgagagagccagggagggggagatggagtgctatttatcgtcccaatcccgaaagaatggtcggcttccccggcgccgtcaggtgttcgattgcaacctctgcaaactcaaagctccttggagcattctggttgctggaacgcaatacttattcgcccattgttccattttttcttcttttgaacttgtctaacatgcaactggacatccgcagcgatgtcatgtcttcttccttgttgccggcggccatgcccgaggccggagccagtacaggtagtccatcaccgtagagttcatgttgcctcagtgcctcctcgcctgagacggaggaaggcgagcgtggcgccggcgcgccgccggctcccgcggtcaccagcggacgagcgccatggcag

SEQ ID NO: 66675 - DNA, 681 bp, Oryza sativa
taacagcatggaaaaggagagcatatagggattatcagatcataccaaaacaagaaacttgtcagtttgcccactgtacatgtacatccaattcctactggggaaataatgttgtgcctgagaacagtacttgaaaccacaacagaagggaaagtcctataatttggccctgactgttcgtgtcatgtttaagaacagtgttcaaatgccaatcaggtatacagcctgaaacttctatcatctaaggacgacaaaccactgctattatatacaacaaattttctgatttcagtagttggcactgcttctgagtactgacagcatgtgcgctcattttagtctctccgtgctggcatctcggcaagaggtttcaaaacaatcggcttgcttggatctaccacaagtgaagaactcgtttacagaaaagccagtgaccaggggagctttcctgtcctagacatcttcaccattgctctctcaacactagctatctgattgtcggttgctgcatgctccttgattttcttctaatcagctttcttttgtgcatcttttattgcctttggcatcttctatgctgctctcgctctcttcttctccaacttgatctgtttccagttgaggcacaaaaccaacaaagtgtcaaacgacaactctgactatatcccaaattaaaataaa

SEQ ID NO: 66676 - DNA, 1097 bp, Oryza sativa
ttatatcgataatatttacattattacaaaggcacttcaagcctgacaatcaaaaataaacagcagcggactagcgggcctacggctccatcttcacaggcgctcaactggggtataagccagggctccacctaagacttcttctccaaagcttctcttactaggggagggaagatagagcaagaatgagtacaaccacaatactcagcaagtcacaccgggagatgcatgattaatgcaagggaaacaaggggtaataatataggggattaggttttgcagtaaacagcatttaaaagacacttagttgcccaaagctattttataaagacgatcctagagctacacagcattattaatcaaggccgtggacccacacgaacctgccttaacccaaggcctacgatgattcagaccgaactggcaacccgacctgggtcccagctcgtcccaagccaacccaggccaacctttccaccttttagttgttaagcaatttttaagaattaaaccactaacttgggtacattgctaggcttgcccatatccgagggcacggctattcgaatagatttactctgatcagaggtgtacatctttacccacaagacacatctttactccgcattccatggccttggaacccatcgtaaacatgtgacataacccttcacccatcctagccgtgaacaaaagtaccgacccaaccctgcctacggccggtatcccgggacaggcaggccaggattgagcccctagcaacaggatctagaccgggtgcgccacacgcataggggtgagaccacccgtgtactagtccagtgccatggcatctcgactaacgggcaccgacccgtgtagtcttcatttgcctagacatctcgattaccgagccgcagctcgtgtagccttcatttgcctcagagatatccatcgtcgcaacgacttcatccatctctatccgtgtccttttgttcaggactagactgagcaccgagttaagccttacccattagacatgtggttagtacgatagtgctttgcaacagaggcccgaagaccggtccttatagtggccgaggtgctactagcaaaac

SEQ ID NO: 66677 - DNA, 769 bp, Oryza sativa
gggcaggcaattggttgctagttgaattttgagatttatttttaatccatgcaaccagcggcacgtttcaaataagaaattgaatgctagtggaattaagtagatcaaatgacataaactaagtggtaaaataaaaatctgtatccatatgacggcgggtactgtacaatattaatctgcacactcgtgcagaaataggcagagttttttttagaaaaaaaaactttctgaatcgaaatccatggtcgtcgctcctggtatatataatcttcatttgtcagacccacatgacaaactagacgacttttctcagtttccagttcataatgccgaggacaagcgaagctccggtatgtagaggagcacaagtgtactccatgcattaataattccattgaaaaccagttcgtgtcttaaactactaataattgagtacaatcagtgtgtgtaacattcaagactctgcacttttgtctactttcgatgagaactgcatgtgtcttcgtcggcaggaacccagcataacaggagagcaaaatttatagcacaacttatactacagtagtactttgcaatgtgcgggcggataatgcagcattggagtttatgctgtttgggagtattaggtttcagcgaaaagaaaaaaaggaggacacagaaacagcgcgctgatgatttacaccaaaatgcacgtccagtattttctttgtacagcatctatcttgtgctactccagttcaaattactggttgattgttcagggattcga

SEQ ID NO: 66678 - DNA, 3883 bp, Oryza sativa
ctgcagccctgggtctttcgttctttttaaggatattagtgttgctataccattactaatttgtctatttgcatgcagttcatcgagccttcaacatttgagattggcgacaattaccactcctcgattactgaaataaatgaaatgaataagagtcggttggatagtatgctgccgtagcagcgtacagagagctaattcgcgatatgggtggtttccgtgcagcataggatgctcgcagttatggtctctaagtacaaacatggagtcacagtaagagggatgctcggttggtaacctgttcatataccgagccactcttactcaaagatcggtctgtacaagcattgacactatggataatacaggcagaagcatgagggtcgatagagatagtacaaaccagagatagtagatgcagaaagttaaccagagacagtacatacataagtatgaagtatgggcggtaggtccgaaacatatgcggaaaaataaagagttagcactgtattggtttttagttgaacatctgttgtggttctactaatatggagacaagtactcccaccgtcccataaaaaaaattaaatcctagggatgtaaacatagtgtatgtctagattcatctatagtgtatgtctagattcatctataggatttgatttttttaggagtagttaagtagcgttgtgattcttttgtgctgtgattaatagcgccactgtgtagagataagttttaatagcagttgtgattcttttgcggtgtggttgatgcgccactgtgtagtagtttggcgattgtgtgatgctactacttactaattttgttggtaattttgttctgaatctgagctgattcagttttagctcaaactgatactcaataaaattgcgattcacatgatacaattttgctctttgtctgaactaaaattgagatttacatgatatggtttgttctgctgagtttcagctgagttggttgaagttttcttgttttttatacgtaaacgtataattggtttgttctgctgagtttcagctgatttggttgaattttttttattttttatacgtaaatgtagaattttcattttagttgtcgttcctggagaatcgttatgcctaggtcttggacgatttgcagctaactgacggagatgcaattttagttgcatgtctattacatccttgagcgaacaatgatcataaagaggagtttttagccaaatttgttagaaacagtctcatcagccaatagtgttgggatgactaaacataattagaaaaagaaatgagaaaaaaaaagaagagatgttacaataaatggagttttctattcaatgcaattattaatcaaaataattagagggagttgagtatgtgtgttaggaaattcatctggtgtaataatcagctgaatacaatgtttgagaggataaaatcttggtctcttaacagctagtaggggaagtatcctgttaaagtctgaaaaggatttattctaatcatgttcctattttgttgatacagattagttacaaaaaaaaaatcaaaatttaagtttaaaaatagttggatgttgagggaagatgtacatgatatggtgagaaagcctaggggaacactaaggagggtctctcaagtatagaaaaatggcaaagaaatctcagaaatttaaagaaagctgggttgaaatatgaattgggaaggaaaatataacagagaaaaggacaaatggtgtgaaaatcataatgtatgtgtgaggagaagagaagagcgagggagattggagaatcaactaaggtttactacgagagaggagaggctaaaatggttacaaaggtgcagggagagagatgtgttagagggtgataataacactaagtactatcatgccaaagctaatgggagaaggaggaaaggtaggattttttctttgcgataagagaatgtgttgatagttgggcaagagtagttgctgagttttataacagatttttataaagatatgtttaggccacctgaaagatctaatataagattacaaaatttggagatgggacaattgtctgaagatcaaaagaaagaattgttgaaaccctttactctggaagatggaaagtaacaaggcacctaggcctaatagttttcctactgatttttataaacacttttaggaggtgataaaaaatgatttgaaagctatgattgatgattttcataagggaattttggatatcaaaagattgaattatggggttatctccttaattcctaaatgaaaagacgcagcacaaattcaaaagtttaggccaatatgtctccttaatgttagtttcaaaatcataacaagaaccctgatgaagaggctaacctatgtcataggtgacgtaattgagaaaacacaaactgcttttcttaaagaaagaaacatcatggagggagtagtgataatgcatgaagttttaaatagtgttcatatgaaaaagcaatcaggagttctgtttaattaaggtggacttcgagaaggcctatgataaaataaattggccatttctatgtcagatgcgggaagtaaaaggcttccctagtgtttggtgtgatttgatcatgagatgtgttggagggggtaaagtggcagttaagataaatgatgagagaggggatttttttttccaaacctataaagacttgagacaaggacaccctttgtctccgctgctttttgatattgcagcggatgctctacctcttttaatgaatagagcaatggaacagggaatgattaaatggctagggcaggaatatacagaggatgaaatagtgattttgtagtatgctgatgacactatcttcatgctggaggataacctagagtatgcaaaaaaaaacttgaagtatatcttgtgtctctttgaacaaatgtcaggtttgaaggtaaatttcaataaaagtgaggtcttttgcttaggagggggccaagaaaaagaagagatgtattgtcatattttaacttgtagaaggggtacattggccatgaaatatttggggatcccaattgataagaagagaattcacaatgtggactggagccccactaaaaacaaaattgagaaaaaactgggatgttggcaggggaaacttttggctattggtgggagattgaccctgataaatgcaagtcttgcctttatacatgatgtccttttatgagttgccaaaaggagtaaggaaaagaatagattttttttcagatctagatttctgtggcaagaggatcaaggggtcaagaaatatcacctagtcaattggcaaattgtttgcactcctaaggaacaagggggtttggggttattagatttgggttgtatgaatgttgccttgctgggaaaatggctttggcgcctggaaaatgagagaggcatttggcaagatttgttatcagctaagtatctaggtcaaaaaaaaaactttatctcaaaaaaaaaaccaagacctggggattcacatttttggaggggtctaatgaaggtcaaaaagagtttctaactttttttgtgagaaggtggggaatggtaaaaaatagccttgttttgggaggacagctggtttggaagaagacctttggctgaacaattccctaatttgtataatgtttctcttcgcaaaaatgtgctggtggccaaagtaataggagaagggttaggtagtctaagattcaggaggtctcttgtggataggaaacattgaattgactggggaggaggataaagtggttttgaaactgactaaaaatggaattttcactgttaaatctttctataaagcaatgatgattcaaaacactggctttcaattcaagaatatttggaaattta

SEQ ID NO: 66679 - DNA, 19586 bp, Oryza sativa
gctgagaaggggatggaaggggaagaaggcaaaaagttagttttattctgaaaatgaaactgtggagcatcttttcttaaaatgtccaattgctagacttatttggaacatagtgagttgtgtgtttgattcgaaaccaatccagaatatacatcacttgtttgggaggtggcttcaggattttcaaaaaaagataaaaactttgtggtggtggaaattgcagctattgtttggactatatggaagttcagaaatgctgcatgtttcaaaaataaaagaacacatgatcctttagagttgatatatgttgtttgctcctggatcaatctttggtccattttgtagagatcgggggacgcacaagaaaggcttcagtgggggcagctctgttaaagacggtggtcgctgacttctacaacactagatttggatggaattcatatgtgatgcggttacagggggtaggatgaaggggttgttggggttcctctgtctttttgtgtttctgaagatgtatgcctactggtggctacagttccgtgtctttttttttctctctgctgaatcttgctcccttttgctgtaagactattaaagactctgtagttttctcatttcattaatgaaatgggagaggtttatcctctccttctaaaaaaaggggtgataatgggtgataaaaagaattgatcgcgctgcaggtgcccaaatgggtgataaaaagaattgatcgcttttggagatccttcctttggaaaggagaagaccctgacaaaaccaacccgggcagcagtttagttaattggcaaacggtgtgtaaaccaaaaactttgggtggtctgggcattccggatttagagaggttttcaagagccctccgtcttcgttggctttggcttggttggaaggacgaaaacaaaccgtgggctagtatgaacgttccctgtgatgatactgacaagaggctgtttcaggtagcgacgacaatcgagctaggtaatgccactaaaataagattttggcatgataattggctccaaaacagctgcccaaaagacatcgcacccttgtgcttcaggctggcaaaaagaaagcaaaaaagtgtccaacatgagctccataacaataactagcttgtctctttccggcaaataacatcaatagaagaaatccatgagcttgtacgccttgggagcatgcttcagggagacatgcttactccgtgccctgatgacatctcatggaattggaatgattctaaggtttacacaagtaaaagtgcttatctctttcaatttcagggatcttttgtttccatagatttctcttcaccttggaaggcgccggctgaaccaaaagttaaattttttggttggctagttctccaccagaaaactcttactacttaaaacttgcttcgaagacactggccgtgcaattggatttgttgtttatgcacaagcgcctttgaagacactaattatctgtttagcgaatgccctttcgtcaagaaagtttggtccctagtcagttcctagcaacatttacctacaagcaatgctggccttcctgtcggaacttcagattggtggtctcaaattgattgtgtgggttcaaaggagcaaaagaagacaatgagaggagccctacttaccacttggtggaatgtttagttagaaagaaatagaagaattctcaccaaattttcaatcttagagagagcagtggagcaagatcttgatctccgtagttcggctttttaggccccctaaattttttgtttgtgctgtgttctgttgtatcgtttttattttccatttctggactgaactgttttgtattgttttctacttgtaattaaattccagcagatctcctgttgtcgttctctaaaaaaaatccttaagcaaacaaagcccccgaacattcagttagttatccattgatcaacattcagctaagagtgcatcataaatgcgtatagtttaggtagttaatatttttcctcaatagttttagctaggcaatgcatattgagactaccatgtccttcaatagtatggaagagaaacgaggacccctgttagttccattaaacagatctcaattattttagatgaaaatcatgcttcaacagtccccctaatcaacatccaaaatttgaggaaaaaaacgtcgttctcaagcaacacccaatttgtggatcgtgcggaggcgcggagaagagggcaagcgccgatctcgtagggagttcaaggtgggcctacctaaaacatgtttcagaagttaatgacttaggacatgtttggatcatttagtccctggactaaaattaatctctggactaaaactttagtctcctattgtttagatccagggactaaaagagactaaaggcacgtggaccaagaaagagataagacagaggctatcactttagtccctataattacccaaacgatccaagggggcggaaagagagggattcgaaccctcagtaaaaaaaaaattgtacaacgcattagcaatccgccgctttagtccactcagctatctctccctgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaagacctccaagagggactaatgaattttagtcttaatatgtatttttagtctcttttagtcatccctgtttggattcttagggactaatggattagtcccatgaaccaaacagggccttaattttagaaaatctgttggataagtttttttagaatctaaatccagattagagatttctaaaggaatttttggatttagaatttaattaggggaactgttggtgatactcttagatagttaacacatagtatcaagcaagatgttaaaatactaccatctcctatgtccttcattaatgcggagaaaatacaaggacatgaagaaaataaggtgagagtactattgattcagtggctaaaatcgagaataaaacgatgtaaattagggataacttcttagcctaacaatacattcttttacggacggagggaaattcttatgctaataaaatacactcttttgagggatggagcatgataaagcgtatacacaccactctaacggaaaatgaatttaatgaattttatcccagcggcaagagacaaataagatttgaccatgatcacaaccattcagtttcccgagtagttaatagttgtggaaatcatttatcagcatattctttcaaggcagtattgcgccatatctatgaacaacctaatcaaaaccacaaggacatgatgggttttaagttccacatataaaagccccctgattcctcgcaagctaccccatatgccttttgcgtagcggatctttggaaacctccttccttgcttcttgattctgcatttcccaaatcccgcacgaacaaggtaataatggcaaaacatgacggctcaacttggtaagttgtgtgtcaactgctccctccatcccaaaatgtttcacgccattgatttttttaaatatgtttgactgtttgtcttattcaaaaaatttaagtgattattaattctttttctatcatttgatttattgttaaatatacttttatatatacatatagttttacatattttataaaagtttttgaataagacgaacggtcaaacatgtttaaaaaagtcaacggcgtcaaacatttagggaatgagggagtataatttctacgatagcatccttccgaggtgacatcagttcttgttatcctacggcagtgaaggccattgggtcactacaaatcgaaataaactaggcgaaaataggtgaaaacaggattttgggggaagttagaagataaattgactcgtaaaggggtttgtgtatgaaattgagttgtaggggggaaaatagaaacactaatgagttatagggggcatttggattttccccagttatatatgatggttggatgagctatttctttttttttttctgttagcacttttctcaagttgttaaattatgtatttttaaaaaaatattaaaaagtttatttaaaaacctaataaatcagtttttaagttagggtagttaagtctttctacaggtaatgcttaattaattatgcacccatgagttatcctattttacatgccactgccagttcaaccaaaagctctagataaaacggagccttagcaattagatctatctatctgttatgaaaaagaaaatagtgagataacctctcttgaaaggattcaaattcaggtcggtgcacagtgcagtgttgtggaagacggtatacggatatcggacggagagagtaccgctaaacggttaatcggaatgcggacgattaatcggaatttggcggaaatataacgttttgaaagtatatgtacatagttgataatagttttccctttttgataaacaaatgcatataacttaatatattccttctatatatatccttaaatagaataaccatatatgatatttaaataagttcataatggatagctgttactgtatatctcaattctgacgtagtgatgggttttgttcataatgcatgaaatgaattatcaagagaatgtagtacatagcataaatgaccgtaatcaaggtcccaaataacatatgtatcggcttcatcaaatacaaactccaataacctgatcatcgtcaaaatcaaggaactcatgttcaaactttagaggaagtcagttccttgtcattttacatcttgctgccttgtgagaatttcggaagagcaaacttctagtcaatagtagtaaagggcacagctaatgagctggattgtggaatcgactttgtcatcacgccgattatacggctgattagacggagacggacgatttaatcggtaatgatcggatttatgcgtttgttaccgactaatgatgaccgcatcggcgtgacgtgatggactgatctccgtatccgtattatcggacgtattaacggccgttaacaccgttttccacaacactggcacagtgcactgccctgggccctggcatatctccctgccagccgagctagcagccgttctccacagatggaaacataaaactttacactgaagagtcaggacatacaaatacatatctgcagcaagaagcgaaacgcacaaatcgcacacagttgcaatagtacagcagggtgctcatataaagcacgctgatttttttatttaaagggagaaaattcatttttgtattatattcttaaacgtttctcaaaatcaagtttcactccgaattaaaaaagcacttactttttatctaacttttaaaccggacaaataacactctatttcctttttatttttgtttaaaatgatgctggtttttcctagtgcaaacttttattagacatgaatgtttttatgacgtatatgccaatatatatatgtcaattaataactaggtccacacaaataaaatttacctgataataatttgcatttacaaaaccactattatataaatgaaaatcattgtgaaaaattattgaatgtgctatttgtccggttttgaaagttaaaggtaaaaaataactcctttttagttcaaggtgaaacatgaatttagagaaaagtttaagggtctaaatagactttaccctttatttagtgatgtaggagagaaatgaaaaccccaattaacaatcttcagcttcccttgatatcaatgtccaaataagtgtaatggggatggttggaatgctctgcaattgctttcttcacaatgtgctcctcacatagattcccaataaactcgagctctttcaggcttgggaggtgctggattccatgaagagaagccacccttgggactttgaaagcaaccctctcgagcttaggagctgtgccattatcaaatatgactgtgctgaggtagctgccttcaaatgaaagatcaactagtttcttgaattcgctgtcacggaatataattgtcccctccgtcaacgcttttcgcaggaatctgagacactgcaggccacgtaggctacccagcatgcgcagagcgtcttctgttaggtaagtctcacgcagggtgatcttggcgagttgatggagttctgtcatccaacgaggaagcccacctctggcacctcttatgtttaaggtttgaagcaacctcggaggtgacagcatatgtgaatcaatcaaactgtacccactgccactgttctcggcctcactccctgtcgcgccttctattatcctgattgacaacgagcgcagacagctttctagcatctgaatctggctaagcaaaaacttcatcagatcgacccttcctctattgaaaaccacacccagcttcctcaacctcctgagtcggccaagatcaatgagcccgtcatcttggctggagatctcaacatggtatagcacttccatatctgtcataaaactgatatcaggcatttttaccgtggaaaatgattcaccggatggtgcctcttttccagccagcagatacttaagcctagggaacacaacgtttaacaccctcacgttggtttggcgtatgtccagcgtctgcagattgtggagttcttggatttgcttgggcagatgataaataccagtgtcccggaggctcaaatatgtgagatgacgcgccctggtgcaaatgaccttcaggtctttagcttgaaaaccgctgcaaccctctagatcaagcacattaattagatgaagaccagggtgcgtggccagtgattcgaccaggctacgatctctgcatgcatgcaggaattcattttgaatggaaatacgtttggccatgtcagggaacaaatcttcgtccactacaccttcatcttccattatcgtggaaaggaagtcacggactatgccatgtactgtacagctcttgaatctgccccagaaactagtaccagtgaagtccccagccggaagaagaaatctgtggttgcaaagtgcatcgaagcagcggttggcaacatctgatggttcttctgaagcagacgttacatctgttctactgattagaccctcggcaagccatcttgttgttaaacttgtccttcgaaaggtgtgatttctaggggaaatagcaagatatgccaagcaatgcctgtaatgactgggcaagctacggtagcagaagttgagcattgaattagcattcagcgccgaagaaggttgcaaactgttgttcaggtccctcagctcttcgatgttcctgttagggttgacaaacagacaacgaaggagcatcttcatggtaaagatagatggggcgcacctagttaggatggactttaggacctccagcagatcattttgctggctgttggcaaccagggaaactgctctctccaagaagaagttgatcagagattctttatgctgctcagggaagtcattgaaatcgaaaatattctgcgggttgcaggaggtggccgccacttgaggtatacttgtgaccaacaatatggcactaccagcgtaacagttacagcggacaatatctcctatgtcgctcatgagtgactcggaacgaacatcatcaaagacgagcaagaacctcgtatcgttgagacgccttatgatcatgcccaggattgagccttgttcccagctgctgacgttctcaaccccaggaacattaggagcgatgctcaccagtatggactcgagcacctttttgctagactggtcgtcgccaagagagatccagtaggccgtgcggctgcaatcgggatcgtactgtccgtacatatcatgcactttccgtgcaagaatggtcttccccgtaccacgtagccctaggatggagatgacattcggctctcggtgttggaggaaatggacatattggtccatcaacggaatccggtcgaggagctccttcgatacttccgttaataggtcggagtcgtcgtcggccaatatgcgccgcctctcgaggtcttcatgctcggatgcggcacgctgatgctgctgctcgcgtgcaggcacaggctcgccggggatggcggcctcaggctgatccagctctccaaatggtcggctgtcaatggctcgtgggcgatgctggtcggggatggcgtccagctcctgctccggacgtcgttcgggctggctgattggaatgatcatctgccgagcagggccagggcgccacatccacatgtcgataacgccatacctcatccgccgctcgcccacgtctcgtgcccgggccgtgaggtcccggatatgggtagcgagccggtggcgggccaggatagtggccagcaaccgagcgaaatgcctcaaaggcccgcaacaacctgcgtcgtgggtgccgtcgaggcagtacacgtaccggtcgacgaagaactcagatctcacggccacgtccctgacctgattcagccaggcgcggacctgggggtcgttgtcttcgttggcatcggcgatcttgaagaggaaggcgttcatgctctccatttcgtccctcatgaactgcacgtcacggcgaacgccacccagcagtctcgtctcatcgacaagaacattgccgagtcggcccaatagagagttgacggcgccctgggcggagcctaagctgtccatgcgatatctcttgcagcaatatagaggaaattaaatcagctactccacctagacacctagcttagcttcgcttgcgggttgtggttgtggttgtggctgtggttgtggtcgacgcttgcaggagcttagccggcctgcacgatcgagcactgataagtgaaagattatatatatactcgttgcgacgaccatctgcagtagggctaacttgcacattatgatatgtgagctaggaatctatctatctatctattatataattaattaaaggaatagaaaaaggagcctccacgttcgctctcatggcctagaaattctcacattaatcggagaaaaagaaaaaacagagtccatatagaaatacaatttacaaatagctgaaattcggaattaaaaaataaggaatattagaagaggggactagagtccatataaaaatacaattaggaaataactgaaattcggaattaaaaataaggaatattagaagtagactatagagtccatatagaaatacaattaggaaaaaatagaaattcggaattaaatatataatttaaggaatagaaaaatgagcctccacgttcgctctcatggcctagaaattctcacattaatcagagaaaaagaaaaagcagagtccatatagaaatacaatttacaaatagctgaaattcggaattaaaaaataaggaatattagaagaggggactagagtccatatagaaatacaatttacaaatagctgaaattcggaattaaaaaataaggaatattagaagaggagactagagtccatatagaaatacaattagaaaatacctgaaattcggaattaaaaataggaaatattagaagtagagtatagactccatatagaaatacaattaggaaataactgaaattcggaattaaaaataagtaatattagaagtagactatatagtccatatagaaatacaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttagaaagaaatttggaattaaatatataattaaaggaatagaaaaaggaacctccaagttcgctctcatggcctagaaattctcacattaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagagtctgtctatatagaaatacaattaggaaataactgaaattcggaatgaaaaaaaggaatattagaagaggagactagagtccatatagaaatacaattaggaaataactgaaattcagaattaaaaaaaaagaaatattagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaagtagagtatagagtccatataggaatttaaaactaactaaaatttagaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaataaataatattggaagaagagcatagactctatataaaaatacaatttacagaaaattcggaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgcaaaatttaaaattatgttgtcattttaatatatttgaataatataatgagaaaacatatatgctattatatgagagaaaatataatgatgctagccgcgcaatctgcgcgggccactatgcttgttaatattaatgtggacaagagtagactgtttgccacattgcatcaagcaaacagctagcaccaccgggccgggggccggtggtatgccaattttcaacgggttttaaacagatcaacacggccgccaacaagaaaaacacaccggagcggtatatagccgataatctttcctctgacttcatatctattatattattaaaggaatagaaaaaggagcctccacgttcgctctcatggcctagaaattctcacgttaatcggagaaaaagaaaaagcagagtccatatagaaatacatttagaaatagctgaaatttggaattaaaaattaaggaacattagaagaggagactagagtccatatagaaatacaatttagaaatagttgaaattcggaattaaaaaataagaaatattagaagaggagactagagtccatatagaaatacaattaggaaataactgaaagtcggaattaaaaataaggaatattagaagtagagtatagagttcatatagaaatacaattaggaaatagctgaaattcggaattaaaaaataaggaatattaaaagaggatactagagtccatatagaaatacaattaggaaatagctgtaattcggaattaaaaaataaggaatattaaaagagaagactagagtccatatagaaatacaattagaaaataactgaaattcggaattaaaaaataaggaatattagaagtaaagtatagagtccatatagaaatacaatgaagaaaaaaaggaaatttggaattaaaaaataaggaatattagaagtagagtatagagtccatacatgaatttgaaactaactaaaattcggaataaatgtgataaaattaaaagtagagtttagagtccgtataaaaatataatttacaaataactaaaattcgaaattaagaaaaacatgggaagaagagtttaaagtcaatataggaatacaatttagaagtaactgaaatttgaaattaaaaattaaagaatattgaaagatgagtttagagtccacatagaaatacaattagaaataataaaaatttagaattaaaaaaaaataaaagacgagtctagagtccataaaggaatatatataatttatagataactaaaatttgatagtaaaaataattaataactaacacgtatataaaatacaatatgaatattacacattagtagtttcgtaaagttattgcaaaatttaaaattatgttgtcattgtaatatattttaataatataatgagaaaacatatatgctattatatgagagaaaatataatgatgctagccgcgcaatctgcgcgggcctccatgctagtttgattaatgcccactcagttcttaaatacatgacgttctagagatctttcagttaaatctatttaaaccattaattaatgtcgtcattagtatacatgttactccatccattatcgaattactaatgtgttatataacggtcatcccacttttacgacgaattacatttcaatgattataatatgattaattacatagttatatttaatatggtaataatcgataatctgatatattttcaagtatttataaatttaccaaaaaagaaaaggtcaaaccttaaaagtaaactccctccatgtggtgtccaactacgtttgtttgttggcttggttgtcaagccgggtaatgaaaattttacctgcttttaaaaaaaagaaaaaagaaaagaacttatagtgttcatgtcaattattcaagaatggagagtatacacaatgttctagttctcagtcatacaaaatatttaagttttgatgtgtgaaaattgtatttaaatattcagtccgaataacaattccatatagctatatatatattttatatttttataactatattagtaaataatgatccaacatgtgcatgaatgtccatatgtgtcaagtaaaaaataacatagatactctctctgttctaaaataaatttatttttcattcatctcccacatattaattaagaaaagaatatccctaatttatcaatgcacaatgcaattatttctcactttatttactcacaatgcatttatcatctacttttacaaactctaatgtcatgattgcttaaaaaaataaacttatttgagacacacagaaggggtaaaaaaatgattttattatgggacctaggtagtgtccagccaaactacggtacaaggattatgtgagatgtcatatagtcaggtttgcaatttatatctatcatgtattaaaagtcgatgacatgcctatccatataccaaaatataatcttgtaccatataccaaaatataatattagtacaaggtatttattcatttgatttaattaagagctcctatgccctcccccgtgtgggcgatcgactcgagcgatggagaaccagggttcacgattccgacgcgccccttcctcccttgtcctccgagtcgccactacggcactaccggaaagccatatggtgtgcggcgaggtaggatggtggtgaagggggaaaatcctcatcagtggcacaccagaaatctgggcaatggatgcacagaggagggcgaggcggcgttcggtgtgagcacatctggcatggtgaggccctcccttgtcttctcttggggcagctcaggcagcaatgaggttgttaattagacgaccgtcgtggatgcagggttggaaatttcggtcgagacaatattatttcggccgaaattttttaattttttatatttttcgtgattttttggtaatatttgttcaaattcaactaaattttgtttaaaatttcaggaatttcggatcaaaattttgaaatttcagtatttcggtgaggtccgatcaaatcgactaaaccgaaaggtttaaccctgcgtggatgtggcagcccacggctagattcagtgagactggacccgacgagaccagatttggcactcagattgtgggcgacttcggtgagacaactacggtgcgtggatgtgacggcgcgagtagacgatgggaggcaacgggatggctagggcaggttggcgagaccagatcctgccgctcaagcttgtggggatcgtcctgcgtggtggagacagtgcggggcaccttatactttctccgtcccaaaaaaacttaatttctgggttttcatgtctaacgtttgaccattcgtcttatttgaaaaaattatgaaaaaatttaaaaagataagtcatgcataaagtattgtttatgttttatcatctaacaataatgaaaatactaatctaaaaaaattccatataagacggacggttaaacgttgtacacgaaaatctaagaattgagttcttttggaaaggggagtatgccgcaaggcggtggtgacatggcaaaatgacctgagacagcaggggtcagtgatgcaagaaaacagcagcatggctcacggccttgctgtgcctccagcaatcgacgtgtggggagatggtgggagtttgggagcaagttgggcaccggtgggaggttggtggtggggcgctagaacggtggtcgcgtgcagtgaagttcttcggatggtggcagctgatggtaataacgaggatgcaacgatatgagggctggatcgatgttttttgagcggaagcccagctcaattctagaccgacagtggccacacttttaggtgccacaaccccccggaggcgttgctctacggcttcctcctctccatctgttgaaatttgtcgtgtgaaaatcttatcctggtttctctggacgtacgacagcgatgtcctcgacgtcctgacctccctagggcatcgttgtgaaggtccatttcctatcattctcttcttcaaacgatttgtcctcttacaacagtgtttttgaccaccaaattaaagaaggccacaccggctgatatgtgcgttgtttttatatgagtaaaatgcaccagcggtccttgaacttgtcagtaggtttcacttaggtccacgaagttgcaaagtgcacatcgaggtccctaaacttggtttattgtatcatcccggtccaaaaccgcgtttgaccgtggtcttgcctacgtggcacgccacgtgaacgatgacatgtattttttttaattttttctccctttcctttctttttcaccactgcgacaacccctcccctcgtgccgcctctcaccaccgagaaaaaagaaggaagaaagagaaaaaagaaggaagaagggagaaaaaaaattccatgtcattgtccacgtggcgtgccacataggcaagaccacagtcaaacacggctttggaccggaatgatacaataaaccaagtttagagacctcgatgtgcactttgcaagtttgtggacctaagtgaaacctcctgacaagtttaaggaccactagtgtattttactctttttatatagtcctactaggagttggatttgaaattaaaataggtataggatagagttagagtcggactttgtcataagttctctcttaaatagagaggggtactataatgtaatcatgacgactacaatatagtgtaggcatgtagggaggacaatagcggtgaagccatggactcgtagtggctagttgctatattgattagggaggagcatccatatcagagccctggagatgtaggctttggctgaacttcattaattaaactagctgggtggcccacgcaattgcgcggctagcatccatataaaattatatatttttttaatatgattttacttaaaatttattaaatagttatctcgttgtcttaagattttaaaagaccaaaccttatcatccttgtgtttctaattttatagtttttaaaagtcacaccagttgctaccccttacttctgtcatattattctttattagcttgcttgatctaccactatttctattcattcttctttgaacctttaaaaattggatgttaagacttatagtttttagagtttattgtcctgttggtcttcttttgtataatttctagaaatcccgtcaagcgctgtcattatactcctctacgatcgtccactgcatcttctctttattgtcattgctattttaaaaatcgaacataattattgtttaggttcatttttctactttccaaaagtttcaccaaaacgtcaacgactttgtcactgtactcctctatggctccccgttgctgctcttctttattgtcattgagatttttaaatcaaacatggttatcattagggtttatttttttactttttagaagcccgaacctttaaaaatttgaccttatagttcttagagtttattgtctcattgggttttatgtttttttatatttttttagaaatcccgtcaaatgctgccactatactcctatacgacccgtccgccgcatactctttattatcattgggattgtaaaaatcgaacataactatcattgaaattcattttttaatttctagaagacccatcaaccatcggcggctctgccattgtagtcttatatgacccacccattgcctctcatttttattgtaattgagattttaaaaattaaatatgattaccattgaggtttatttttttactttctagaagtccccgccaacccccatgaccgattgcttcacgacctgtccgtcgtacttccttttaatcgtcattaggattctatttggtgttttattaatagtttttagatgtctcattaaccaccaccactctattcctctataggcatattacttaattaatctcgtcatgtgttttagatactcttttctttcaatactcaatagtcttaatttttttatcaccaatcttagttatttataaattgtattcctagttaaaatcttatttttcttttttctaatttcagaatttattttattttttgtattgtgttcttttcatatttttatttttttattttcaattttagctgtttcaaaattgtatgcctactttaactctctttttaatttgcctaatttcggatttttattttatttttttattctgaattttaattaatctactattcggttcttatatgtactcttatttctatattacttatatttaattcgaaattttagttaattttaaattgtattcctccttgaactcttattttattttcttttttctatttcctatgttttttatttttattctgaattttaattaatctcgtaatggattcttgtatggactcttctttcaatattccttgtttttaattctgaattttagttatttttaaattttattcctacttggactctcttttttttgctaattttggattttattttatttttattccgatttttgattaatttcgtattgggtttctatatgtactcttcaatattgcttactccgtttgaatcttcagaacatgtcaatatattttgccaatcactttgcattgcttaatatatttatcatattttattcagtcatagatggacggggaattctgtaattagttttgtattctaattacctattcagctccaacacatactatatgcaggcaacgtgcatgtccgattcctcgtcaattaaaatattgtaattacttctcagtttcctattatgatagaataggcttagcttagagcagtagtttctattcatattcatattcttcaaattaatctacaccgttaaaatctagtcagtttgtgatctaaaggtttaatattttttgttttttctccgattaatgtgggaatttttagccccaacaacgaacgtggtaccttcttttaagactgttttaataatataacttgttgggtggcccacgcaattgcgcggctagcacctaaacaaaatcatatatttttcatatatttttcagtatgattttacttaaaatttattaaataactatttcgttgtcttaatactttgaaatatcaaaccttagcatccccatatttctaattatgtagtttttaaaagtcacaccagctgctacctttgtcatatcgttctttatttgcttgctcgatctactactatttatattcattttctttgaaaccttaaaaaattgtatcttatagtttttagagtttattatttcgttgggtttcgtttttataatttatagaagtcccgtcaaacgctgccattatactcctctacagcctgttcactgtcttttctctttattgtcattgggattttcaaaatcgaacataagtatcattcggggttcattttttactttctataagtcccatcaaaccgtcagtggctttgccattgtattcctttatggctcacccgctgcctccattatttattgtcattgagattttaaaatcgaacatgattatcattggggttttttttactttgcagaagttccaaatctttaaaaattggaccttgtagtttttagagtttattgtcttgttgggtttcattttttataatatttagaagtcccgtcaaacaatgccactatactcctctacggtccatccaccgcctacattttattgtcattgggattctaaaaatgaaacataactatcgttggaattcattttttgttttgtagaagtctcgcgaatcgtcggcggctctgcaactatactcctatataccccgctcgctgcttctcatttttgttgtcattgatattttaaaaataaaatatgattatcaatggggtttattttttactttttagaagtcccggcaaccgccttgcccgtttgcttcacggcccgcctgccgtccctccttttaatcgtcattaggattctatttggtgttttattaacaatttttatatatcgtatcaaccgtcgccattctactccttttataggcatgttacttaatttatctcgtcatgtgttttagatggccttttcttttaacaatctttattttttatcaccaattttagttatttataaattgtactcctaattgaaatctttttttcttttctaattttaggggaaaaaatgaaattttaattaataccgtatagtgttttttgatatttttattttttttttttgaatttaagttgtttcaaaattgtattcctacttgaactttcttttagtttttctaattttagatattattttataatttattacaaattttaattaatctcgtattgagttcttatatggattcttctttcaatattgcttattttcaattacgaattttagttaattttaaattgtattcctacttgaactcttattttctttttctaatttcagactttatttttatttttattccgaatattaattaatctcgtattgattcttatatggactcttctctcaatattccttattttaattccaaatttcaattatttt

SEQ ID NO: 66680 - DNA, 9251 bp, Oryza sativa
gcgtggacgatcggtgtcggtgatctgtgggccgagtggaccgcacgtatgggctgtgggccgttcgctgccaaattcaaggcccaatacggagcagccactgcgctagtgcggtgtttagtcccacctcgcttgccaaacaatagtcttactaacttgactggatttataaatcgaagtttggagagtgcttgttctcgcaccgacttctaagagcatgagcagctccatagctccattgtatgtataaactgacaactattttagagccgaactcctttttttaagaaaaagcctatttacgatcgactttagaactctttttttttaaaaaaaactatttacgatcgtaaaaaaactatttacagccgaactcttttttttaagaaaaaatgtataaacattttagagccgaactcttttttttaagaaaaagcctatttacgatcgactttagaactcttttttttaaaaaaaactatttatgatcgtaaaaaaactatttatagccgaactcttttttttaagaaaaagcctatttacgatcgactttataactctttttttaaaaaaaaaactatttacgatcgtaaaaaaaactatttacgatcgactttagaaccttttttttaaaaaaaaaactatttacgatcgactttaccactgcaactattgaaatctttttttttaagaaaaagcctatttacgatcgactttagaactctttttttaaaaaaaaactatttacgatcataaaaaaactatttacgatcgactttagaactctttttttttaaaaaaaactatttacgatcgactttaccattgcaactattggaatctttgattcgtactttagagtcgaactctttttttaaaaaataaactatttatgatcgactttaccactgcaactatcgaaatctttgattcgttcgtctcccgtggtaggcatgagtcgaacggacaatgtggatgccctaacgaaacaatagctgtcgaactctttttttttaaaaaaaaaaaactgtttacgatcgattttaccgttgcaactatcgaaatctttgattcgttcgtctcccatggcaagcatgagtcgaacagacaatgtggatgccctaacgaaacaatagctccattgtctcctttctgcacgctttaattactttattttttgttacgtccagtttgtataattatatttttttacaattacaatgttacgcctataattaattttttataatgttacgtccagtttgtttaattaatatagaccacctataattatttgtcatccgttcagaccaattaattgtagacgtaaacttttttttcacactaataaaaaatatatatcactgggcaaatcatattttctcttactgccatcaaatgaaggccgatgaaaataaagtattttcataagtgggatcagtcgtttgcgaaaatatattatttcggtgacgggtatctaaagggcatcgtcagtgagaatcaatctttctaggcctttctatctatctgcacgctttttattattttctctacaaatttacattagattgtttggtattaatatagaccacttataattatttgtcatccgttcggaccaattaattttttaaaaaatgttacgtccagtttgtttaattaatatagaccacttataattatttgtcatacagtggaccacttaaattgtaggcgccaactttttttttcacactacttaaaaaaaaagcatatcactgggccaaatcatattttcgctgacacctagccctactgccatcaaatgaaggccaatgaaaatgaaaatagagtattttcataagtgggatcagtcgttggcgaaaatatattatttcactgacggatatctaaagggcatcgttagtgagaatcaatctttctaggtaggacgctcaagccactcaccacgaaaaatacatttttttcagaattctttttttttaaattttttaaatgtacataatttaaataacaactatgcacaagtttttataattctttaaatgtacataattctttatcaaataacaacggtatatttttcactcagatctaaattccttactttcttttaactttttgagaattcttgtttttacaggttggggagtgtaacgtcaaacatcttcacttgtttctcttccaatcgcccaggtgtttgacactggcaatgtcattcatttctctccttctctaccaagaggttaaaaaaatgggtccgatagaagcatcagattaccatacgtgaaagaactgtaccatttcgcaactgcaccaacgaataataaaaaaaagcacagaataaagtaagcaaggagttgatcccattattaaaaatcatgttattatctatttaaacaaattccgaaactctaaactacctgttataaaaaaaatagaattcctaataacagaccaaaatgccttatttttattattattttagattgtttttacaggctgagtgtaacatcaaacctcttcacttgttcctattctcatcgcctagttgttgccactggcagtgtcccttcactccttttttaccatgtctaaatatctcctcctttctcttttcctagaaaagagcccgtatgttacaccggagagaaagaaacatataaaatacagggaacaaaggcatgaaaattgagaagagagggcatggttagtactggtagaaaggttatgtgagatggtggtgtggaaagaggggggtaggcgtctaacggaagaaggaatttagctgtaatcggtggacaggaggatcctagtgaagtgaatctcatggtcttatgttgatctggaattagagaaagtttagggcttgtttgggtgcccgaatgaaatctggctagcacgcgctatcagtgggactagctccgatagacatgggaaaccgcgatccgggttgaagtaagtccttgatgggatgggagcagaccagcggtgagagacatgtgttgattttaggatgtaagatttgatgattttgagtcgttggatttgacgatgagaactgtataagatcataattagtgaactatagggtagataattatttttatcactctccattaattcctaattaatgccccacctttttagataaaagtttattatgtaaaatgttaaacacaacattctagtacaaggttggcttttttttaagagggaataactttaacctgaaacacattaataacacgcatcacctgtttgtaggatggttggaattgcagctgtgatctgtgctctttgcaaagccagaaacgcagcatatgtttccgaaataaaagaatcatggacccagctgagctaatacatgttgtgtgctattgaaacgatacttggtccgtcttgcacataatggaggaaaggcgaagaatgttgcaactgggagcggtgctgctaagcagagtggcagaagaagtatacaactcggcatatagatggaggttgaactcaaggcgtctgatgtgaagatgaagtacctgggatcgtttttactaccgtttcagcaccaccagttatgtgggggagatgtaggaagggcggagccagccaaaaaggacgttggggtcaactgtgaaatagtatttacaaaggctgtgtttagatcagttcaaagtttgaattttggttgaaattaaagatgatgtgactgaaaagttatgtgtgtacgacatgttgatgtgatagaaaaaattagaagttttggatctaaacacagccaaaataccaataaaaaaaaccatgaaaaccgcttggttttgtcaattcgctagttttagaatgtttttcattacagagttgatgaaaaaaaaatcatcgatagtttattagttttaattatttttttacgatgttacgtgaaaatcatcgatttttactagccagcaaaccgtatgaatcggacacgggccaaattttaccaagaaaagataacataaaccctataaatccctatatcttaacactcacatgtactctctccatcaagaaaatataaaagattttggttggatgagatatgtgctagcattgaatctggacagaggagggagggagtagcatctaataatgtatatataaaatattgagaagaaagtatggctccgttataagtttgcttcctgccaatttagtagaaacggaaaagttaaaacatatggagtactactgaagaagatattcatataagctgtgaacaacaaatattggtttctaatttcgttacttgaagttgtgctgaaagaaacatcagaccttacaagctgcatatacttttagtaaatcgtaataaaatcgcccttttatctgttggcttgtgggccttgtgtagttcacgtgggcaatcataccaatgatgggcttgcaaaccagccagctaatcacagagattttaatcagtggctgtgctcatacaagaaaaccagatgggttgaggtcagatcaacaattttaccgggttcacattcaactacaccctatttatcaagtggaatttagctccggtcgtcggtgtcctaggaccctgatccaacaacggtagctccgcccattaggatccctgcttgttttgatatgattgtcttgtgtcgtacccatgggaactgatggtgcttttgtttatgatggtgcttttgtttatgtggaaatgttgtcggaaagatgtaacagacttggtaattttacatttccttaatgaaatgggagagcttagctctcttaaaaaaaacttgtgtcttgctagcatcaaatgttccaactctgcaagtattgaagcaaaccatgaatttcaccttccatgaggggatcgatctatactcctatggcggcctgtagcatagccagaattatgaactttgggggaactagcaaaatgttccaaaaaaagtatgcaacctgctcttaagaattgtgtccatatcctagccctttctcccagtttactgaaggaagtggaaaaagatgatggagatcagccatcaatgacagagagtgttgtgacaaatttacgagagctgcctcaggacatcttaatggacccaagattgcctgaattaagattggacccaatgccaagccaagcgggcttcatcatttttctacaaataagtctactttgtttcccttgtttttatatcggaattaaattgcatataaactgtaagataagggttaaaaaaaaattattgtggttttgagagatatttaaactacgaaagtggacatgtcttataccttttgctgccgcgtccgtcgtgtcggcggtgacccatgaacgtgccccagtacttgaattagaaatccttcggggcacatgggtgatgtttgaatgttctgaatatgaagatgaagtgtttcacgcaaaacgtggttgtaataacatgtgattaattaagttttaattattctaaacttaaaaaatagattaatatgatattttagagcaactttcatatagaaagttttcacacgaaacgcaccgtttagtagtttaaaaaacgtgccacaagtatctaaaatttaattcaattttagttggagaaaagaacatggccatataaatcccagattttcacagcaatcaattgtatatgactttcaacaaactccattatttgtcttgaccttgtgtttaatttgatgatgtttaccttttcttcctgctgattttttttctttatcttctcccaattttcctcttcttccctagttttagaacattgtttcgtcatctttttcttgctccaaaggagtacggcaagaatataacaaaatgagtacggagagacaaggagctaggtgacccggtacggcgttacctcgagccgagcaagcggctgctgaactcaacaaagcaatagaaaaaaatacaggattctaatagaaaattaaattaagtataaaatgaagagttgcaaaaaaaaaaaacacaagaatgatcgttgattagacagcaggacaaacacagaaatcggatcaaagagatagtctcgaaggaatttttttaagaggttgaacctcttactaaattttctcaaaacttacatttaatgagccattccattgaaattttatatgatttgaaaaattccaattttttgaatcaaaggattatatagaaaattttcctatatgattttaatcctataaaatttctctgtaaaattctttgattcaaatggcccacagtatacagcgcttccagatttttttttcacgagagaacctgtctacacaggagcaataaactttgaccgcttcatgatgcaaagactgcgaaacgagatgcgtcatcatactttggactaagctccacgtctcacctttcctgtacatagaaacggtcgaaacatatcgttattacctgcatttactgtccatttgtcctcgtcaacactgacacttgtcacctgtacactcccaatcaaaagcgcactactccccgtagaacatactactacatcactttgcccccgctgcctttgccggttacaccgacagcgccggtagtccggtacacactacacaaagaagtcgttagggccaaaccatctgaattctctgataatccaatgggccggccaatccgaggtcgccatgcttgttgactctagatcgatcgatcgatcgatggatcgaccgcgacggcagcgaaagatgagacgacacgagacgagacttgccgatcacaactccgccgatggtcgctgtcacgcacgcaagcaccggattgccggaacatacgagccgatcgagaagcggtcgaagcggatcggagttacagtagctagccccacccgtagccggtgtatcatcccgttctcctttaattttccgatttgtttgttatccgagggatgcgatgcgagcctgcacttgcgcgcgcggcacgcgtcgccgtcttagattttctccccaactgatgggcaatggctacggtattcgccccatgtggcgggcgcgccacaggagggtctcgctctcgcttccgttctacgtaacggcccgcgcgcgcggtggaccggtgcatgcgcgcgcgggggtggggtgcggcgcagggagtggtgtggtggtgcgccgggacgtcatcaggcgtccaccatcatcgcccacgtccactagggcggattggctccgggtttcggatcccaatcgcgcgcggtggtagctggctctccgactccactctatacatgcactccgcccctgccggtgaatttgttcttttgattatttgttagccgaatgtttcttctagacctggagatttaactgatcgcccccactctttactacagatatgtttaaattactttgcatataacttataactagcatagtgacccgcgcagattgcgcggctagcatcactatattttctctcatataatatcatatatgttttctcaaaatatattaaaatgacaccataattttaaattttgtactaactttatgaaactactgatatgtaatatttatattatattttttatatatgtgttagttattaactatttttaatatcaaattttagttatttctaaattatattcctatatggactctagactcatctttcaatatttcttattttttaattccgaattttcattatctgtaaattgtatttctatatagactctaggctcttcttctaatattatttatttttaattctaaatttttattatttctatttgtatttctatgtggactctaaacttatctttcaatattctttaatttttaatttcgaattttagttacttcctatattgactttagactcttctttccatttttttaattttgaattttagttatttgtaaattgtattttttttatacggactctaaactctacttttaattttattatgcatattccaaattttagttagttttaaattcctatatgaactctatactctacttctacttctagtattccttatttttaattccgaatttctattatttcttaattgtatttctatatggactctatactcttcttctaatattctttatttttttaattctgaattttagttatttttaaattgtatttctatatagactctggtctcctcttccaatttttcttattttttaattctgaatttaaattatttctaaattgtatttctatatggactctgtttttctttttctctggttaatatgagaatttctatgccgtgaaagcgaacgtggaggtttctttttctattattttaataagttaatagattttatttggatgtgtgataggatgagctcacattttgtgggtatgagtggagcgtgcatgtgtgctttcgacttgtattaaaaaattgaggaaaatgatgtttcctaagaaattaatatgggtttgtaattagaagtgtaccttttgggttcgggttttctatgataaactattgagaacctggaaaacaatataaaggctacctacataaagaatgtatttttttacatatgagatatgcgcacgtgtatatattatatatttatatatagcggtcaatttagaaagcacacatattagtcagaggcaaaacccgcaagggaggaggcatgagggttatatgggctatggaatatccacaaatccacaagtatgttttttttagtagaagaaaagaaaaggtgttcttccacatttccattctacaaaagtcgttacaagaggggatagttaatttcctcttgtctataggtgttgctttctacaagatatcagttagttttcagtgatcacctttacttaattgacttctgctaacaactcaccggcacttagaagctaactagctgggccaaattatacacactagcatgatgcccttatattttgctatttaaccatggccatgctttctttaattcttcattatttgcgagtggtgacgacgaccattaattaggaaattggatgcttatcaactacttcagggagcgtttcagtaaccgaaaaatcaatatacacatttgggaggggcatggcgcctcatgtcagttatcagttggatcagaggggacatcaactttttccacttgccaagtgacagcgatcgagtggctggattagagggaaaggaaatgtaaacgtcttcacggtcctaattaagcaccacattgctagaggtgttagatcccatcaggctaggtacagtatgatcatccta

SEQ ID NO: 66681 - DNA, 2260 bp, Oryza sativa
cccatttctctaagcccacagatcagtagcagtaccttttactccatcctggtttagtatctgcttaagggaccgagttggccgggtacatacctaacaagcagcagctagcgcgcggtgtggtacctagcttggacagcgaccaatggtactgtttggcgacccatgatgatcactggccgggccggcgcgcatgcatgatggtgcgccctgaacgcattcggtgtctcggactgcgatcgccgcggacgtatgcgcctggcgcgcgtaccgtgtaccgtaccgccgctggagagaccactcgtacgcttgcacgctgtgggcgtagtattgcaaccgggcggccgcgccagcgtacgttttgtccttccctaagaccatttccaacccataacactagatataatttccataagcttcacatcatcgagaaactagtactagacactactcttccaatgcaaacaccactatttcatgcttcaatttaatgttacttatctcacatgatgtcttggatgttgtgtagaaatcatgtctcgcatggtttccttctctttcctcatttattcacttgccacatcattttttatcctatgtagcagcttatttaatgttatggacaccatcctagtcattgggttgggaatggcctaatcatgtacccctcccatgattaccccaattaatatggagtatatacgcagtgagcgagcgtaccaccaaattgaatgaaggtccccggtccaggacgacgaacagcttaattaattcactgcgttaattaatttttgatgatctcgatcgatccgtttcgttggacacagcacagcggcgtgcctggtagaagaatgtactagtaattctttgattggtgttctaaaaaaaaaattctttgattggtctgatccgacgatggatgtgtgagattgtgagctgtgtgtggtgtgtgcgcgaatgcgaatcagcgtcagaaaaaaagaccgaagaaccttgaggggagaaagggaacatcatatcgacgtcgatctctccatcatcttctccatttccttatacgtactactagctttgatcacgtcgagacttttgcgccccgaaaacgaatcgacggcgccacggcggttgtattggtcgcgtggctagctaccctttgtttgtcgctgcccctgtggctttgcgctttggccgtacgacggcgacgacgtcccggccggacgacatgctgcgtgagtgattatttcattatttgtattttgggagtggtttggagatgaccatcaaagggtggcgaggtctatcgtactacatggaaaagctagcacggcgtacgtacgtggaattgtgggcgacaacggatttgttcaggtgatagcgagccccctgacgcggacataacaacaacagcaaggcaaattaatcaaggcttctattggaaatctacgttacggtaggaaacgtatccggcggggacatacgtatattaagaaggaaacgtgctgctccttctagtagtacatgttttctgttcaacttttcgatggcaaagcttagaaacaaaagttaaatccctttaactagtcctaggtagatacagacatactttgtacagtagtatatgtgctatgctccgtactgtcacagtagatggcagtcaatcgttgtagtactacacaggagggagtttatcacgccagattctcgcgccttggaggaggcgacaaaccaacagctggcacgcccagcagccggccggcgccaccgctacttgttgtggctccccgcagcgcgcggcagctctctcgatccatttccgatcgagccgagcgtgactacgccacgacagacggggatcaatcaggagaaaaatcaatcgattacccgtacatacgcgcaggcgcacgcaggcatcagcgcgcgggtcagcgtagcgaccccccgttttctctcccactactcgtgccgcgccgcgccgctcgccgctcccgcaacgcttggggccgcggggaggcaaggccgcgcccgcgcgctggcgcggcagcgttgcagctggccacccgcgcggccgcctgcgaaacactgtggacctctttcgtacggggcgcgcactgccacgcccccgtcgcgcgctgcccgcacgcggcatcacgttgcctttttctttcgcctcggcttcgggttcagtacggagttttctctgtattcaccgcaccgcaagcggacggctcggtggaccgtaccagtaccacaccggaccgca

SEQ ID NO: 66682 - DNA, 1169 bp, Oryza sativa
cggattcgagggaggaacgaagctagggttcacgggagagggagagaggaggccgggcgggaggaaggagacgaccggcctggcgcgtgggccccacgcggtcggacgcgcggtcagcgcatgcgcggcgcgcgtgtgcacggccggctcggctcggcctggcttgggcgcagcttgggccgggcggccggcccaggagaagaggagggggaggcggcctgggagaaagagggaggaggagggagtgggccgggagggggagaggaggcccgggagaggagggaaagagagggaggagagggagactttggccgtgggccgggagagagagagggaggactttgagccaaatttggcccaaaagaaaaaggaggattatttttagatttttctttttaataaactttgataattgtttttgttgcttaataaatattcccggcgctctgaaaattcaagtaaaatttgagggctccttttagaccaaggagaatttaacaaaaattctccggaccacattcgaatttttcttgtacgtattttagtgtttgccaatttcttttcaaattttaattaattctattattccttttagaaaatgatttttaatttcgggatgaatttatcaggacgtgacatagagtacccactagttggggttttgtttatcctatggtgaacaaggtaatagtaaacaatagcaatgataaggctataacaaggattaataggaagtgctaaataaaacagtgattacgcgggaatttaaataaagcggtaatgcaataatttaaatcaaaataattttataaactgggattcaatatgctcaagggtgatgtgacttgccttgctcagagagaacggccttccgaacctttggcgacgaccacaaaccacgcttcgagaaccttcggaacgacagaagctacgcgaagcacacaagcaaagctacaagcctataaagaagcaataacaatacataaaaagaaagcacacggttctttaggttatgacaaacattaggagacttgaacaggtcgattcggggttcgtatgaccaagatatgatcatccgaagtttaatgctgttacatggagatttacggattattgtgattaggttttgcaattataaaacatgtgtaagcgctagcctggaaaagaca

SEQ ID NO: 66683 - DNA, 20032 bp, Oryza sativa
gcattactttcctattttagtaaatttatacacctaaagtttgtgcacctcaagtttacacatctaaaatttatacacctaaagtttagagacccaaagtttatatatccgattcatatttgaatttgaattcaaatatttttatatatagtatttctatacatataaagtttatacacctaaagtttatagatccaaagtttagagacccaaagtttataagtcaaaagtttatatatccgattcaaatttgaatttgtattcaaatatttttatatatagtatttctatacatctaaagtttatacacctaaagtttatagagacaaagtttataagtcaaaagtttatatatccgattcaaatttgaatttgaattcaaatatttttatatatagtatttctatacatctaaagtttatacacctagaatttatagacccaaagtttataagtcaaaagtttatatacccgattcaaatttgaatttaaattcaaatattttttttatatatagtatttctatacataaatttctctaactttgtttttttaaaaaaatcccaatcaaagattaattgtgtgctactatcaagattcagtaaaactattgtgtcacacgcacacacgaggtgttagtaatttcgtaaagggagatataacgtcgctggcgcatggatcaattcagcaagctctcttaacctttcgtgactttgttatcacggtgagatcacgttcaaagatggtaggctggaaaaccggccgtgccggccggtccctgctgcaggaagagggctgaactccagtttgattaggtcgcctggccaccattcgagcgtgacacctcttgtagtgtacctgaagattcgttagttatcgccaggttttatggtacacatgtcacttttgcaccgttagttctcttgtttctgcgaataggtctacttgtccaagtcctctgttttttttttcaaatgcctggaaaacactatcgtccaaaagatatccggtatgcgacaaaagagaatttatattgacctttaagaaatatatatatatatatatatatatatatatatatatatatatatatatatatatatatatatatatatatatatatatatatatatatacacaccatcttttctattctagatcagttgttaatactacatataccagtagtttctaaattacgtagatgcgtggatgtacaatggtcaaaaggatatagcatttgttcgtgtagggtgaacttttctaagaacccgtgcgtagaagctccacgcacatacactttgcctcttatcatctgttgattgtcttattagctatagacaaatttaatttttaaactcaatttatttgcagttgattttggagttatttcatcataatctattttttccgtattggtttttaaaccaccaataacacataagtaatgttttacatgttactttctttttcttttttagctgatcaaagtttatttcatgatgcagaaaactacaatattagtacacgtagcttgattcaaaaccaggtacggtttatgataacaaattaataagatcacataggtaggaaaactatgtgcgcctatttgaagagatcaaacatttctacgtacagaaatcatcgcattatgtgtacaggctgacaactcaattccaaacattcacataacataaaatgtataaaaagaatacatccatgtggacacaacatgaaaaaattgaaatggaagctcaatgtgtaaaataattccatctagctgcaaccacagagatgaatagcatgatatatataaataccaacaagtcaatatatatctccaatttttaaagcataggcgatgatcggttgcttggaatcaaaggattttatctgcaatacggaacagggttaggccaacaacggttgaagctgacatgcagatagtacactcttgtgatgtatgttacctccaatagaagcacagcggacgcactcgctagctagctagctcctgagagaggagctccctctctctctcttgttgaccacaaaagcaatctaacgcgcaggaaaggaaacgaattaatttttgaaggatagtatattatagttaattaacctctgataggtagttgctgttacccatgatatgcactcgctatcacgggaatgttgactctgttataggtgctaaggcccaatcgacttaatatatactccttccgtacttgtaaaggaagtcgttttggacaacgacatggtctctaaaacacaactttgacttcttgtttatataaaaaatatttattgaaaagtgatatatgtatgcttttatgaaagtatatttttcaagacaaatctattcatataatttttacattttcaaattcaacaacttgagagttatttatgatttatattttcaaggtttgacttaaagattgtcctaaacaacttcctttactagcatggagggagtatatcagtgtgagagttacacattaagaaaattaattgtgtggttattaattcaaactaacgttctcgcactccgtatatttattcttgatagggagcatatatacaacacaaaatgtactctttaactgctcctcctattaaaaaaacatattgtttggacatcgatacggtttgtactagctatccaacatatattatacgatactagtgcctccgatccgtttgttttcaaacgtatgatcgatgtcgttaatttttatatatactgtttggctgtctatttaaaggtaacttgttttatcattaacgagtgccaatgtactcccctcctaaaagattatcatgacagttagtcaaagtcatattaaatataagaggttaaaatactactatgtacttcattaatttttaatatggagagaaaacaattagcatgaggaaattaatactattgtttgatgattaaaacaggaagaagcgtataaagtagtattaaaggttccgttgaacaaacctctaaaaccacgatctttgtaggataacatttttacgctaaaaaacaacggtcttttatggattcagggagtagtatttttatatatttacactaaatttcctaactagccgaatgcatggtcaaatgtcatgtaaaaaaatcaataatattgtggagtacattttaagagagagagagtaacagcattattgtattatatgaaggtactttcatgataaataatttagacatggtttaatttttcacatatccaattcaacaatttgaaaacgcgtacaatattaaagtttctaaggttagtttgggatataagaaaacaacatacatatttttgtgacgagagggagtactacaatttacagaaaggtgcatgcagcaatatttggtctccttaatttccatgccctttagtctttatccaatattccattaaaacaataaattgggtgcaaaactagtgctatatattcaagttaacagaatattggtagggcaggttttagcagcaatcctaaaacggtcctaaatgcaaccattagttaagttaatcagcactgtgtaatttgcacagtacgtttgacagttcgtgtttactgagcaggtattatattaggaactgaagataaaaacagattccgccatagctaaaataatccaactatcttcgattgatcggcatcaagtagcacatatacacgtggccagagctagcaactatttccacttactccctccgtttcgaaatgtttgacgccgttaactttttagcacatgtttaaccgttcgtcttattcaaaaaatttaagtaattattaattctttttctatcatttgattcattgttaaatatatttttatgtaggcatataattttacatatttcacaaaagtttttgaataagacgaacggtcaaacatgtgctaaaaagtcaacggtgtcaaacatttagaaacggagggagtataaactgctatacataggaaaaaaaagcactcaaaacagcaagacatatagggaagtagcggtatgtagttacaactcaacctacctaactgagcttaatttaatcaattaattattaaaccggagacagacacgattagataataaattacgggattgaccaggtaggtcgaggcgcccaaccagcacaggaaaacccgtaacaactaactcgctgtggctctcctcgtcccctacaagctgaaaattagctagggttgagcaagattatgagtaaattaggctatctgaaccgtagaagaacttaaccattctaggcatgatcagtgctcgtgtgtctaactgttccagaattgaaaaacattaatgtaagaagatagtatcttgcttgtgtagactcagtctcattaattatatatatttgccaatatgtaatatatagatagatatactttgtcgcatggtttgtttaactaattaatttgttcttgctagctagtgcatatatatggatgggtatagtacaggcacagggcatcgtcaatagtagttctgaaaactactgataaaattaactaacaagactaatattctgcgctgagatcattaattgacatataaggatgctcactgtgtactcaacttgaggcataaaattgggtctcccagtgaaggaaacttaatttattttaaggcacatgcagccataattaggtgtcgagttacattttgggggagggaagagtgattgggttggttaagtagacgttgtaggtttgacaacatcagagagatgttgagacctgaacaacagaattccccccaccaagcaaaccctactacagcgcatgcatccatacatgctgcatcaatatatccatcttaattatattttccctggcctaatctatcccaaattaatcctgaaaattattaggtgcacctagtgaagaattttcccttgcacacaaagatcgacagagctagcagctgcagcttgtgaagatcgatcgacaataacaaatgatctttctgaaaggtacatacagatcatatttaggtaacggatgaagcagcttaaataataagctagcaacagaagtagtagtagtacacagatcatcggttgaactatatatttggttgataccaaacatttttaccaattagctagctatacgtactactgtaatctgtttttagttaacccttcccttaaatactctgatgacatatatatattttctacgtactatactactactcatgtagttcctcaattgtcatgggtagttgcatgcatggcaccaacatgcatgcagaaatcatgcatgcatgctagcttaattaggttctgtaagtatgcagtttgttgaacaatttgtgtaaccggagaggagatataggtagttagttaattagttgatcttgtgtggacctacacggcgtgcgcaataactgacatttttctattatagttgcgcgagaagcttaacttacaaaaccaccagttagcccacacgtagcatcaaactaacctggtgtaaccatctcccatctcactgtctttagcttctccctaacgatcagcacaagtgcacaacgatggagagatgtagctagctagcttatagctaaaaaaaaaaaaaactgcccaacacaagacaccactttccctttggctagctagatgctggcctcctgtcgttctatatattcccttggccatcgtctctctcttgccttcttcttctcaccctattggtagctcctgatttagttttttgcttctcttcttcctcctctcatctgcatctccagtggcccagcctcgcatccgcggcgcaatcgtttatatatatgtcttgatcgatccctcgcatccgcggcgcaatcgtttatatatatgtcttgatcgatcctcgttcttgatccgttgtctgaattaaccccctgaaactagctaggagattcttttgttgctgcagcttatttccatgctgcaactttaggaagctattacacatatatatatacttgattgagagatacagctagttgcaagattatagcaaagctagagaaagagggggttgagagggagattggatttgcttaatttgttacatattctggtgatcgagatcgatcgatcgatcgatcgatcgggaggatgtgcaccaggggccactggaggccgtcggaggacgagaagctgaaggagctcgtcgcgcggtacgggccgcataactggaacgccatagccgagaagctccaagggcgatcaggtgtgccatcatgatatacacatagtagtacatatctacatatgctcaagaaatgatcaatcgatcgattgatatatatgtgtgttatttacttgagttcttgatcgatctttgggttgagtcggttcattgtacggtttgcttcttcgtggtgcaattcatccgagcaagtttatttgacttgaggctttggcatgtgttttagttcgttttatgatcagatagaattttaatttgttagagtgtcatgtcaaagaggtgcaatctacacagttcatcaatacatgatgtccactgctctgatgtgtatatcacatctatatctcttgtagagcaatatattccatctctcctgtcgagctagagctactactagaggtagttactaattgatttacaacctttcttgctctataattcatccgtgctttttaccttctcaatttatagcacaagcctcatgctgcaatggtgtgtcaccaatcgcttaaaaaaacattcatagtgtaaatagtttacatgcacatgtcttattcttttttatgcggcaaaatagtcaggactatgtgtctccagtaagtagtgcatagcatcggccggagccccttggcactcgagcatgaacaggtcctccttgagtagagccgtgcccctcgcagggggtggacggagatcggcaggctgttctcgggccgagaagacaagtgccgtcaagaaccactggcatgtgatcatggtacggcggtgcaggtagcggatttggctgtcgcatcgccggggcggtgcctccgccgccggtgctgcgaaaggcgacgagagcccagttaggattagcaacggcgagaagacggcgacgaggcctcctgccacgaatggcagcggcatggccatggcctccttgctcgacaagtaccgaagagaatgcggcgccgctggcctgtttgcaattggcagacaccataacagcaaggaggattattgttcatctactaatgaaggtgtgtttacagttaaacatacaacaatctcgtatgccaatagtacacatttaccattgatccattagttcaagtctataattaatagtgttattcttaattatcaattttactatatgctaatggagaattaattgttttgcagatacgagtaaatcggtggagttttacgacttcctccaggtgaatgcgagctcgagcgacaccaagtgcggctcgagcattgaggagcaagaggataaccgggatgatgatcaagctgaagggcaggtgcagctcatagatttcatggaggttgggactacttctcgtcaatgaatttatccacatacatatgtgtatttaactaggggatcaaatgatccaaaacatgcagcttgtaatgcatgctttgcagtttgcatgctgtgaaaggagagggatgctgatagaaatctaacaccaaaaattaaagtatatacttatagaggaagagaaatgcgatgacgtacgtatatatatgacatgtaatttattgatgtaattaaacacacatatatatctgttcgatcgtccatcctcggatcgtacatgtgaaattcctcatggtaaatgaggaattaattattctctcatctatttgtaaatttcaattaataatataaaatttaatttctgttttgttactcaattgcatttttttatgccggacggatcgatacttgattgggatataacttattgcaatacaccacttccctacatatactccaaatagttcctattggtctaatagtattaattaatattactacctatatatccaaaagagtgtatcttttagtactatttagctaaaagagtgtctaaaaatattactacctaattatccgttgcctagtacaatatgaaaatgcagcagcaattttgacattatcagtaatttgatgtataattaactatgtgaatacgtcccaattggacatgtgatgttgatgccatatgtgatggaagcagtccaccatatttatcgtctaccattttgtttgtggatattatattctgtttatgaacatatagtttaactaatttcacatcgatccatcattgattgaccccctggctatcctagcttttctttgttttggacttcatctatacagtataacgtacgcatgttaatttgattcggaatggaatatggaagatgcatgcatggaaactaatatgcatactatactggtgacgatggatagttgttaatttgtcacctttcaagtgcacaaacttatccgatccattcacgcttctttgtcgaaaaatcgcttttagagacttcacccggcctagagcagtgtaacggtgaagcctcctgttactatatgccatgacatgacatttaacaaacctggaagaactttcccatctctctcgtttgcggtgtgccaaaaggaaagaaagtttaaaaaaatgtattggtcgatcatttgtgatatttctataaatctattgcactatgtcgacgtgtcctttttactgcttctgttcgaaaatgacgataatatagaagttacgttttttcactactttctaactaattgacaaaagaggtcgaaacacatgcgtgtcaattactagttctcaaagtatttcaaatactaatattgtaacaagcactcaaaattttaccaggcatatactccttccgttttcaaattaatgataatgttgactatcaatttttcacctttaaccactttactcttgaatagatagactatgataattaaacaaaaaattatgtgcttatatttaggacgctatacattttttaaggaaaactacagtaattttttttaaaagaataacgagtggtcgaagtttaaaaataaacagtgaccggtgttaataatttaaaacgggaggagtataatcaaatggtcatacgagtgaaccactcttttctaacaattataaatacattcgtaatatatcttatagctagctagtatacaactatatatatactccttccatccaagaaaaaaactttagctagggataaatttggacaagtacttgttcagctagattcatgtctacaagttgttgtttttttctgcattgggtatacatccttaattagcaatatatattaattatgtatactcggatactccatatatacggatatgtatatattcatccttaggttgtgggacctataatcaaccaaagtgctgccctaaaggagaacaaattaattaagtgcactacccaaatttattgttatcagttctccagcgcgatcgacgaccccagctagctagatgcctagatatatagcacacttccatccatcattccataaagctattcattccaataaagctattcttcattccatcaggccggccggcagcagctaggcatggccaccatctcaagtctcaacacagttagttatggtgtacgtacttaccaagcacagagacgtcggcgtcagcagggcggcgagctgccgagtcgaactggcgtttcggtcccaagttagctagcactcgcagcgcccccgcacgcaagcgcgctgcaggccgggaccagatcaatcaaaaccaaatcgcccgatcgggtcgcgccctgcctgtgcgcgcacgacgtcgccgtcgccgcgcgcatgcagcacggccgcgcaaacgcaacacaacgcaaaaggcgtcgttttcgaacgagggggggagagagagagagagagaggagattctcccatccccagtgcgggagcgcgcgcggtggaaatgggagaggccaactgcttcccccaccacttcgcggccggcgccgttgttggtgggcgatgtgacgcaggcgctgtacgatcgatatggagctgagaatgagagattgtgagagagcggtttagtaacgggcaagtcggccgtttctcgcgcgatccggcccgtacgttttttttcgttatctcggctcgatcgatcatgcgcgttttttagaagagggaatcggttaatgtggggcatcgtggcgtgggggggatcgaggtcaggggtcgctggagcgacgtggatgggggaggggcgcaggtgggacgtgcgcgtcgagggttaatggggccgtgacgtaccagtttgatcatcatccggccgggacgatggggtgtgcaagtgcaacttaacgtcgattattcccagggtttagtttagtttaattaggccctgtttgggactaatctattagtctatctattttaatcactttcagttaaaaaaatccaaacaagggtgactaaaagagactaagggcccctttaaattggaggattgttataggaattttggaggatttaatttcctaaggattttttcctatgaaaccctttgattcatagaaaagtataggaaattttccttaggattgcattcctatagctcaatttcataggaaaataagcaagaggttcaacctcttggaaactatcattttactttgtttgtttcctatggtgctatcaaagagaccctcttcatatttcctgtgtttttcattcctataggattagaaaaacataccactccaattcctatgttttttctattcctttgtttttcctatcctacgtttcaaagaggccctaaaagtgcatattgggactaaaatccattagtccctcttggaggtactaaagtggcagcctctctctagagtctttagtctctagatccaaataggaccataatcttgtggtgtgtgcgtgtattagtggaagacaaaaccctctcatagcttgcagtggtcttgaaatccatcctacaagagggccgcttatggttttctacaagcacaacgtcttttgggagtctagtagaacccaacagccacccttcccttttcttaggagcgatttcaaatttagttccccctagcattttttggttattttttctcttgtgtcctcaggcaatggccgtctggccggttgcgtcgtttagttaaactctgttttcttctaatatattgacgtgtaatttttttgttcgttcgcgaaaagagatgattgcatatttggttctttctttatagaaaagtagttgtgtacgttgagacacatatcgggtacagattttgcaggaactactccctcagattatttgatcccttttcctattagaatttatgttgtcaagcattaatttgctattctgcaatcttttgtgtagtttttcataattttttccttgattgccagtttctatcaaaattttatcttctctctttgcgtttttcttttttctctctggtcccgcagaattttattaattccttttattcacattttatatgcttatcttcaaattatatatcagatattgtatgggccccataacaacagcgcattaggacgttaaaccaaactttggaccacagctagctagctccccaagtacacgctggtgtgtctctaacaaaagaagtacacacacttgtgcacggccacgttttgcacactatgcacttgcatagttgcattgcaccccacgcgctcgcatccggaagtccggatcaccggaacgctttgcgcgccgcctcgaccagacgaccacgtaagcgcgatcgagcggcgggctcgtacgtttcggcctggaaatcctccgatctggacctgtctgtgtacggcgtgggtttactgggccgtggtggtcgtggctaaaggaaagagtttgactcccttaaaaagtcacccgaatctaatccgtagccctcaatcgtaaaaccagataggatgactctctaaactattcaaactagtgcaatttgactccctcagcggttttgctgacgtggcggtgttgacccgatcttcatcccacgtggcacttatgtggcattacaattaaaaatattttgtgggacccgtctgtcatttacacacaaaatatactgtgggacccacatgtcatcctttctctctccaacccttcttcctcccccctctctctcccttctctctcttttctcctgcagccgcacccgctgaacatgccggtgtagttgaacccgtgcgccacctcgccggtgctggacaccacgatgagcccgatgaacccttcgtccagccgttccttgacgcagtagtcgatggcctcctgcagcccggcgcccctgtactccatcacggcggcgacgtcgcacgccagcgtggagcgtatgatggccttgccttcccccgacccgatcaacggcgagtcgccgatgcgcccggtcatcttgttcatcagcccgcccgtggacatggccgccgcagtgtggccgtttgagtgcaccactgcgcaacccaccatctccggcgtgggatacggcagtcaaactacttgtaccaattaatcacaggatgtcacggttagatgttagcaatttttataggcgaattggtaacatgagtcaatgcgctgatcgacgaaccaagatgctattggcctccttggcgagcttcagcatgccgacgttgtcctcggtgatgaagtagctattgtccacgacctcaagaccttgcaaacagtgaccacaaagaaaaaaaatcagaccagtccatgacctcaagatctgcaggactcgggtggaccacgctggtaggacggatttgtcctgcagctgctggtcctgccaaaattcgactggattccatggcggccgcgccttgctaccccacaccggcgctgcacttgcatctgctaggcaacgctgtgcacatgcatgttctccgagcagaaagaaacagaggcggcaccccctgccggcgcagaccgggaggcacggctagggccggcggcatctcaggtttcgccgtctacattagccctcccgttcgtcccagcctggcgcggcaccatcatgggggaggccaccggccagacgcccccgccttctccagcgagctgaggccgtcgccgctccaccacctctcctccgactctctgccgtcgccgccgaagccgccgctcgacccgctcaagttccttccttcgcgccagccctcaccctgccgccgccgccgctccagattccgcaccgaatctggaggaagagaaacatacagagaagggagagagagggggaaggaggatagataaaggatgacatgtgggcatcgcaattttttttcatgtgaatgacgaatggagcccatatagttttttattttaatgccatataagtgccacatcaacaacacatatcaggtcaacatcgccacgtcagcaaaaccgccatccaaaaccactgagggagtcaaattgcactggtttgaatagtacgggaagtcatcctatccggtttacttttgagggtcacggattagattagggtcacttttaagggagtcaaagtggacttattccgtggataaatggggctttagtggtggaatgggctgtaatgtagcctgtggccgtcgaaaagctgcgtcaccgttgggctttcgctgacggcctcgtagcgccggccgcccgctttgctcgctcgtgttgctatcaagttcacgttaggtccctatatttgtcgtccaatctgattttcatccctgaaccgtaaaaccggatataacacatccctcaacttacaaaaccagtgcacataacatcctaaggcggtttgaatagtggttttggctgacgtggcgcctacgtggctggtttgactagttctccgtcccacgtggcattgacgtggcgcttacgtggcaattatatctcgaaaaaataataaaaccgtgggcccacatgtcagctaaaaataataataattttaaaatggtggggcccacgttggcccacatgtcagttacaaaacaaaataaatagggtgggccacacgtgtcagtctgtagcgatttctttctccccacttgaccatctcctccaatctagcaatccccatccgcggacggcggttgctgcggtgctggcagcgcacagcacacggagggtaagcggaggggagtgggggcgtggccaggctctcggcctccggggcgcaaagctgccgcggcgtcatctgctccgggcagcgccgcggcgtggctagccgccagggcccaggggctcagccgctcaggcgagcggccacgcacgcgcatgagcgtagcgcaggcagagcagaggaaggggcaagcagggcggagggcacaacagcagtgcaaccgtgcagcaccaagcagcaacaacaagcaagctaactagccactcaagcagattgaaattgtgaactaatagctctgtatcttattaacctgaaataatggactataattcgatgtttgcttcaagaacctacatccacacctttacatactcaccagcgagcgacggtcaaagaggcggggctggtacggtggagccatggtagaggagcggcgtgcgactgcgactcggcggcaaccggctcgccggcctcctcttccccctctcccgccagcacagccggccgccgtggtatcctcctcctcctccgcggtggcggcggtgggcggtgtcgagctcccgtccgcgcgccgctgcgactcggcggccggcggagccaagcggagggcgccagcctcgtcgtcgtcgtcttccggcgcgcagcggcgcgaagctggcggggcggggcggagcgggcgggcgaacggcggcgcgaagccgacgggacggagtggggcagcggcgggcggacgcgccggcggagtctccttgaggtcgtcgtccccggcaccgccgagaccgtggccagagaggggataggggaggaagaagagatggggtgagaatgacatgcggggcccacgtgggccccaccattttttattcatttgtgtgtgaaactgacatgtgggtcccatggggtttaatatttttttttatcgaattgccacgtcaccgtcacgtcaatgccacgtgggatgaagacctagtcgtaggcgccacgtcagccaaaaccgcccttcatactgtcgagggatctcgtttgtccggtttttgtaagttgggggacgggttgtacctggttttgcggttaagggacgaaaatcggactagccaactaatagagggacctaaagtgaacttattccttcgctagttgccattgaactactcccttcgtactgtaatataacaagcttatattcatagtactagcttcaataacaacatattctatgttttatattttagagtgaataggataaaggggacagataggtaagggcatgtttagatctctaccatattaatccattaatagtgctaatatctaggtaatctttggcactgttaatgaattagaatgaattagtaaggtagtattatcagatcatgtttggattgggattaatataaagccaaaatttgcgaagtgatttagttcaactggttcgatttattgtggtggaaccaacccaccggggttcaaatcatagatttgacacgagtgcttacatttacggataattattctttcggtggtagacaacgtacccgactacccgtcgaacgcccatggtgacttcgtcaatctcaagatatgtcgacctaatctttcggagatgctcgtagaggtagggtgtgcgtgtgtgtttatatggtgagtgcacgcgcattgtgggaacttgtatttgttctgtgtttcccgaaaaaatcatagtgaagaaacttctagaatttagctaaataaaacatgggcactatcaatttggttggccttaatccaaactagcacatttactatttatattgctaaaaaaatggttttacacatttaggtatcaatccaaaatgtccccaagtcttttgtcgtttatctcacttgtatatttcttcttcgattttttatactgccaatgtagaaaataaacttagtaatccagttcaatatggacagtgggattgtctacttcttacatcgaactctagttatctctgcaccaacttattctaccgactaaagttgctcagaaattgattctcgacactccttgggatgcatggatatgtaagagtaggatttttttatgagttggaggagagagaggaagagagagagagcatgagcatgcgactaaccagtcgcctgtgatgtccacacaaaagtctttccatgtctgcttccttatcgtcttcgatgtggttgcgaaaaccaagttttttagctagttaccataacaaaacgagaagtagatgtaggttttgggtgaagggacttccacagtgggccaaagtggagtttctattgatgaggtgaatgtatgtgcattttcgaccatgtttagtagggtttcaactcctaaatataactttaggagctaagtctatagtggagttatagagcgttccgaaccccaccctatctctctagtttatttttttcggatcactctagtctgctctgctttcttttcgagtgaaactaaagtcgtttggttgggttcaactctaagagaagtggagctaaagctaaagctttgtcaaacagacctttcgttaccctcagttaggggagagcaacaatggattcctaatagtactccatgtctaaatgcattgattatgaaagatcacagggttagataaaaacttggtaaaaatgaggtatgatgtaagttgtgaatcaaactgaatattgactagatataatataatgctaatctagacaataacattgaacatgaaacaattacacatacaacacagatacatatgacatgcattcgattgctttctatagcgggcagcgctttcggtaacaagcaaccaagcatgttcatactactgataatatattaatttgttttcactatgaatgatatgtgacatatatccaaacactcgtgaatcaataatgagatccattacctctctaaaatctgaacaggcatgcacgtgtgattgtcattccgaatcaaagtggtttctgtcaaacggattcaccagaccaattggcagacccctttagagcatgtataatagcagactataagacaaccagaaacactaatgtgcgattgatcgctaccgcgatgggtagcgatcaccacccctcccccctccctccctccacgtttccttttttggtaccgcattactttcctattttagtaaatttatacacctaaagtttatacgcctaaagtttatagtcccaaagtttataaatcaaaagtttatatattcaattcaaatttaaatttgaattcaaatattttttatagtatctctatacatctaaagtttatacacctaaagttgtagacccaaagtttataaatcaaaagtttatatatccgacttcaaatttgaatcgggtatataaactttaggtctataaactttaggtgtataaactttagatgtatagaaatactatatatgaaaaaaatttgaatcagatatttgaattcaaattcaaatttgaatcggatatataaacttttgacttataaactttaggtgtataaactttagatgtatagaaatactatatataaaaaatatttgaattcaaattcaaatttgaattggatatataaacttttgacttataaattttggtctctaaactttagatgtgtaaacttgaggtgtataaatttactaaaataggaaagtaatacggtgccaaaaaaagaaaaccaggtggagggagggagggggaggaggggggcctaccgatcgctaccagatcggtagggcgatcgatcgcccattagaactaccctaagacaactataaacacattttgagaggataaaataaaagagagaaaagtagcggactacagatttgttgccagctgtagcacgaactctaatatgcatgtgtgtatgataggtgagtccatatattaattgtatagtatatgtttatatatagctatggtataaattggctataaaattaactataattcatttggagcgggtagttggccatacccttgctattatacaaccctaacttacactccaactaccacggtaggaaccaatcacaatgaggggcttacataccggacccacaaaagatagcgcaaagaaaaatgggatcaatcttgaactgacaaagagggcccacatagcagccagacacgacttgtggactctgccaaacttaaaccccagcaactcggcttcctcagccctgcgctgcgttgcccccctcctcctccgccgccgcctcatcccaccactcgctagtccaatctcggtctctccccgcgccgccgccgccgccgcgccagccgcccctccccccgcggaatgggcgcgcaggaggcgtcggcggaggaggcgctgcgcaccgccgcggccgaggtctccacctgctcgacgacgcgccgcctccgcctgttccgccacaccctccctcatctcctcgccaaggcgtcaggtacctacgccgccatcgcctccgctcccccctatcccctggatcgcgcgtgctccccccttccgtccgcggattagtctccccgtgcgcgttcgcttgctcccgtgctcctaccccccctttttttttctgcgatcgagaaaattctcggactctgatggcggatttgctttgatttgtgggagctagggctcatcgtcccgcgttgcgcgtttgcttgttcgtgtggttgcccaattccgttttacttgtagcggatcgtagctcgttagcttcactcgtctgtgaatgtggtcgctatcctgtgtagattgagaataatagtgcttggttttgctcctcttttgcatccttgtctcgtgttatgccatgcgatctgtagtgttattttagttgcttagattacagttaggtcaggactaagcagctacgtagcttctggagttgcttgctgttgtttcatcctgacatctgtttagtagttttgaaccaagagaatgcttgtatacattcgtgtgaagctaagtctctgcttgcttccaagtggttccgcaaagcaccattgttttgtatgtatctcgtgttggtctgatctgcaattataactgaattgcatcgcgcgttagtcctgactgcaagggaagttggttcgtgtgcactcatcatctccctttttctactatctgaccaaagcttttattatgataagcgattaagttcacagatgcatagtgtaatctgagcctcccttgaagtacctgcattcctgatgcagagcgccagagcatatgcttctttgtgttgactagatttgatagtgatatgtcactctaagcttaatacgttggacatgcttgttgaatataccaaaagtgaatatgatgctacaactgcatggtctctgttaccatgcagtgtatatgtttatcacacacacttatgttacggctgttcatgattctctagaaaacttgttgcaaacaaaccaaggccgctgaactgatgtaatagatccctacaccaccaccactaataagttaataacacacacaaacacatactttccttgctacgcatctggctgatacaccttcatttcattatactattccatgtataagatcgatgcaaagctgtttttcttaagattgctttgtcccccctgcagagtcaccatcagatacaacattgttagttgatctcattttccagacattgcttatatatgatgatcgggcatcgagaaaagcggtcgatgatatggttatacaggctcttggtgaatctactttcatgaaaccctttgctgcttcacttgttcagtgcatggaaaagaatatgaaggttacaagtcctcttgcatgctt

SEQ ID NO: 66684 - DNA, 760 bp, Oryza sativa
tgctaagcgatatattctgtgcaaaaattatctaaatataagttaatttaaaatatcgaatatatctatttatcaagtttataataattgaagtaaattaatcatgtgttaataactttctcattttacgtgcaaccacttaatcttcatcttcactcaatgtctcgctgaagtagaactgtagagaactagaaattcgtcatatttgtcccagttccaattgaactcagtagctcatttgctcccaggccacagggccatttcggagtagctggtctccctgagtatttttgagtcggtgaactgcagagatggatggtcatggtctggcatgcatataatactctctcttaatccctgaatacgatacgatctcatcagagacagtggagctcatgtgttgatttaccaaaattagttttctgtggtgcttgcagctgaaacaggtctcaagtgtcatggaagacatgcatcggaaacaattctcaaatgccatggaagagcaaaatttgctctttgcagcagtagttgttgtgttttcagaggctcagagatgcatcggtgcttaatttgtcaggccctgcttggtggaacggtggcgggaatgctctaggaactttttagcatttagctcaaattcaattagctcttactcctatttcagaacttgaactggtgctctttttcagaattttttttatagctttcatgcttgaaataatcaaatcagttgatcaacagcagtctgactaagtgttgc

SEQ ID NO: 66685 - DNA, 3900 bp, Oryza sativa
actctctttttctttttctccgattaatgtgagaatttctagcctccacagcgaacgtggtgccttctttcaaaactgttttaataatataatagatagatagatagatagatagatatcgtttgttcctatgtcattatctagcatgttttgagggatcaatgattaaaacgatggagaatgttagtcatcgttctgctacatcgactaatttttgtaatagaatgaacccttctccacttttataatagaatgaacccttctcttctcttacgtaccctcttcctcttcaatctaaatgtgtggattgagttgagtgtggtcaggacgtcacactcctgtttgttcctcaatagtttttatgttgtagacacgtggtatgtttttttccatgttatagcctcataaagattatggttttgtaaactttttctactgtatcaatataaaccttgtaccatcttgtgcggttttgtaaaaatatttattcattgtacaacaggacgaaaaaatatttattcattgtacaacaggacgaatttggattacagcgtagagtggaaaattctgcatattgatgattatcaattgtacctgttgcaatgccgtgtcggcatgggttatagcaagaccgactaataataaagctggccaatggaaaagataaactccctctatcctatgatacaaggcatattaaacttgacacggtctctacaacttatctttgatctataatttctcatatattataaggtttgtaataacaaaattataagcatatgaaaataaattcaaattgccaatccaatggtataatttttagcaagtaaaattcaattcatattatactaaatgtagatcaaaatgttttgaaggtagaatcttaaaatgcgtggacgctttatattatgggatggagggagtaatagattagttacacacacacacacatatatatatatatatatatatatatatatatatatatatatatatatatatatatataccatgtcaattgtcgcatcttcccttggataatagtagagctcactttctactattagctcatcttaaagccaacatatataatagattagtttataaggttggttataattttcttcttctctctccatctctcacgtatttgtttttaaacttgtgataagattagctcttacatgagagtcaacactcttaattttttactacctctatcttctatctaaacttataaacttataggaggtttatagctccctactaagtagacagcaagtggccgtataaaaagtccaacttgagttcgtcgcgattccagtagtttgaccgggcctatttggttttccctgacgccgatgcaaccttgacagattaaaattaaagttgtggtctagcagtctatggtattacataattgtttccaacattgctcactctattacacaagtgggataagagttgtaattgtgtacactaatcgatttattttatgaacaaatcatgcattagcaacttgcagattcgaaactgaaagcatatttatggatatgtacggctgataagttcttaaccgtcccggtgggggaacccttgaacaccaatccaatataagatatcttaatctttcaactattaaaatcggtgcattttagctttctcggtggttttgagggtgccttcggtgacgtgacgtctacatgacggtgtgacctagtctttatcccacatagtgcttacgtgacattagaatttaaaaaataagcaagagaattgtcgatagaattaaaaaaatacatggaacttatttgtcattaaaaaaatattataagacccactgacatatgggcccccatgtcatcacttctcttcctcctccctctctacgtatatgaagacttgattcacctaccacaaaagctaaactaggatgagagcggctgcttctttccactccccggcgaccacccataccgcttcttctttgcctggtcgtccaacgaccctgagctgccgccaatcatatcggcgccggacatggacgcaatcctcggtggcgcgctcatcatcttgtgactggtgttggtgctgtagtgctgcatgtaaggccggatgcggcgcgcgcctgcttggctcggctcggtttagctcgttaggataacgagccgaacgctaagttgttagctcggctcgtcttgttggtaagctcgagccagctcgttggtaaaattgcaaggctgcacttcagtaagcagctagcacatatcaagccagccagcaagatggcagaaacgcataaagcaaatgcatatccataatacgatgttccaatccatagcctatcagcaattcacccaagaagtacaaaaatatcaaatagtaactatgcaaaattgcaaatgtaacaagccaataaagcaaaaagaaaaaagcaacaacagatcaagtcctcagtattgacgccaatgaaagaaggaacaaaacagcaggaatacaggcttgctcgacgttgacggtctcagtactgacgccgacggcagcgaggaaattaaggaggcttagggtcttcgatcaaccatttgccgatgcaccttgattagaaacttggtggcgccgatcccaatacctccaggatgctagggatgttcgctcgtcgcgcggtgcaatgggcattatcaccaccaaagcagtctattcctcttcccaaaattcgccggctctgtgccacaatggcaagtttatttgggacaacagagctccgcctcgagtttaattctttgcctggcttattgccaaggatcgcctccccacgaaggttaatctccataaaaagaacattgtgcaatcccccaaatgcaagctttgcagcgatgaagacgaaacggtgagtcatctttttcttcactgtccgttcgctgatgaattctagagatctctcaacattcaccccggcatctcacgcgtgcaagatctctcaggtctagtcgctcctaggcagctccccgctaaacacttccaagttttatatctactctgtttctggggtttatgaattcatagacatgatgttgtttttcgtgatctgcctaaatcactcctaagaatggtagcaaaatgtatggaagacgctaatctttgggctgagtgttttcgtagagaagacagggtagttgtgtcaatttggaaggatcttctctcttcctccgtacacgtcactcgtcatgctaaggtggttgatgatggcgctagctgcgcgtgtgtcgcagttgcgcaggcatggtgcgcatggctggtgtagaccgggagtggttacacagcatggcacatgcgctggcactggacacatggacgtggccaagagaggacgttcctggcctagggttgatcgacgggggcgtcgatctctcttaaggggggacgtggccaagagaggacgttcctggcctagggttgatcgacgggggcgtcgatctctcttaagggggtgagggtgtaacatcccggtctagggcttaataggattaatagaatactcatatcaacaagttgcaacttcttttccggaagccaatctccaaagaacttcagggttaagcgtgcttggcctggagcaatttgggatgggtgaccgactgggaaattcttcccgggtgcacacgagtgaggacaaagtgtgcagaaaagacatgtgttggtttgtgagggcagtctatgacctatgaaagctatcagaagacgggacgttacaaaatggatagatggtgacgggcgacagccaacagcgagatgcggagggcctggatttttcacattttggtctttttaaaaaacttattttgcaaatagacccctaaaaaaacttatcccggaaatggtcctttttggggcgccaga

SEQ ID NO: 66686 - DNA, 1783 bp, Oryza sativa
aattcggaattaaaaataaacgttcgctgtgggggttagaaattcccacattaatcggagaaaaagaaaaaaaaagagtcaagtagaagtacaatttaaaaatagctgaaattcggaattataaaaataaacaatattgaaagaagtttccatataagaacccaatacgagattaatcaaaattcgaaataaaaataaaataaaaatccaaaattagaaaaggaaaggagagtccaagtagaaatacaatttaaaaataggtgaaattcggaattaaaaataaggaatattgaaataaatttccatataagaacccaatacaagattaataaaaaattgaaataaaaataaaataaaatccaaaattagaaaaggaaatgagagtgcaagtaggaatacaatttaaaaatagctgaaatttgaaattaaaaataaggaatattaaaagaagagtccatataagaacccaatacgagattaattaaaattcggaataaaaataaataaatccgaaattggcaaaagaaaataaaaaataagagttcaagtaggaatacaattctaaattagctgaaattcagaagtaaaaataagcaatattgaaagaagaatccatataagaacccaatacgagattaattaaaatttagaataaaaataaaataatatcaaaaactagaaaaaaaaaataaaagagagttcaggtagaaatacaattttgaaacaactgaaattgaaaataaaaaataaaaacattaaaagaacacaatacggtattaactatttttttaaaaaaataaattctgaaattagaaaaagaaaaataagatttcaattaggaatacaatttataaataactaaaatttgtgataaaaataaagactattgaaagaaaaaaccatctaaaacacatgacgagataaattaagtaacatgcctataaaggagtagagtggtggcggttgatacgacatataaaaattgttaataaaacatgaaatagaatcctaatgacgattaaaaggagggatgtcaggcaagccgtgaagcaaacaagtaagacggttgccgggacttttataagtaaaaaaattaaaccccattgataatcatttcaatttttaaaatctcaatgacaataaaaaggagaagcagcgtgtggggtgtataagagtatagttgcagagccatcgacggttgacgagacttctagaaaataaaaaatgaattccaatgatagttatgtttaatttttagaatcacaatgacaataaagagtaggtggcggatgggatgttgaggtgcgtagtggcatcgtttgataggacttataaaaattataaaaaataatgaaactacaagtccaatttttaaaggtttgtaacttctaaaaggtaaaaaaaatgataatcatgttcaatttaaaaatctcaatgacaataaagaagggaggcagcgggcgagccgtagaggagtacaatggcaaagccgttgacggtttggcgggacttctagaaagtaaaaaatgaacccaaacgataattatgttcaatttttaaaatctcaatgacaacaaagagaagagacagtggacgggccgtagaggagtataatggcaacgtttgacgggacatctagaaattataaaaatgaaatccaacgtgataataaactctaaaaactataaaatacaatttttaaaggttccaagaagaatgaatagaaatagtgatagattgagcaagcaaataaagaagaagatgacataaggggtagcaactg

SEQ ID NO: 66687 - DNA, 16199 bp, Oryza sativa
gctctcctccctagggcggtgccaaccattttggcgccctcctcctgccacgtcggttcgcgtgtaccacggtggcaagaggacggcgccagagaggctggcgccgtcccgttggacgacggcaccagccactctggcggcccaaaaaggaccatttctgggataagtttttttaggggtctatttgcgaaataagttttttaaaaggaccaaaatgtgaaaaatccagtgcggagggcagccaacggccggcgatgaccctgctggcggcggcacgaggcgtgatgggggaggtcgagacggcgttgggagcgtcggaggctcgatgcgagatgggggggagcgagagtgcaacactgggatcgagataacggggggatagggatctaaggttaatttgtttgcatttatacctggtgcctagttgggctgagcctctaaatatttttgttggactgccttttgacttgacctcgtttagctagtgagctggctcgttatgacaagggataagttcacattgggtccctctatttgtcgcccagtccgattttcgtcccttggtcgcaaaaccgggtacaactggtcccccaacttacgaaaccgtttaaatgaggtggcgtcgacgtggcttctttgactaggtcttcgtcatacgtggtattgacgtggcgcttacgtggtaatttgatccctgaaaaataattaaaacagtgggacccacatgtcagcttcatatccataatctatccggttatccgctctctctctctttttgtcagcgaagaaggacaagcggctgagccggagcggacgacgccgatgaccggagcaagctggcgacaagaacggcggcgccaagggccgggagccactctcctcctccttgtcggccgtgggcggggagatatcggcggcggcctcgacggggagccgctctcgctaacggtggccgcggaaggggagatgtcggcggcggcctcggcggggagccactctcgctgatggtggtcgcgggcggggagatgtcggcggcggcctccgcggttcgggtcttccctcgccggattcttccgtgacagtggtggcggcagcatatgtcgtcacggaggaggcaacgatggagatgaggagcacggcgggcatagagggcggcgctaggatggagatgtgtcgcgcgccattcctctcccgtcggtggccgcatgccgttcctctcccgccggtccactcccgccgcccgccgctcctctcccgccaacgcccgtcggcgggcgcaccccgctcctctcccgccgcctaccgcccaccgcacctcgctcctctcccgccgtcagccgcccgccgcacccctcctcctctcccgccgtcagccgcccgccgcaccctgcttctctcccaccggcgtcgttgaagcatacagagccacagaggtagatgaggttgaaaaagtgggacccgctgacatgtgggtcccttttttattttttttactggcatgtgggtcccacaaattttgtataatttttttattttgaattttgatgtttttttttcggatctaattgccacgtaagcgccacttcaatgacacgtgagacaaagacctaatcaaaggagccacgtaggcgccacgtcagcaaaaaccgggcacaataccgccgagcgacctcacttgcatggtttcgcaagttgggggacctatcttacccagttttgcgaccaagggacgaaaatcggactgggcgagaaatagagggacccaaagtgaacttattccttatgacaaatgaactaaagcattgcctcagctcgttaggaattcattacaagccaagcccagtctagtcaagctagagacgagctgagcgagctaacgagctagagtttttcgtccagccaattcaaatgaaataactgacccagcgaacaaagacccatttagttcgcgaaaagaaaatttttagatatcacatcagatgtttgaccggatatcgaaaatgtttttcggacacgaatgaaaaaaataatttataacttgcatggaaaccgcgagacgaatcttatgagcctaattaatccgtcattagtaaatgtgggttactgtagcacttatggctaatcatggactaattatgctcaaaagattcgtctcgcgatttcctccctaactgtgcaattagttttttcatttatctatatttaatgttccatgcatgtgtttaaagattcgatgtgaagtttttggaaaaaaattttggggaactaagcggggccaaaataactgacacaatctctcacattctcactgacccggcgaaacaaaaaaaaaagattaagggcttgttcactttgatatcattttcaaccttaccaaattttggtaaagttgccaaagaaaaatggttacatttaaggcctgttcactttaatgccattttcaaccttaccaaattttggtaaagttaccaaaaagtggctacatttagtttactaccaaattttggtaattatataagaaatcctgccaaaattttggcaagttactaaaattttggcaactttgccaaaattttagcaatgacaaaatttggtaaggtttttttggcatcaaagtgaacatgtccttagtttgctgccaaattttggtaactatataagaaatcctgccaaaattttggcaagttactaaaaatttagtatttctaaaatttggtaaggttttttttagcattaaagtgaacatgccctaaacaatcccctatacctctcacagtctcaatgccccgtgtcttgttagcgcggtactccatggacctcgtactccacgctgaagacagttgtgatgcaagacaacctcttggggttattgtggggtgtgtttagttcacaccaaactttccccaactcccaatttttcatcacatcacatccaaaatttttctacacgtaaactcctaacttttttttcaaactaccaactttccatatacttctctccaatttcagaaactaaacacagccgtagtcatttgggaggcggacacaactatgcgcttcgttcttcgtaggtctgtcacctagtattcattaaaaatccttatattcatgtccatattatttgggtaagatatactacgtagataaaaaagctatcatttaaattggtatgggtagaaaagttatcattccaagtttggatatggggaggttattacatatttgaagaactttgttcatacccgtttataatgggtaaaaatctgacataaaatttttaaactcacattcacattataaaatcttatcaattttgcttgaaatttacagagatgatttattatataaaagagcaattttctacaaattttggtccatttctacatatgggactcacatgtctcttctcttacccattaggttacccctacccattgaataatatccacttaatttgggtatagatatttttttagatgtgaatggttaaaattgggtatagatatgggttacacaataccctccctagtggcaccctggtctggtactgcatggatcagtcctactccctcttgaactgggcagcatcctctgagaacgctaataggcgatcggtcgcgcgcctcctctcccacgtgactggacacgtgtcgcgcgcggagaaggggcgcaggcggcggtgcggttttctttttttttcggtttccttttttctcgcacgttcgtttttttggtttgttctgttttttctgcggttttttttcgcacggtttttttctatccgtatatattttttcagttttttgggttttttaatatatacatatgcaaagtttgtatacacatatacaaactttgtatatgtgttttctaatatgtacatatataaactttgtatatatacgtatataaagttggtatattttgtatacatatatatacaaactttatatatgatgtatacaaactttgtatttgtatacatcgtatacaaattttttatttgtgtatatattttttatacatatacacaaaaagagagcaactagaggacggtataccgttttgacggtatacctctctatacacccacgagcacaagtacgattccccatgactcgaagccccgcgtgtctgatcctggcacgatgctcacaagcacctcgctgtcaggctctcagtgcagcacgcagccaacccttggacatatcacgtgctcctgtctctgttggcatcgattgtagacttgtttctattgttttaaaattttgcagtgcacatgtttaactaataaagtgctaactatttctttccgtctaaagctacgtactttagttagacgattatgtgctagatggttgtgctaatatataagatgacaataaaatctctgtgatatttttacggtacacatctagtaatgttgagatattatccgatacccttgagctagctatcattcgacactctcaaggtatcattcaatagatattatctggtactctcaaggtatcaccggtaccaatgaggtatcacccggacccgatacaatcaagttatcatcatatatcaggtaccctcgaagtatcatcgggcctggtaccgttaaggtatcatcatatatccggtaccttagagtgataccttaaaagtatcagatatataatgataccgtaacagtatcgagggcctagatgatacctcgatggtaccggatgatacctcgagagtaccagatatacgatgataccttaaaagtacctcaagagtaccgagtgataccttaagaataccggatatacgatgataccttaacaacaccgagtgcctaggtgatacctcgatggtaccgggtgatgtctcgagggtattatctggtacctatactcttgagatatgatgatacatatggtgtattaggatggtactgtgaaagtatcatgtgtatcacatacatccggtatccttttttaaaattgtatagaaatactgaatttttcagtttgttactgtgatttcacattagtactacaaagctatcttaaagtatatttggtctggtcaaatgaacaaggccatacgtggccgaatgaacatgcacatgcactctgctaggcaggttaggagcagaaatgtgatacgcttggaagatgggcgacaagcgcgtgactcgaggagggcccacacaacaccacggagtgggcgctggctgtagaaagaaatcgtaatctatactgtcgggagaacggaataccgtcctttagtttttctctatttacatatgtatgaactgtagaggagggagactaaaagaggctagaactgaccgcgcgccgcgcgctgctgatcgccaatcagccaggcctggcatcctccgctgccgtgagtgaccatggcagcggcttcctctcccgtgtcaggatctccctgataacctcctcctccatgtacactggccctcttggaccggtgcactcctctacctccaccgtcgccgccgccttggccggggaaacgatgctcgacttgtgatgatcggagcagactgtctcttctctgtcgccactgtcgccgcattattcgtcacggcgctcgcctttgacgacgacgcactgttcatgcctatcaactccgatctaaaacactggtcgctagcaagattgtaagtattgcgatccatatatatcgtagtatcttcctaccaagatgaaacaatatcaatcccacttagtatcctaatttttataatatcccgatcctactattgattaccatatgattttacgaaatcttaggtaatatcccgattctacgatcatataaaatgttatttaaaataagatggtttgaaaataaattaaataaatatgcactagtttatataaaaatcagttaaatatatcaaacataatgtattttcttataaatgtctctatttacataacatatattattactatatttttatatagaatagctatacataattaatataaatattaattaaacttaaaaaaaataaaatctcatagtatcctgatactgcgatacgatactattttaagcaaaacgatactacctagtatcccgataactaataagcttggtcgctagtgggcggtggattaacgggagaagcaacgtgacggtttaatgcagttaatttttaaatcatgtttgaccatttattttatttaaaaagttatatattcatcatttcatttattatgatttattttatcattagagttgcttttaacaagagtaaagtccatcgccggtccctaaacttgtaccgcagtgtcatcccggtccctaaactcacaaatcgaccgttcaggtcctcaaacttgttcaactgtgtcatcccggtccctaaacttgcagatcactcgtttaggtcctccaacttgttcagttgtgtcaccccggtctctaaatttggatttgaatatcatctagatccaataggacggtttaaagactttatatttaaaaataattcataactttttcatgtgaactctaataaagacaaactttatatcaaacttgtagtcctcgacgcgatctacaactttgtagttgaatttttttattttaagtcattttttgtcccaaaatgtaattttaaaattaaaatttcaaaatctataaacatgcaccaatattttgggactctaaacagttttaattcaaaaacttttcaactaaaatgttataggtcgcgttgagggctacaattttgatataaagcttgtcttcattagagttcacatgaaaaagttataagttattttttaatataaagtttttagaccgtcctgtttaggtaccggggtgacacaactgaacaagttggaggaactaaactagtaatctacaagtttagggaccgggatgatacagtcgaacaagcttgaggacctgaacggtcgatttgcgagtttagggaccgtgatgacacaacggtacaagtttagggaccgatgatggactttactctatagtttaaacaattaaatgtgacgatttattaagcatataatactatgtttagaaaaaagtcaacatcgtcgaactagaaaaactgagtttgcaccctaaaaggaaaaaaaaaactgagttcggttccgtgtcgaactcggtctcttcccgcaatagcgccgacccacctgatcggactccgatcgcccccgcccacccataaccctaaacccgccgccgccgccaccgccaccgccactgccgtcgaaacctacgcttcgaaaccatgtcggccacgacgcgcgacgacgaggcgtgcccgtcgacgaccaccaccaccaaatccacaacggacgacgagccggcggcgccggccgcgacgacgccagcggtgacaacaacaacaacagtcatccacgacgacggcgcccctgccccgccgtcgccgaagaggcgcaaggtggcggcggcggcggctccggctccggcggtggtcgacgagagggcgcggctgaagcggaggatcgcgtgggtggcggacaagatcgcgacgcaccgggacgaggtggagacgccctacggcttcccggacacctgctacggctacgccgggtacggcttcgtcgggtgggtgcgggcggacttcgccggcgaggagcgcgccgccgagagggcggcgctggaggcgtggatgcagatcgagtgggagaggcggctcctccggtggcgccgcagcgagcagcagcagccgggcgtcgacggcggcggcgactcctccttcggcgtctgggatgatgatgatcaagaggacagcgagaagaaaacggaatacaaaataatagcaggatgattcatggttttttttgtctatccatctaatcaaatttgatcgaaatcacgctaatgatccatcaatgtgcctgatgtttatacattttttgcctgctgctactgcaatctgatatgtgttcagagtcatctactcctagcaatgggaaatttaactatttgccactcttgtgacatggcaattaacgatttgccacaccgtgtctatgacatgtgggcccttatgtgtctatgacatatgggcctagtggcaaatcgttaagcaccactcgtaagagtggcaaatagttaaaagcccccctagcaattgaatgcgcatctatagatgcaaatgttatgtattcgattctttcttcagtgtcaaatttatgccttcgtgcccccaactttcgttcttgattaatgaaaacatccttggcaaatgctttcgtagttgttcgtctttcataaatccaagaatttcacctctgactatgaaatacgaatgcccccgactgtccctattaatcattactccgatcccgaataccaacacaatagaaagaaaaattgaataagacgaatggtaaaaagttaacactgtcgtaaatacggaaggagtacgtcgaactagcttatgtaatttacatttgaaaattgaaaataaaaattacaaacaaatctactcaaagttacattataactataatgcaactacactgtaactataacataataactatgctgtaattttttaggtaggcgggccgatgctataatgtaattttctctttcggtgttgctcaagtattggtttgttgggtagcgaaaaaccttcactgcgattgtggtatagtagagaatacaatgctcctgttgtagtatgtattactcagatggaggtagagcttaatgattgccgtgtgaaaaagactccgtttgtgttttgggctttctccaaaagccgggtcaatatatttgatctgatttcaaaaaaaaaaaaatgccgtgtgaaacgtgatcgaggagttaaacttctgtacatatagagagagagcaaacaaatgcacggcacgtacaacgtcgtatactcgtatctaagtaatctaaggaacgtgaaaaacaacagattcgtcaaatttctagcagatccgaaaaaaagaaccacgaaacaatcgagccgtgtcccttccgactccaactcttccccggctatacgtacggctccgcgttcgcctccgccttcataaaccaccgtctctttccccccatcgaaagctacgatcgattccaggtcaatttccaacttccaactcgcgtcatcgcggcgaaatctaccggcgatcgatatatggccggcaacgagtactccaccaaggcggcggcggtggaggcgatcgacggcggcgaggaggtcgtggtcctggcggggaagctgctgctgccgagggaggtggtcgacaagatcctggccatcaagaggaggcccttctccttcggcgacgacgacatcggctcggacgacgacgagctcagggagctggccgtgcagcacgaggccttgcaggacaagttcgccgcgtgccaggccatgatccgggagcatcgccacgagaacaagggctacgccattgtcgacgacgagttgcaggtcaggatggccgtgaccagggccctgcaccccttcgttgagcgctaccactgggtcggggaggaagacgaggaggaggagcaggtggctgacgtcgttggtggtgaggaaaagctgatctgagacgcaactgagaattgcagagctttgcctatcttaatagcattacaattaatacgtactgtctcatcggatggcctaatcagtcaaagaaaaaaccaaattttgaattttcaaatctaattttgagtttgattttgagatattttcaacgtagtttcttttacaacattggcttttaagtcacaagaacacatttataaaaatttcacctataaattcatttttatttcctaataagccgttttggcttattaggaaataagccaaacgatggggacctcactttcctatgctgagcttattcagtactccgtatctatcgatctacatactccacatgtctatgtgatggctatttatgtatgcaactaccccatctgtttcatgttatattcagaccgtgtttagttccacgctaaaattagaagtttaaagaaattgaaacgatgtgatggaaaaattagaagtttgtgtgtgtagaaaagttcgatgtgacggaaaaattgaaagtttgaagaaaaaagttggaatctaaacagggcctcaatagtagtatctaactatctacatcattcaaataaaatattgttgcaaggtaaataaatgaacaaccatgtgccataatacaactattatattgacagattctttgacatgcttttcaaacttattatcaaaatatattcaatgtttcatttaatgaaactaatttggtgtataatgttaccaaatttttttataaacttgatcaaaaaaaaatcctaattagggcatcttcagggaaggctgaaacaaaataattatcatctatattgcctctatgttacaatgcttctccaagtgaccagcataaatgtcataaacaaacattacagtacatgacataaggaaaaggataaaaaaaattcaataaatatcacagcaagattaaaacatcacaaatcaactatatgcatcagcatcagaccatcagcatgcatggttaaatcttgatgataatttaacaaatgaacatcacatgcatcgtcgatcgttgcgctaactgaagataaatcattatactatttgacaaaaagttttttataatactagatattgatccaatttcttcaacacaagcttcatcttcaccttgtcgaacacagcgatcgtcctggttccttcctccaattccttgggtctcacctcgaacgccctcgtctcttgattatagacgctgacatactcggcgaactcgccttcctccggtggatcatcggcgaagattttctcccagacatgtgcccgccacagcctccgctcctcctgcagccgctgcgtctcctcgaactcgtcgacgtcgtactccacctcgacgaagccgttgctgccgtactcgacgcggaacttggcccaggatttgcccaggtggccttgaggatgccgttgacgtgcaccagcagcgcctccggctcgtcgtcgtagtagatctccgggaggtggtcctcgtcggcgtcggcgtcggggacgaatgggaatatgggatgtatctctcgatgtccggggcgtcgtcggtgcagagctctgtacggtcgaggacccactcgatcggcgttctcctgcgatagccgcatcgtcgccaccctcctcctcaccgccgccgccgccgtaccgtcggagttagggcacgcctcctgctggccatgctgctcgaccgccgccgccgccgcggccgccatgatttccccggctcgccgcggcgatacatttctgaacgaactcttagagccgtggcttatgtaaaataaaatgggccggtccgtacggttttcgggttaccggaaaccgaactagagttatcgctgcggccccctatccgtgtcactgcacgagcacgacgggggaactattctaatccctcgaggggatattccctcgtttactcaaaaaccatctaaacagttatgaaaaattctagaaaaatttgacaacatttatacaacacatatatataactccacaaaatcttaagtccaaactcaactcacacgtcgagatataaaaaaaagacaaattcagcgtatgaatagtaacgtactgtttatatataaatttgtcttttttgtttctcgatgtgtagatcgaatttgaacatgaattttggtggactagtaggtataattatactctacattgtcaattttttttagaatttttgacaactatttgcatcgaatttagaagaaaaaggtatatgaggggatatcccctcgagggattagaatccactcccgcacgacggcctcacgttggcatcttaaccgtcctcggccgatcggacggctccgcacacagggtcgctggataagaaaatagccgaaattttgacaaatgaccctttcaagaaacttaattaaagataaatcgtaccaaaaactaatttagaaaatgataaaccgtgacctcgacgtgctttaacgtctcgacgctgctataacgttcatgctgagatcttgttcgacgaggcacaaattcgtcggaggagctcgcattcaccttctgtacaatctgaaatcacgcccagtagcgttcccggtcgtaggcaagcgagggcgcaaaactgatcgccctgagagagcgagggcgatcgctcgcccagtagcattcccggtcgtaggcaagtcactcagtatcattccatcgtatcctctttttttttcttttttttttactttaatgcatataaaaccaaatgagaccaataaatacatgcagcttggtgattgcagcacacagcaatatggaatggacgcagcagtggtatgcgccactatacgccattggcaacactgtgcctccaccgtatctattcatccttaccaatgatccccactagattgagccatctcacctaggtctgagctttagcataaggcaaagttcaaaggcaatatatagcacttgagagttgggagattggtattatagggggctgctataggcaaatgaacacaagaaagtttgcaatttttcatggtacgaattgaacagcattgaaacctaacaagtgcatgcactgttaacaagagatgaaaaaatatgcaaaactttgtaatttcacagcgttcaggcactacataatttcacctatctttccttcaattaaatagctaaacttgtgatttttaaagagaaaaaaaaaacagaaaggactaaagaaagttcacttataattagctaattaaaacatctcatattgcatagatgggccagcagtactcaagattgatcgccgattaagatccaaaaagataatcccacaataacaagaaaacaatgacatacgcttgcataaggaaagagatttgcagaatgcattgaattatcattaatcttctaaaccatcattatctaacttataacaagtgacaagtaccaacatcgcaatacataagtctgcttcagcaaatgggaaacctattaggcactcgttgattcagttcttcttcacgaagacaaaacgcttcttctccttatcgaacacaggaaccccaatattaccttccacttccttcatgacaaacttcctcctcttctcatcgtacacttcgatgtaatcgccgaactcgccgtcctcgatcgtgggaagaatatcagccatctcctccgcgagcatctccgcccacaacgccctccgctcctccctcctatgctgcctctgctcgaagtggttgtggtcgtactccacctcgacgaaccccttctcctcgtgcttggcgcgcacccacttctcgaagtccctgaacttgtcgaactcgtccatgaggagactgtcgatgtaccgcatcagggccttggggttatcgtagtaggactccggcaggggatcctccgcgccggggacgccggaggggctctggaggaggaaggggatgtacctcgagatgtcgggcgcgtcgtcgccgcacagctccttccgggcgaggatccagtcgacgttttcctgcgacagccgcagcttcgccgtcgccgtcgccggaacctcctcgtgggaaccagttgccgccgcagccatatatacttgttctgactcgccggcggcacgcagagggaagtttcgatgcttggattgccacaaaagggaatctcgtcgtctcgttaacctaagcaagccctctcgattttggagattgtgggggggaggaggcggtgcggcgtgcaggtttatactggtggaccgctccgcccgcgtccgactcgaagttcatcgttgaaaccgaaccggatactgaaaaccgatcgataggtgaagtccgcgtccgtcaggtcatgggcctcacgggtttaacagaccaaacggagcgcataccattttccggacaacgaaacaaatacgatcggacacaaataggaaaatattttttttttcggaacgtaaaaaccaactcaacttttaaaaacaaatatcatcatatataattagctcattttatataaaatataatataatatataactttttaaaagtttaaatattattaatagtgtggactagcgttaacagatggactactattaaaatctaaaaaggtatattgaaggtcatatagttataaagaaatacggtatgtcttatggcttttttgatatccgaattattattcatatctaaggaaaccccgatatcttattcgtattgtatatgggagaaaatatatgtttttttatcagtatccgaactatccgagaattatccgtttcgaaagatatatgtattcgtttttattcggaacggacaaaactatccactccactttcatccctagctattgacaatgtacagtggcatgcctaaaactaacggtgatattgacaatgtacagtggcttgctatatttctacatctctatctctaactctactttttatcttccatcttctatcttctactattataaaaattaaaaatgtttttgctagtattttgatacgtcatcattgtttgagtcaactttttaagttctacaaatccatgtttgagttcgtttttaagttcgttcgcttttaaaaatacaaaagtagtcgtacaagaaatttctttaaaaaaaactcgcatgctaacttgagacgaaagttggactcctaactgcagctaatgattttctaaaaaaattatccaagtgaattctcatagtgaatttcaccctaactaaaccgtataacaataataaaattaaaatagccttcaccgttgcaacgcacatgtatttttttctatttaaaaaaatgacaacatttcatggcaactcgcatatatccttttggtccctaaagtttggccttaaggtcaatatggtcctcgatattttattttgtccgatcagatccttaaactttgtcatatggtccaatatgaaccttaggctcaccagaaatgccatgtagacatgctatgtcatcattttattaaaagtggattgtgaaatttttaatctgtatatttgtatttgtatgtgataataaatactataactaattaatcttatataattagataatttaatctaatcccaggaattgatatatacactaggtcttgttcgtttctccaacaagatggagatgaaattttggatactcgtgatatgcttttcaaactactaaacgttacgtttcgtgcgaaaacttcctatatgaaagttgctctaaaatgtcagattaatccattttccaagtttttaataattaaaactcaattaatcacacgttattatcacatcgttttacgtgaaacacttaatctttatctccatcttcatcttcaggagattcaaacaccaaatagattatgttacaagatggcatggcaacgtgattttttttttccaaggaccatagtagactgaaagataaactctgaggactagttcgaacaaaatgaaatatcaaggatcatattgacctcaaagcgaaagtttaacgactaaattggcgccccccccccaaaaaaaaaaataataataaaggggagggggatgagcgggtgtttgtacgtacctacatatgtacgtttgatggtgtatgtacataagtaaatgtggcccatgaccttatttattagaatgccagatggtaatttaggagtgtttataggaattacacaaggcagcacagggatgatttggctctgcccgtttcatccttctcaccgcattatccgattattggttatttagggaatatatgtcacgccccgaaatagtcccgaccggaactagcccgtgacgtttcaaattaacctgttaatcgataccagtcccaggaaacagtgctggtatcacagggagacagaatatcacagcaacagaggtctctttattatagagtaggagtacagtcatgttgggctacggacagatcccgagctcacaactgcattacaaaaggaaagcggaagccaggacttggaccaatcatcacaggcgcgacttgggaactaggccgaaaccctaaaactcatcgtagccggcttgctcctggaagaactcctcatcagcaagaatcgcttcatcttcttcagcaactgggggggattatttatacagagcaagggtgagtacgggggtactca

SEQ ID NO: 66688 - DNA, 2390 bp, Oryza sativa
atatttacgaagtaggaggacccgagccctcctatcgagacccacacacactaaaccacccggagagcttagctgcctaggcttgccgtcccacaaacgagcttttgaaggccagaagctcctgcaacactccaaggatgactctcattttctaccacttgcaagatcgtcacaactctaggattggcgccattgaaaacatagtcattgcggtacttccaaatcttccaagccactagggtcaccaaagagttaatccccattcgcaccttcttcggccgattcttggtcgcttggctccaccaccttagaaagcggtcggtagagggctaaggcgctacctcggctaaccccagcctcaagaagattgccgtccaaacttggcgagaaaagacacatgagatcaaaatgtgttggatggattcttgacttagatcacaatggggacagctcaccgagtgctgcagcccacgcctagccaattgatcagctttccaacacctatcattgatagccaaccaaatgaagaatttgcatcggaggtgaccccaacacttccaaatacacttccaacacctattaaataatttataaatccctgaaacgaaatcaggcactacaccatggcatcagattaccaacagacatctgttggtaaaaataaacaatcattgatagactgtatgttagtaaaagcttttggcaaaccatatgtcagcaatactcatatgtcagcaatactatgtaacaagatatgttatatgttggcctttgctgacatatctgtagcaggctaccttgtgacatggtgtagtgagggtgtggcactactaaagagtcttgctactaaagttacgctattgatcaaggctttgcacaaaatataacttccatggctctctttgtgaacaccagcaaatgcttgtcagctattcagcatcatttttgtgttggctaattgttctagtttatttttatgttcttttcaggaactttcggaataattacttgactggtcccattccaccattcatcgggaaatttacttcaatgcaatacttgtatgagttactgctcgttctagatcatgttccatctattggtcattattttttgttaattattgttaatcatctcaaggtcattatctttgaatccactatctggactacttccaaaggaactaggaaacctcaccaatcttgtttcattgtaagaaatcttttctcacacgtggattaatcttcaactgctccctctgctacgaactactcatgcttgtagctttaaccgtcaattccagcacttttcgtatatatatagttgaacattttccaccctcctccatttgaaaaacaacttatgattatgaatgcgcatagcttatgtctagattgtaagctagaagtgcttttttttatggagggagtacgaattatacattatgaaattatttctcatgttgaatctaaatgttaaactatacaaatttgtaaaaatggatatttaggaatacaaatgtttgacttacaacaaaagcagaatgacagatagtatgaaacgaatggagcatatatttggactgcatgaactgatataataatacaagaaatagcaatcacataagttctaataaaaaaatcaaaactactactaaataggatgtaataggcatgtcagtgtaactcctgttcatgtggtttttcagatgatcaagtaagattaaacagcaaggacttgaacatattgtaatgatgaatattgtgggtccaatagcacatcgggaaaactatgcccttttgctattagatgatgacaaacattttaaatcacttctgaaatatttcatttttcttttaggggcattggctcaaacaattttacaggaggccttcctgaagaactgggtaacttgaccaaacttcagcgattgtaagatacccccattgatttctagcttcttatttctacttgtaaaagaactaaatttggaatggccatatctattgtcgaacatgataatatttcaaactttcaacaacaggtacattgatagttctggattcagtggtccgttcccttcatcgttctcaaaacttcagaacctgaatacattgtattgtcaaaaacatagccacagctattatatttgtcatgttttcaagctaagtgatattttggtctgcttgcaggaaagcatcagataatggattcaatgggaaaatacctgaatatttgggcacaataactaatttggtagaaatgtaagcttcttaacatatcatttgttcttactgttcagagatagatgaatctgtgcaagataaattactgtctgtatatcacattgtctccattcagacttaaacaatagcatttttgggctgcag

SEQ ID NO: 66689 - DNA, 2606 bp, Oryza sativa
acaatacgctgaatgttgcggtgcagtcctgacataaaacgtgcaattgattgctcttcatcttcataaacattggctctaatcattgccttctccatctctttataatattcatcaacactgaggcttccttgcttcaaattctgcagcttgtcaaaaagatcacggcgataatgtttagggacaaatcttgccctcatttctctcttcatttcagcccatgaacgcacatcgccttggccagcttcttctctttcatttagcatttgctcccaccagattagagcatagccatcaaactctagagcagccatggcaactttcttccgctcagaataattatgcaaacgaaagattttatccaccttcaactcccatgtaagatagacttcaggatcagatcctccttcaaacttgggcatggtgaattttaatttgccaaatctctcttcattgggctgatttcgcccacgatttcctcggtgacgacgatcatcacgatgaggctgttcaacctcttcgtcagtcccactttcttctagtccatgttctcttccacgatcagcacctctaccaccatttccacgaccaggatgtggaggtcttcttgcatttgcaacaacacgatctctccgtcttcttcgttgttctcttgcaaggcgagcagcagcttctccttcggattcttcatcttcttctccatggtgacttgcatttgcatcttcaggaggaggctctggcaatcgattcataagtgcttgaacattggctgttagtgcctccatgctttgcttcatctcattgaattgtgccatggtgacacaatcctcaatctcaacattagaacccatcttcctgtcaagttagtgatggcttgcaacaaatatttgtggaatatgtggaataggaaaatatatgtgcaatcacacaacctcacctctctaccgaagctcaagtgagttccctgcagattacagaggaccaatgcgaggtggtaacttgagaatgatggttgggagaatgcaagatcagcgttcctatgacggtggattacttgtggagcttggtggggatatattttacaaggaatgcaatctgaattctcgctattgtaaagttaaatcacagtccaaaatgcttagtgctgaccacaagatatgaataacgtaaatagatcaaacacacacgcaaagataattcagttttgatgcaaacaaggagtatgcttaggatgcaagtgttgcaatcagacctaagcaaaattttgcaccaaaagatagataacaaactgattgtgcaacttgatataaaattcagaacatgtgcacataaacaaactgatctttcaacttttctttctcaaactttcctcaactctttttcttctctctttttttttgtaacttttctttcttctctttttttttgataaacttttttttatatatataactaagaacaagaacagatatgaaacttatacacttttctttttgtagaaacaagacacgaccgtcagcgttctaacttgataggatcaaagtttacgcgaaggatgataccggtttctgaatttttttttatatatatggatttgcagatgtatgaaagaagctcaaaggacacgcaaaggagaatatgatcagcaactaaaacaagactctaatggactgaaaattaactaaactcacaagaataacagattgaaacaaagggctatagcagaatatttttatggctttttcagtggataggacgaacacaaatatatatgtagctaagggtaaaaatcctaccgttgcaaccgaggctctgataccagatgatgaggttgttgtcccgatcttcacgacgtaagattgatcttgataactagccgaagaacgaccgataacttgctgcaagcagcgataattagtgcaacctgacgacacgcacaaggagccaaccaccgtctctatacggcagcctgaaccaaggattcgaccaaccacactctcaaagaaccaacctacgcaacctaaactcagaggatcaagagcgcggattgggtgccgatgacgcggacggttctgtaatctgcgcgaaggaaaacacatgagaaaaggggtagagaatctctctctggggtttgttagcacacagctgaacaaagggttccgaataggattatcaaaagtctgagtttgcaatggtcttaggggttatttacactaccaacagccctgctagataggggtgaattccagatggaaatgaaaagactaaaaatgtgaaagggcctccacgaaatggcttctgaagtgggttcgcgaggctgttggtcttctggagtggtgttcagtaatttggcaataactccaacttgggaagtccaaatgatgcaccgtcagttgcgttggaaagttaacttcactatgttttgaaccatgtatacatgcaccacgaaacattgtagattggtacagttttgaacatgaacttgtaccaacgtgctgactcagcagactcctggccttcagagcagtcttcacaaacgtacttggttctcattggtgtgaagtccaaagtacttggtattggtggcattggaaagctgacttgat

SEQ ID NO: 66690 - DNA, 768 bp, Oryza sativa
ttcctgcaccccatccgctccctgcaccgccgcgccatgatcacatgccagtggttcttgacggcgttgtccgtgcggcccgggaagagcctcgcgatcaccgcccaccggttgccgtgggcgcggtgcgacgcgaggaggagctcctcctcctcctcggtgaaggggctccggttgattcttgggtcgagctggttgaaccacctaagcctgcagcttttgcctgaaaaaaaattatttgtcattttcaggttagctctttacgctatgtagtttttttttgtgcttggtgacacaccattgcagcatgaggcttgtgctagaaattgagaaggtaaaaagcacggatgaattagagagcaagaaaggttgtaaatcaattagtaactagctctagtagtagctctagctcgacaggagagatggaatatattgctctacaagagatatagatgtgatatacacatcagagcagtggacatcatgtattgatgaactgtgtagattgcacctctttgacatgacactctaacaaattaaaattctatctgatcataaaacgaactaaaacacatgccaaagcctcaagtcaaataaacttgctcggatgaattgcaccacgaagaagcaaaccgtacaatgaaccgactcaacccaaagatcgatcaagaactcaagtaaataacacacatatatatcaatcgatcgattgatcatttcttgagcatatgtagatatgtactactatgtgtatatcatgatggcaca

SEQ ID NO: 66691 - DNA, 3196 bp, Oryza sativa
atgctagtagaccataacttcctgagtttgatcccagtttagcattgacaagggttgacttgaagtcttgaagtacacgcccactaactaatgctctcttcgtttcatatataagtcgtgttttgatatttttttactaaacaaacttatttaagtttgatcaaatttataaaaaaataataacatctataacatcaaattagttttattaaaactaataatgaatacattataataatatatttgttttgtgttgaaaaattaatgttactatattttttccaaagcgacttgtaaaatgaaacgaactagctggatggcctgcacaattgcgcggctagcacctaaaaaaatcacatattttttatatgattttacttaaaatttattagatagctatcttattgtcttaagactttgaaagaccaacccttatcatcctcgtatttctagtttttaaaagtcacaccagttgctaccccttatgtcatctcgttctttatttgcttgctcgatataccactatttctttttattcttcttggaacctttaaaaattagattttatagtttctagagtttattgtcatgttgggttttatttttataatttttagatgtcccgtcaaacgttgccattatactcatctacggcccgtctaatgtctcttctctttattgtcattgagattttaaaaatcgaacataattattgtctaggttcaattttactttctaaaagtcccgccaaaccgtctatggctttaccattgtactcctctatagctcgcccgctgctttccttctttattgtcattgagattttaaaatcgaacatgattattagtggttttttttactttttagaagtttcgaacatttaaaaattggacttgtagttccattttttatattttttagaagtcccatcaaacgatgccactatgcccctctacagcccgtccgccgtctactgtttattatcattgtgattctaaaaatcgaacataaataccgttggaattcattttttattttctataagtcccgtcagccgtcgacggctctgcaactatactcttgtgcaccccgcccgctgcttctcctttttattgtcattgagatttaaaaatcgaatatgattatcaatggggtttatttttttttttttactttctagaagtcccggtaaccgccttactcgtttgcttcacggcctgcctgatgtccctccttttaatcgtcattaggattctatttggtgttttattaacaatttttatatgtcgtatcaaccgccaccactctacttttttataggcatgttacttaatttatctcatcatgtgttttagatggtctcttatttcaataatctttatttttatcaaaaattttagttatttataaattgtattcctaattgaaatcttatttttctttttctaatttcagaattttttttaaaaaaatagttattaccgtattgtgttcttttaatgtttttattttttattttcaatttcagttgtttcaaaattgtattcctacttgaactctcttttaaattttctaattttggatattattttattttttatcctaaattttaattaatctcgtattgggttcttatatggattcttctttaaatattgcttatttttaattccgaatttcagctaattttaaattatattcctacttgaactcttcttttattttcttttgctaatttcggatttatttatttttattccaaatttttattaatctcatattgagttcttatatgcactcttcttttaatattccttattaatctcatattttttttattaatctcatactatgtctatatgaattattcttctaatatttcttattttttattcctaatttcagttgttcgtaaaatgtatttttacttgaactcttattgaactcttatatttgatttttctagtttctaaatctattttattttttattatggatttcaattaatctttaattgtgttctacatgaactcttctttcattttttattgtgttatttcaaaatcaaataaaaatccgtgcacatgccatcatgctattctggttgctgacgtgtgcatcacccaaatacggctcactgtgcagccgcacggcttgacccgctgcttcggatttccgtcgctcgctgctagcatctatcttcatatcaacaaaaacgcatccaaattactgttctatagtggttcgttgcccgctgctttatttatatatgtgtattatagcctaattcatctctaactctggttaattggtttaggaaatcggacaaaactcttttgagtccgtttgcatgtaaaggtcctagctagagattgattctaattctacacgcgtacggtactccgtatctcttaattaacatgccaagtttgtcttaaatctcagacattgaaatctatgcctcttacaatccaacggtataaataattcatattttcttcgattaacgtgggaatttctagcctccacggtgaacgtggtgtctttttttcgagctgtattaataatataatagataaatcgtattaatcgaagagtggagtaaataatccaatccgttacaacaatccgatggctaagcttaaaaggaggagcgtataactggactgaacgaccgctggtgtggcgtgtgttgttcctcgctctcctgagagtcctaagtcctgacccagattggaaccgggattattcacagtgagggtcatcagcggatcagcctgttgtttttttggctcaaaattttctcggatttttggcgttccgatacgtcaagcaagaggcccagatgtcgtcatgtgcgtgacgacgaaaggcagcgaacctgcggagcacccggttccgcgatgcgtgcgccgtatatgggcccggtttattcgccatcctattgggccggaccagtacagcccgaactgccctataacataacaagcacatatctatctcctcatggattgagggcctgcttggtacagctccaactcctaaatttagctctaggagttgggtctggagtggagttgtggagctgcctaaacccagctccacaactctagttcattttgtgagagagctccacccagctccactcccagttttggtggagctgaaactgtttggctgagctccagctccagaa

SEQ ID NO: 66692 - DNA, 3199 bp, Oryza sativa
tatctttattcacagtttttttacaaaaaataaaagattttctttattcacaattctataatcgatcttttacaaaaaataaaagattttctttattgtgaatgaaaattgtaagtagatagtcatgtaagaaaaatgttgtataatatcatgtagtaaaacttagttagatccaaagtttattcaagcagtgaatgttctataaataaatttaacataaaccaaaaccttattcaagttcttaagcggaaatataaagtcgcgcaaagcgtgactatatggctagtaccattgcaccataaagtacttaaagaggtttacttaattaaccgcaagaatgagatcttaccggatccaccagagaactacagcctgctgtaataacagtcaaaactgtcatgacgtacattagcgcacccaagggttgttccttactgacgtgaaaatgtagatctatcagatagataagaatgggggagcacacaaagaacaggaacatcgagataaccatctgcatgttaatggcagaaagaattgtatcagacaacagatttccctcgaaaaaaaaaagacaacagatttcactatatatggacaaggagtatttttaaactacgtaccagaaataatcccacgcaacgaaatttttgagaactcttccggagtcccaggaggaacagatacaccgtatccaaaacaaatccagccacgctaacaaagagagtagacttgtgctcttcggtgttaacgacgaacaacaggtgaaacaccagcaccatgttcagcatggctccagagaagacagaaaagggtgactgatatttcacggctgtttccaatcttcgcaataccaacacaagaaccctaaagaaacaatccagtattgtcacactttgaatttttccgaatttgatcttaaaatacatttcttcaatttgctaataaccaaaacaaatttattatgcaagcaaaacagcaaataaaaaaactaaggcatgccccacaccttctttctcccattggggcattttatcccagtggttattcgttcttccaaagagttcctacgatttataccggctcctcattcactcgccaatcaccagatgtgtcaatttgctattgtcagcaaagttcaagactcatctagaggaggtaaatcaatagatacggggtacgcctagttgaagcaacccctatacttctatgggttgttccagcctctactcggtatcccgcaatactatcgcacaatcctttagaatagtcaggccatactcttctagattgaacttggcctcgctcaagcaatccatgctatgcatcactacagtgtgcttattcatgctggcttccaccacaatgctgaactgctccctctggaaaaccaagctcttctaagcggacaatgtattatttgaattgtaaaaacctattcttgcgtcaccttctacttttagaaatggcaatcagtcctagattcaatagcagggggcagctagttcaacagttacttaccattttagggcttctttcgaaccacatgatttctaaaatgcgggaataataataaaaaacataagaataggatgtcacatactttgaattcctaggaacacgaaataagtagatacaaaaatacatttggatggttcacaggaatcttaaaggaaataacatgtggaagagagagcagagagagagatacttagcaagtgtttgaccaatttcacttacagtggtgcgaggtcgataaacaatgatacaatgtcgaacacaaatgaaactcgaccaatttcttcgacggcagagccatgcgagtccatctgtaaacaacatcgtgagtgtattagcacgcaagaattaaaatgatgacaaattatgtagtatgtacatttggattgagtgctagattcagagcgcaggtaggcaggtagcgacgggatagagttcgtaatttcgtaaatgcacaagagctaggttggtcatccatgaaagaataacaccaacataacaataaaatacacgcgtggaacaacataatattgcattttattattattatttttcattattacatacatgaaggtcacacaagtcaacacccacaaatcacaaatgtgcattctgatacgtgctaaagaaaaacagagaaaaatgctactaatattgatgcgtctactaacgcacgctcaaaaatacgaaggacaacaccactaaaatttaactaaaatctattcagagtgcacaatattcaagaaccccgggatcttgatgtcatgagcgttgcgcgcgacaaagcgagtgttgtgcgcgcttgcgttgctctggttcaggagatgcgctctgctctgcaccgtcacgtcacgagcaccacgccggcatcaccaagacctcctacttcggggttggattctaatagctcgagtgaacgtccacccgtttattgcatgtcaactaaatggctacgaaaaattttcaaaaaaaattggcaagatagatcaatatgtaatatatcactccacaaacatgcaagttaaaattcaacttctacaagttgtaacaaaaataacaaatttaactgtaaatatacatatagtaatttgagttttgtttgttatttatattataatctgtagaagttgaattaacttgcatgtttgtggattgatacattacatattgatctatcttattcatatttttttaatttttttcataaccatttagatgacatgcaataaacgggtaaacatccactcgagctgttaaaatagtttcccctcctacttcgtgcgcccaacgagctcctcccactcccaggactgctgatccaccgcgtcgaggcgaccgacgcgtgggagtacatcgacttcaatcctacccagtggccggcggcgagggcgtcgacacgacggaggccatgtactcgcggaacaaggagggccgtgcacgtcatgacacggcacgcgccgggccggtgcgacgcggcggcgaacgcgtgaaacgtcggcgtcgggcttcgctatgagtggagcaagttctacgcctccatggcgcatcccgcatgctaccaccttgactgcgacgagccggacgttcgacgtacccgccgggacgccttgccggcgcctcgttaccccttctcccccctctctctctctctctctctctctctctctctctctctctctctctc

SEQ ID NO: 66693 - DNA, 1483 bp, Oryza sativa
tgctcattcttgcaatattcaatcatcagaagaggagtatctcagtgaaggtgatgatctggaggattaggcttgttctggttaagttgcctgtggagtggagtcgccatagctgttccgtagtttgttatagatttattttttttcgctgcgtagaaggatattctttgagaggaactatctacctctgtaatattttattatttgcgaatattctatagttgttcatttgtactctattatcaatttgttattgtgtgcctcggttgattcctggacgagggtttaacacacatgtaagcgtttggaattttggatagaaattccgggcgtgacagattggtacttggtttgttccgaagcctggggttggcacttgctgccgaacggttggcacctgagcagtgttgccgaagtcgaactgctgtcattgactccacggcgaaggtcccgagcctggctgaattggtggcaacccattgggcgctccttgacttgtattccctaccgggtgagccgatggggttgtgcttgaaatgtagtggggttggttgagttgctaaaggaaagcttggagttgcgcctgcagagccgaagcccattccaccactggttgtggcgcttggccaggtggttgatgctgcccggcgaagtacaccggcggctgtgcggctagtggcggagagggctaggtcaccacttgcggccggacttgaggtggggcatagcctgccgaatactgaaggattggagccgacgtggccttggtcggccttgtcgcctcgtatgcttgttgttgttcttgcatttggcgaagcatgtcttggagccgtgtcatattctgccgcatggcttccatgtcggcttcggcttgcgcttcggggtccaggctgatttgggcctatacaacggcgagcgcagttggtgccgccggctgtgatggggcggcttgaggcaccaccagttggtttgtcgaaaggatctctgccctggtctggagtgcccttgccgccgcagccgccttcgccacgtcggccttgttcggcacttgcactgaggttgcggaggccgaagacggttgtgatggcgcgggggccgaaggcggctgtgatggcgcttgtccttctccatcttcggccacagacgccgaaggctctgctccttcctcggcggccatgtccggtccggcgtcgctctccttccgcctgacaaccttctccttcacgaccctcttcgtggcattcgctctcagtggtttcgctcggagtccccacggtcggcgccagctgttgtcgaaacaacaactgtatacgtcgaaggacgtggttactcaacagtggttgggaaaatgaagtgtactaaatttttaatttcacttgggatcccccgttacatagccctagggggctatttatagccctattgcaggctctttctactaggatctaggttgtacaggggaatttatataattacccttata

SEQ ID NO: 66694 - DNA, 1651 bp, Oryza sativa
gaggtgtatgttcaattccatcacaatccaaccattccacagtgtccaaatgatatgagaattcccaaagtctaaagttataaaaccacctaatgttgcctaattagtcagcgaagcatctacctagattcatactagtggaactgttaatagagtgtcgcgaccgagaaaattgccttttcccgaacgctagtgtattaatccccgtcccaggaaaagccggggtacaccacacaaacatgatataaaagacacatctttattatatcgataatatttacattattacaaaggcgcttcaggcctgacaaacaaaaataaacagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagtcacaccggagatgcataattaatgcaagggggtacaaggggataataatataggggttaagttttgcagtaaacagcatttaaaagtcacttagttgcccaaagctattttgtaaacacgatcctagagctatacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctaggcttgcccataaccgagggcgcggctattcgaatagattatactctaatcagaggtgtacatctttacccacaagacacatcttcctcacgtgtaaccacgtgccacataccaccacggtatacggacggaagacgtgacatagttcccaacccatcctagccataaacaagagtaccgacccaatcccacctacggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccatccgtgtacttttgtttatgaccagactgagccacaaactaagccttacccactagacatgtggaagtacggtagtgctttgcaacagaggcccgagcttaatccttatagtggtcggggtgctacttcccacaactggcatgcacccaaaccccaccgaaaacaggttttaggggttttgaaagaggaagagaggtgtatgtccaattccaccataaaccaacaattccatagtgtccaagcgatacgaatattcccaaggtatagcgttatcaaaccacctaatgttgcctacttaatccgccaagcatctacctaaactcatactagtgggtactctatgtcacgtcctgataaattcatcccgaaattaaaaatcattttctaaaaggaataatagaattaattaaaatttgaaaagaaattggcaaacactaaaatacgtacaagaaaaattcgaatgggtccggagaatttttgttaaattctcgggctgcaggaat

SEQ ID NO: 66695 - DNA, 724 bp, Oryza sativa
ttgtaataattaaaactcaattaatcacacgttattactacctcgttttgcgtgaaacacttgtttaggagattcaaacaccatcataatctatcatagtggaaaaagtaaaaaaaaataatcaaagtttgtaacgactaaatacgaacaggagcaattgaaacgagctactgcaactgccgccttttctgtaagaataccgcaactgctgtcgtcttccgtttagcaacaaccgttttaattcaaatttacctttttccgagaacagctcgaaagcacatagcgtatcggcggttgcttgatactcacaaagtcacaagtacagccacatttcggctacagaatctgatccaaaggcagatacagagcgtatgcacgtatgcgtgcatgtggctgtggggtcgcctcaactactaagaaatcgaaaggtgtggatgattagagctctctccattattacaggattagctatttcatccactaattaattgctcttatttgacgcgcacacgtagaagttcagaaggtcagaatacaattagtttctgaacatctcttgttcttctgaagtctgaactgtactgctcatgcgtgcacataatgcagcttcttcccccaaacacctcaaaagctctgtttaactatgcagcacgatatatatgattatgctctttgccacgaaaaggggtgcgtcgcatcgaccgggggatcctctagagtcgac

SEQ ID NO: 66696 - DNA, 13752 bp, Oryza sativa
  unsure (1)..(13752): unsure at all n locations
cattacagtgaatgatttgtcaagaattttgatatttttactttcacaaattttgttgatgggacatagggacagcacaaatgataaagtagatcacacacttctagaattagtgctgcattttcaataacatttactatgtctggtttcttatgctaactaacttctgcacttccagttacgaattaggagcgcttgttgctgaagattgtgctgaaaccacttatgaagcagaaaagcagaagcattctaagaggtcaagagagtacatcccctctgctaaggctggctcacggcttccacatatgctaatgagagcattgtctacttcaaacgaggtttgctcaattcaccacctatttgatgtacacatttttagctaatattctacatgtgtaaattgtgtactccaatgggctctttcagggtgtgttctcaactctggatctagtaaatggggacaagcctgagtttgctcttatcattgccccaatgaaagtgtcatatgagcttgctcgtgctatgctgaagatagcagatgaactcaagttaccaaccaaaatttgtgttatatggccacaaggttcagttgatgctaaagtgaaagggagcagatcggagttggcaccatggacaaactatgttgatgtcgaagaagtacctagagctcctgttaattcttggtgggagatgtgccagataactagtaaaagtgtaattttggttaggcctgacgagcatatagcatggagaacagaatctgacagggtgacagatgcagattcagaagttaggagagtcttttctgaagttctatgtctaactagccgcatccagtaattgtcatcatttcagtgacaggagctaagtgtagttagggatctcagctgctcgatctgaactgccatgcagttcagtgttgcttgctatgacaaaatgccctgtccatgaccaataatttttgtttgtgtagttcttacgtacgctgattaccttgaaatgcatatgatcttaactcagagatgttatgtcaacgtgagtgattttctcttcgttaaaaaatgtggtaaataatttgattgtgtgatttcttgtttatgataacagcatttctgtttttcgaatggtaattttcagaatcataatatggtaacgaattattgttttattgaatagatagcattaatatcaaatcaaagaactgaatatcactaagtacaatgcaatgaacttaccaaatataacaaaatggtagatcaacaaccatcactgacatactcacattttagatttcaccagaataatgaagttatcgaacaaatattctgtacaaaaatcctgagaagtacatcacctgaacatacatgtatcacgtgccgtcaaaacttcaacagcaccacaacatctcattgttacaaatcttaccaatacctaagtgacaggacactggacaagcctcttcttcttcttctcaagtccccttcaaatgctagcaattcccatccaccttcaaacacagcatcatacaaaacctgatactacaaggaacatttgccctgctgttgctagcatagacccaagcaaagctccagcaacaacctggaacaagttttaacacccaaagaagttagcagcatacaaaatagatttttttttttttttttttttgagatagcatacaaaatagttggccatgactgaaagaaacaagaagatggtagcactgctgacgaagctgcatgatgtgacgataactgataagcatggggtgctaggtaaaaggggatctgatgacattggcacagccagtttgtggttcagttggtatccacgtaatcagcacaatcaatatgacatcgctttcgattggtgcagtataataaaatgattagtgaaaatggcatttgagcaaacctgggttggagtatggcctaagagttcacgcaatggtcttgtttcagacaagggatgttcagaaggaagttcgcagactatttgattcaacacctgaatatagttagaaatgagatacagttcagtataactgcacaaacaaatatctttctttgtgtcattacaatagaggcaaatctaatacatggtgttaaaaggtgtctcatgatgatattagcatgttcatattgatattaacacataaagaaacagtaactgcatacctctgcttgctttccagcatgtaatctgataccagaagcatcgtacataacctgccaatcaagtcacaacagaaattatgaaccctcgagcctcatcttttcgtttatgcttatgcttatcagccaaaatttgaattttcaaccttaaatttgaagttgattttagggtttgttcatcgaagtttatttttcagcctttgcttttagattgctaagaacacgtatataaaagttttattcacaatttttttttcgtttgtaaatatgaacaaaatctatgtccttcagtcaataagcgaaacgatggggactacatgtttaataataacaaacaggaaatcaacaaaaactcttgcacaatgcctacactcaacatcatggtgtccaagtcgaggcaagaaattgagtccaagcaacaccatcaatgctcgttgtctttgtcagaacaaaggaactcgattgaactaattaaacaggatacgagatggataacctaccacacttgcgaatattgctgctgtcgcaaatagggcacagccaaaaccatcttggaagccaatcgctacagctagtgctgtaactgtggcagaatgtgacgatggcatgccaccagaaccgataagctgcttaggatcccatctgttctccttataccttaatttcagaacaaacacacattaaacttgttgcaatattttctatcataaaaggacataatgagaactaagtcacaagatacattgctcatcttgcatcaggctgatgtcaatgaacaaaatctatgtccttctacccgaattaagatatagttaagatttacaatgcgcgcaaagaaaacttttttatacaaagaataaacaatgcttttgtatcctctgcaattggctcaaatggcacaacaatcaccatcgagctacttgctaatccaaagtggaaatcggataacaaaacaatgtcaagcaagaaaattcatacctataattttctcacttgtgaaagtactccaatttctcaaatgcacacaataacatgtcaaattgtcgattgtagtctagccatgaataaaacgcacattaaatctaagcaaatctaaatggcacctattctcctttaaacggttcttaaaccgaagagatcaccggcaattcctttgccccccatctcaaactccccgaaatcattcgataataaatctatacggaatcctaacattctcaattccaccattcttctaagcaagcaaaaagaaaaaaaagaatcgaaaccgattgttctgacggccggatcagatctccgggagaggaaaccggagttccaccgaacatcatccgaatccccccatgagattcgaattgaggtcgcgaggaggagggggcagagggcgtacgaaccgggtgacgaagaacttgatggactgcgcgacggcgaagcccagcaaggcggcgacgagggggtagttgtggaagacggcgaagtaggagaatcccgcggaggaggcgccgccatcaccaccaccgtcgtcgcccatggctctcccttctccttcccaccccccaaggtgcgtcccttccctccctccttccttccctctcctcgcctaatcccgggtcttccctcccctccccaactatatttatagcccacctcacctcacctcacctcctccgtaaaatgcttcctctttctctctcttctgcacaaatggcgatcttgctccgctcgattgatagacggattcgagatttttttgatgcaacagttgccttccatactggactgtctccctctcctcgctctctctagcttgcagaaaactactactctctctttcggagtacctcgtggacatgaaggaatcggaatttggagggggggagcatggagaagaatatgccgaggaagaagcaagttgcggctgcttgtattatggatgatgaattattggcgcgcttttatttatttatttatttattttatttttatttttttgtccgtgctgctgcggcggcggtagatccgggcttggttcaattcatgtttgcatgcacctcgttcgcgccgcaaaaaataaaattggcggaatttaccgccacgccaatatggtgaatctgtgggtgggtgtgcaaaaacagtttaaattcaaccgaaaaaaatctattatgatttcagaattgtcgaaaaatgttgctgtctagcccatagtttactctactgacagtttaaaatacaataattttcttaactatgtttttttctcgaacgcaattttcttaactatgtgagtaattaagcgattaacaagacctgcatggtggcgattcgtgtaagggacattttacgagcggccattttttttttggcacaaacttttgcagttacgcaactaagagcaacttacacaaagcttcacgtataaaacagactgccagattaattaatatcctaatggcgcaattaatcataacaaatgtagacgtagttaacccgtctggtgttgatcaggtccacaaaccatagattagccaataaacgaggagttcagatgaagaacgccaaagtcaggtcaacgaagacaatgccagatcttttttttccccttttatgttgcttcattttttccccagttggagagggttgacttatgttttctgcattaatccacatagcctgctattaatccaagcaatcatcctgtaattgcagatttgcagagctttttttttaagctgtgaagtggagttcacggtggattttccatgctaaagtcagtcaatttggattgctctgacatagactttgaaattgttggctaaactcctctttcactttccaataccaactgaattttgcattcttcagaaaaccatcacacataaaattgccaaaattacagctttgaacaggtgaccaagcaaacagcatagcctctagcagtctagcttcaactgtggcttcatccagggctatgccaggcaaagcatattgctggtctatcatcaacagtgttacatctcctacaaaatttgcacatacaacacccaaaaaaagagctactatgtctaaatcatagtgtgcctaacattctaacctgtcattttgtgatgaaacaccgattgtgtggcgcctggggatccatcatcttcttcaagtcaaggtccatctcatcctcatacttctcgtcctcctcctgtggctccgatgccttcctctgcctctccctggcttcagcggcttccatccgcaccttctgccggacatagtcgtcgtacgacatctcgcaccatttcttcgcgtctccgataacctgctggttgtgaagctccacctccctctctagcttggtcttctcggtgttcttgggctctccccagtagtcgtagcggtacataggcttactcgggtcgtagtaatctttgccataaacttcggtctcatccacgtcatatcgcccaggttcgtcgacaggaagcccaaatgctttacggctgccaatttttgagttagtggatatacattcggtggcatcaaatttgtagcagtagtaacattagttgcaattaccagcatatgtctctgataagagcttcccgctcttcgaaagaacggcgccattgcattaaatcgtactcatccatttctttgtttcgtcggagcttccctactttgtattcctctcctctttcctctgcttcctttcttagtttttttatcagctgcagaaattaaacttcagtatgttgaaaggaaatagcgagtgatcaataaagaattgtcctcgctatgagggaaagggtacctgacgctcagcacgagcggcatccagatcaagctccttgatatctatattctaacagaagagttcagaacacaaccagaatgtcattgggggatcattgtactgtaaaaaaaacaccctacgataattgaaagctagtaatcagtagctacgtatgactgcgtaccacaacttcctttttcagcagtgtgtctttgaaatacccttcagtatgttgaactctattttcttcatgaacaatggaactatcaactgtggactcatatgtcgtatccttgaatttatctggattttcctcctcatggtctaaaatcatttgctctgcattatgccacagccaaagctgcaaacaaaaaaaggatcaatttaatacaggaatagaaggaaacaaggcatgaaagctgccagaggatgcttatataggtggcgagaggcatgataagcatgttatcatttgagacatggtcaagagataccgtttcaacaaaggggtggtctgataccaaaggttctttctccatatctttcaaaggttttttcctaggaataggtggtcttccaccttcacgctgtcagtgcatatacgagtcagatgcatgcacagcacaatactgaagagtatgcatttcattaggcaaaactagtacgtgagaatgcacaaattattaagttcaacaaaattatggattcaggaggacagaggtcacacccacaactgctctgggttagtatcttccttgcggtgaaatattggtggatagtcgaacctattgaatctgcggttagaaagaaaaataagatgacaaacagttagtcaactaaaaacaaactgaagaaatgcacaagacacagggcactgaaacctccagattgtcagaaatcattggcacacgcatttcaaatgatgatactcacattagatgatcaatgttaggatatacaaagcgcatttcgagtgggaaacggaagcggtagggatctcgtttggcctgcatcatacagttatacaagctccattaattaattaaagaaatttccacaactcaggcaacaaaggaataaaactttttctatgaaaaataaattcattttcagttaatgcaaattgaaaagacacaattggcatattcacttagcaatgcgaacttcttaaatatttccttaatcttttgtattgctgccatcatatcattaaccactgtaagagtgaaatttgagatcactaaccagaatctctacatggacttccatgccaggtctgatgtgatgacggatccaataccaatcatttccttttattggtacccacctaaacaaataatgagatgtaaatggcacgcagaattctttcacaaataagtataccaggtccacaattgtatatcagaacaagaaaccatacccatcatgaacacaaccgatgtccacaaaagctccctgatagaggtgaacactgatcactcgaccacgacagatctgcatgagatgcattcaaccaaacaatcagaatttaagggcgagaacagtcaacaaattgctgaagaatgagagtacaatcagaacttctagcaaacctgtccaggatagaagaacgggagttcaagctgcataaaagcaatcaagacatcaggaactaataatatcaagaaattaaaattgaccaggcagtgaattgtcaagaggtaatgaacataccatgtcctctttgtagtcctcacctcttttccgtctgccagggtagtaatcctgatcaaactgcacgacaaaaatagccaaagaggggtattaccgcctagaacactacaaatactcttaaagatgacaagtgagactcaacccctaaactaaaggtctaaaccaacaaacaaagcttagttacaggagataaaatcaacccatggttatctgacgtgcctctctctgaagagagcataaaacagacaataccgagccactcaaatgaataacaaaacaacttgccaacatcgaacctaagagtttaggacacaggtgttcatgacgtacaaggaaataggcatctgagggggttctgaacaccataacagtttttttttttgggtcgaaaaggaactttttttaagtgataagaaaatacaataatagtagagggccgctacaaaaggggatcccgttgcaacgggatagatatattaactattctcttgcacgagtatcacaggtatcaggtcctaggtatcacaggtaccgggtaacaggtatcacaggtatagggtaccatgcagctggtaccacaacaggtattaggtattaggtaagtctcatataagggtatcccgttccaacgggataccgttgtctaggttttctgataatagtagactgttcatacaaatgtaaaatacttttattaagatatcacaaattcacaataaaccactgcagtaatcactaaaaaggtttattttcaactatctagttattaccagaataatgattttggactactgttacattctacaggtatttcttccatcctttgtgaacttatcacctctgataattatcatagtaattagcagcatgccaacacgttccataaccaatgtgaactgaatcaattggtctgcaaatatctaattacaggcacagaccactaaagcatgaacacttctacatctaactaacacaatgcacagtcaaacgcaaattcccagttaaatcaaaccatcacacaaatgatcgaacaaaattaacggctttaccttgtaggactcctcctccaacctgtcccgattggcttccacccattccttgtactgcttcaagaacatcttgtatcgatccagccccagatcatccggcgcgttctccaccttgtccacgtgcgtcacccccttggccgccaccgccgccatgtccagcctctccgtgaactccctgtgcgcctccctgatgaactccagctcgccggggtccacctcccaccccggcggcggccagtcccgcggcggcacgagccggagcgggagctcgccggcccacgaggtctcgaggggctcgggcgtgtcgcgcgtggcgaagaggcgctcctcgtacccgggctcggactccaccttctcccggtacgccggggtgagcatccggaacgcctcctgcgactccggcgtctggagcggcacctcctccccttcgttgaggctgtgccgcgcgaacgcgacctcgggggtcatgatctcctcccacggcgcccacccgtgctccacccagctccggcggcgggcgacgtcctcgggctcggtgttcttgacgaggatcgaggggatcaccggcgggtcatccgcgggggtctcgtcggggccggagggggagacggagacggcgatgcggcggaggcggcgcctgaggaggggcttggggcggaggccgaggtgcgggaaggtggcggtggccggagtggccgccattcttgctcgggttttggggacgacggcgtcgccggcggtggcgacgtcgaggggtttaagtgagctgaaacaggagaggataaggcaggtcgtgggccccacatgtcagtgagagattcagtccttttgctacagtataatggcccatgagatgagaaggcggaggcccaactaggcccaccaaaatttggatttccgtccgattgggccttacaacgaattcaccacggcgacgcagaccaatgccgccgccgccgcagcggcggcggcggtggcggcggcggagagagagcgagacagcggcggtggaacgcgcaggctggcggcggcggcggcggtggcggcggagagagagcgagacagcggcggtggaacgcgctggccagcctgctttcgcgttcggccgtgcgtgcgggtccgtgggagggaggggagctggagctggtgggggagggcgaccgtgtaatggagccgtggggcgttttcaagtgctcgccaactgttcgaccttttgcctcgcagggcgtacgctcggtatggactccctcccaacccgccccgctgtttctgatcgtagcatttagggaccatggatttgtatttccaattactttctgatctgccagcttcggcgtttttttaatgcatattgtgcatcagtgcttgtggagtagaaacccggtattcttaaactggtgggaggagctgtaggcgctgctcttgatatgtttctgttacctggaaattctgatgtgctaaaaaccgatccatgtgttatttcagcaaatatggtggcatggaaataggagctatgcccctttttgtttacaaaatcaaactatagggtggcatcgtactgtgacaaccaatataaaaaataccccggttatccaaacaaatcaacaacgaatgatttggtgaatataattaaggctacaatttattttgatctagtagttggtggaaaagaatatgaatctatctaagatcacttgcattgccaatataatatgaacaccattcagcaactgtccaattggtaagggctagatcaggaaaagatcagtatctaatgctagcatagtcttcacttaaaccaaaatttccttctgtacttctgatgcctgctgtccactcgtaaaccttcttcatgccctgttagtttcaatgttgataaatacaagtctagatggagttaagtaggttggtggctgcttgatatctctatgttaactctggttgatgtctaccctatgatgatcttcccacgaattccatcaccagctttgagaaagctgatgattcatctctgaggagattttctggagaatcaaactctagtatcttacctgcagtacgaacaataaaaaaggtacttccatcgcttaatatagttttttataaattagaattgcttttgttgaaccaaaggaaaaacatgggttattcgtggatatcttttaccttcacctaggacaagaacaaggtcactgtcaatcacagtaggaatcctatgtgcaattgtaataactgtgcaattgtttgtctcttgccttatagtcttttggatgatattatctgttgcggtatcaaccgatgctgtggcttcatccagaacaagtattttcttcttcattagcaataccctggccaagcatacaagttgcctttgtcctacgctccagtttcccccatcttcaacaactgcaacatcaaactttagtcatataacttgtccatctcgagcaaggaatttggaacgtgagaattaaaactgctgcaaggaaagatagttcttcatacctggtgcatccaacaatctactgtcttctctcacaatctcctcaaggcggcacttatgcaaaacctaaaagatgggggggaaaaatcagcactagactcgataaaggaagctgtctttaaattgttaactgctttcttgaaaacctataacagctatagacacttaaagaaatttcatttggaagagcatcttcacagcactatattttatagattgtttacctcccatatttcagtgtccagatgctgctgtagaggatccaggtttgttctgactgtcccttggaaaagagtcggttcttgtggtataacacttaatcttgaccgcagatcatgcactcccaaaagcgatatatcaacatcatctatgagtatccgtccttcacatggttcaacaatccgaaacaaagcgtgaattagagtcgatttcccactccctgtcccgcctaccaccccaattttcctttctccgggaattgtgcagcttatgcctttgagcaccattggcatgtccgggttgtacctcacttggagagaatcgatctgaatggttccacaccagggccatgattctcttggtctacagtcctcaatgactaaaggggcctcacttgttatgtttgagaactgcaaaattctttctactgaaatcattttgttctcaacgttgcacagattccatatgacccatgcttgtaacacattaaggttaaggccataggtagctgccagccctgcgaggcctaaacaaggagaaaaccaaaatgggttagagtttatagccatgtaataatattgtgatttatcaaagtactgtagagttacacatttagggtttctgaaaaacgtaaaatacaccacatggtttctctgtaaatccttttttttttttgtaacaacaaacactgttttaccaaaaagaataagcaggaatgcaatgcaagactgcagatctaattatagtgttagatacgatactattttttcatgggaacgcttacttggatcaatagtatttcgaggcattgagacaaggatgactagcgtcacaaagaagacaaggttgaagaggaagttgatgcgaacacataaccattcaattgttgctgaattgtggaaagtgatgtgggagtagtcatcaattagtgcaagactcttcctgaagaanttctctccatgattaaagcatataatagttgatgctcctgatacagtctctgaaaaatggtggaggactggagcttttcttatgccaaccatccttgntagttctctagctgaacagatgtaatagctctgcatgaagtttttacaaattactagcattttcaaacctgaggaaaacatattgcaatgaatgaaggtgtacctgataccaagtagagatggcaattataattatgaatagaatgaatataggccaggcaatttgagacatgatgaaaataatactgaggagctgaattaatgcgaagataagccctgcaagcctgtagggaatgtctgtgtcaactgtgctttgatctgttgaagcctgcaaagcagaaaactaagccgtgagaactggaagtaaggggcgtttttattacgatattcaaatgaagaggtagttggctcaccctattgaggattctacttgatggagtggagtcaaagaagttgattggtgctcgaaaaatactcctggtcatgcgtaagaagaactgatgagcagtttcaatggcaatcgttgaaaggacaatagctcttcccaatataaacacagaacttccagctgataacagcacaaagatacctatcatcttctccctgcttacttgttcctgcctctcagctgcccatgcaatccaatagttgctacatatctgcaatccctggaaaaggacttggcatgcaagaataacaggaacgagagctccgccatatgcagagttgacaaacttgcgataaatatcccatttaactcttccagattcgcgctcctcctcgcattccctgcctattacattgtgatctaattctatttctgtgagctcagtctgccttctcttgtgactcttatttttagtcaagacatgtgcttttgcaggtgtgacctgactaagggattggttatgtgcagccatttgcattgagagttctccattcctgtctgctaccaaatcatcatattttccggattgaacaatccttccatctttcatgacctacagttggacatttgcaatcatatgttagaccatataactctacatgtatgttcttagtaattattgcaaaaatgaaatatgacagcttgtgacaggtttgaaggatacaaaacccacccacttagtggttcgcttcccatttagttggatgtttattttgcacgtgtggcacttgcattaatggtcaagcaaagggactaggatgcatcaatgggctgaccaaagtccaatatgacccacttgcatccctagcagctgctcaaattaagatatttacaacaatatagccattttatttgacctaaagctaacaattacca

SEQ ID NO: 66697 - DNA, 917 bp, Oryza sativa
tgttaattgcacacttcattgagtcacttggtaatgatcttaatagtcaaatttatgaatcaagcagcttcgtttgaaattatctttagagttctttcactactttagattgtgcattacagccttcgcgcattgcaagttctgtatagcaattctctgacaggccggtaggggacacacaaagcgtcttcgtccttgcaatgacagtacgtagctgtcgtagcacatgtttatcttctagaaggtctacgtgttgtccagatcccgtggatgcaaattaattgctaataacggccatggatcccagattgattcggtgctctggctgccacccaaaagaagcctcatcgtttaccaaataaataaattcagctacagttaaaacttaaaatttaaaattgattttatggtatttttaatataatatctcttttaacatttatttttaagtcgttaaaaacacatatatataaaatttttaaattatttttcaatcactaataaagctgtgtgccatataatcagctcttgattatattaaccgaataaccgatgaggctattggggacatgtgccattagaaggaacccaaggagctcgagagctgaaacatgaaagttaatcctgacattggaaaacataaacttaattaatgaacaaatttacagcattgaccacagttcaggttcaggaccgatggagccctgaggatccaatggtttgcatttgtctctgtactgtggtataaaactcaattcggaccttctcaatcacattacatcaagattagtgaattttcgtttgaactttacagccattttgtagagcacttcaatttctacgaaaatctgggcagtagatcgtataacaaacgagtcacaccctagatacacaagctcgaattcccgcagcaaatt

SEQ ID NO: 66698 - DNA, 16375 bp, Oryza sativa
acggcgcccgggaagcggctttgcgagcggggagctcgcgcaaggggagggggcgctcagcgcgggcgactcccgcgcacgcgcgagcagcgtgcgggcgaggctgagcgggggaaaggaaagagcgcgccggggggggagagagagagagagagagagagagagagcgcccgggagagagatgggccgagctggattcggcccatcgaacccgggggaggcaaactagacttttgcggaggaaattgatttggagggatttggattcggaattgaactcgacgattgatcggggattgagatcttgagatggcacggacactagacaacaaacaaagaaacaaatttcgcaattagggtttttaagagataattttcccgctaggcgccacgacggaacgggcgctacagaccaacccccctaacaagaatctcgaccccgagattcagcacctaagggagcagctccggaaactcggcgcggagaagatcttctcgttccctggttgcctcatcttcagaatgattgctccattggactttgtagaacttgatggtcttccttcgagtctgacgttctgcctcttcaagaaccttgatcggtctttccttgtaggtcagattcttttccagctcgatactacccaggggaacttgctcttctggaactcgaagacatttctttaactgggatacgtggaacacgttgtgcacatctgcgagaccttcaggtagctcaagctgataagccacttcgccacgtctggcggctatgaggtaggggccgatgtagcggggtgctaacttgccggacatcccaaaccttctcatacctcggaggggtgacacccgcaggtacacatgatctccttttttgaactcaaggtcacgtctccgattgtcagcgtaatttttctgacggttctgcgctgtcttcaagcgttctcggatcagcttaacttgttcttctgctgacttgagtatgtcaggaccgaataccagggcttcgcccacctcattccagcacaagggggtgcggcactttcttccgaacattgcctcatttggcgacatctgaatactagcctggtaactgttgttgtatgagaactcagcatacggcaaacaacgatcccaagtgccttcgaaatccaaggcacacgcacgcagcatgtcttctaggatttggtttaccctttctgtctgaccatcggtctgtggatggtaggccgtactaaaatttagatcagttccgagagtttcatgcaactgcttccagaaccttgaggtgaactgagtgcctcggtccgacacaattttcttgggacagccaaatctacatacgacatgagtcatgtagagttctgccagtttctttccatcataggtggttttcactggcacgaaatgagctgatttcgtgagtcggtccacgattacccaaatggagtcatacccgcagggggttcttggcaaaccggtgatgaaatccattccgatctcttcccatttccactcgggaattggtaggggttgtagcagaccagctggcctctggtgctctgccttgactctttggcaaatgtcacacaaggctacgtattctgcgacgtctcgcttcattccagcccaccagaagtatgccttgatatcttggtacatcttcgtacttcctggatgaatggagtaggcggactcatgagcttcctttaggatgagatctcttaactccttcttggccggtacacagatgcgtggaccgcaccaaactgtgccttgttcgtctatggagaaattggtgtctttcttctcccgtattctttttattaactcttttatcccttcgtcatctttctgggcctcccggatttgtgattctagggtaggctgtactgtcaagctggcagggacacctgactgtaccacggtcagccttaacttctccaattctctgcacaggtgatcttggttaggccgtgtttgggctacattgcaataggccttgcgacttagcgcatcagcgaccacgttagctttaccgggatgataatgaattcccagatcgtaatccttgattagttccaaccatcttctctgtctcatatttaactcggtctgtgtgaagatatacttaagacttttgtgatcggtgtatacttcacatctgttcccgattaaataatgcctccagatcttaagagcatgaaccatggctgccaactcgagatcatgggtgggataattgacttcatgaggcctgagctgcctggatgcgtaggccacaacctttcgttcttgcattaggacacatcctaagccttgtcttgatgcgtcacagaagatctcgaaatcttttcggatatctggcaaggtgagaactggtgcagtggtcaaccttttcttcatttcttgaaagctgtcttcacaggctgcagaccattgaaatttcttttctttctttaacagctcggtcataggtctggctagcttagagaatccttcaatgaatcttcgataatatcccgctaagccaaggaagctgcggatctctgacacgttcttgggcgggttccaagcaagtacagcttcaaccttgctgggatctacttcgacaccgttggaggaaatcacgtgtccaagaaatgctactcggtccaaccagaattcgcatttctagaatttagcgaatagttgatgatctctgagcttttccattatcagcctcaggtgttcagcatgttcttcctcgttcttggagtatatcaggatgtcatcgatgaacaccacgacaaactggtccaggtattccatgaagattttgttcattaagttcatgaagaacgctggagcattggtgagtccgaaggacattactgtgaactcgtatagaccataacgcgttgagaaagcggtcttcggaatatcttcagatctgattttcaattggtggtaacctgacctcaagtcaatttttgagaagactcttgctcctttaagttgatcgaataaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactctccaactcttcgatttgtcttttgacttctgctaactcattagctgccattcggtagggtatttatgcaattggagttgtgcctggtaccagttctatggcgaactcaatctctcggtctggtggcatactcgttaattcttctggaaatacgtcaggatattcactgactatgggcaccgactccaaggaggtgacttgcaaacaggttaggatagaccgacttgcggtaggggtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatatttgaattgcccttatattcctcccaggggaatgtactatcattggtacacgcaaattttgggttttccaaccgtttcttttcacaaaagcttgtgatatgaaagaatgggaagctcctgaatcaaatagaactattgcgggtacggagttgacagagaacatacccatcacaacgtctggagcatcctgagcggtttcagcttgaatgtgattcacacgtcctcgaccaaagtggttggaagcacgagaaccttgtccacttgcctgagagctaggacgagactgagctgccgctggagtaggagttctggcggtgctgccattagcatgccctgagttggtgttggcaggattctgaggacactgtctagcatagtgacccatctggttgcaccggaaacactgaactgctgacggtccctgtggtgacttgaaagaggtaacactgtttggcgcagtattgccactaggggcacgctgctgtggcggaggtgccggacggtttatctgaggacgaggggcgtagcctggctggcggttagtttgagtgatcgactggtggtattgcatgggttgaccgtagcgagggcgaggtgcgcctcgggaagaatttccctgatggttagacttgcgtttcttgtattcttcggtagcctcttttctggcatcctcaagcagaagtgccttgttgatcatatgttgaaaagtggggaagtcatgagcaagcaactggagtctcattccaactgcgattcccttcaagaatttcctgatcttcttcttatcggtgtctacttcctcaggggcgtaccgagccaacttgttgaactgacttaggtactcattgacactgttgttgccttgcttaagtctgttgaattcttctttcttcatgtcaatagtgctttcaggcacatgagctgcacggaaagccgtagcaaactcatcccaagcaatgttattgggttcaggatgtgcattgcagtaattttcccaccaatctgcggcaggtcctcttagctggtgagaggcgtagagcgtcttctcaacaggagtacactgcactaagttgagttttctatcaacatctttcaaccaatcgtcagcctcgacgggctcgacggtctgagagaactctggcggacgtgacctcagaaagtctgtcagcttggatctattgttgcccacgtgagggtggccatgcacattatgctgaaaactggctatggctgtggttagtccttgcaagatttgtgtctgaactgccattatgtgttgcatgttgttttccacatgaggtggggaagggaggcgttcttctccagaattgtgactgacagtgcagtgagagaggtgagactgctccatctctgcatcacgggaaactgtgcgatgcgagcggctgctgcggcggggttgctcaacctctgcgttgcgggaaacagtacggtgcgaacggttgctgcggtgagactgctcattagctgattcatgatttgcttctgcttcaactctaccatcttcaaaaccaaagcgggctggtgcacgagctgcacggcgggggcggctagccatctaaactcccagaaaagggcggggtaagagtcagataagcacttaggagggcaaggagcaaagcaaatagcaactcagatagcacacactaggcacaactggatttttcaaatcataaaaacacctgatacaacgggtgtggacaagtcacagagctacgccgagcttgactgtgcgcacaccacctaggagaaccagactaccaaacaacacccacaacaaacacacgcacgcgctacctcgccacgactccaaaagagttggcggcggaacaaaagggcctaacacacggacggctgctgaagactgcctcctctactcctcgtcggcctggctgccccctgtagtcggctcctcagtcgaagaaacgtcgatcggctggcgcgaagggaccggcggaacctgtcgagggccggcagcagcacgggccgctggcggtgggggagctgggtggcggaaacggaacacggtggaagaaccaacaacacgcttccgtgcagtgcggataaagcgtgggccacggcgggaggaagcaactggagtgtgtccgggggtgtaggaagggctaactgggtgtgggtagggggagtacactggtgagtacggcgcacgcgagctgggggagcgcgggccactgggagtgcgagcagagccgcgggagctatgggaggacaggtggctggcgtggcagaggcggcctgagtcccaagagatagtgtcaactgaggtgacaccctcctcggccagacgggcctccaaagtggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagaaggaaggcgtggaagctgccggaaggcggaacctccgagacggtggctgtagtcgtgggccaggcgacgaagcgcattccaggagaggtcctggtacgcgatctggagagtgggcctggccacagtgaagtggtgggggcgaaggccagctccgtgtatacctccacgagggtaaaggtacacagagagctcacagtgagggggaacacggtccacggagtaccccgtgtactcgggacacgagaagccaaggaaacgggcgaggtcacgaagctgggcgacgtggtgaccctcaccaaaaccgtgggaactgaagctggcgttcacttccatctacaattttgaaagagggagaaagatcagtaaccattttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaaatagtcccgaccggaactagcccgtgacgtttcaaattaacctgttaatcgataccagtcctaggaaacagtgctggtatcacagggagacagaatatcacagcaacagaggtctctttattatagagtaggagtacagtcatgttgggctacggacagatcccgagctcacaactgcattacaaaaggaaagcggaagccaggacttggaccaatcatcacaggcgcgacttgggaactaggccgaaaccctaaaactcatcgtagccggcttgctcctggaagaactcctcatcagcaggatccgcttcatcttcttcagcaactgggggggattatttatacagagcaagggtgagtatgggggtactcagcaagccaggggaaataagtgtttaatgcaggcttcaaggagaggctgttgtttttgcaattgattttatttgaactccttttttctaaaaacgactaagtgagtgcttctcaaacgacacggatgagacagtgcgtcttgtccggtcggagtatgtgcaatgtatcagtctttagatttgaaacaagattggcacccggccaacagcttttcaaacggccacccgggccaacaacttttcaaacggccacccgggcctagctgatcccgtcagctgctgatttttcaaacatcgaacccattttctcaacagcaaattcacaagcggtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatggcaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcggttttggaaatccatttagttcacaagcaccgacccaggtgtcgggttttccaagtcttttgtaaaactccagttttacctaggttgttactcagattttaagtttgaaggcgaccgtcgatactcgcacagagtgcacgaatatcgaggcgcaactgggtggttacaaggggacatggtatggcaattaacaatggaaggatcaaatgcaacaagtcaggtaggtccaccaatctgccttgcagatgggacaaaagattaagtgcggtcctatcaatgcataatatttttcaagcaatataattaaatttcaatgataggctcaagatgttcaaaggtggcttgccttgctcgagatctggagcttgatcctcgaaatcctcgcactgcgggtcttcgggctctgaatctacacgcgaaacggaacgactcaacaaacggcgaaaataaagccctattaatgacctctaagcgtgccattagatagatctcgagatttgatgaattttggaagttgaacggagtcaaacggagtcacggttgggaagatattgaatttctaagattattggatttttggtctaaaggaaaaaggatttaattaaatcctttttggaaaagaaaaagaaaagaagggagggagggaatatagacttttctcgggcggctagggtgcggcccaagagatttggggcggctcggccgagcttaacgggccggccggcccaagacggcccaagcgcgcgcgcgcgcgggagggaggagagagagtccggtggaccgggctcaccacgcgtggccccgggtgggacccgcttgtcagcggctcggctcaccgtgcggagggagcacgcggcgcacgtgcgcgggcggggaggaacgcggtgcacgcgcgcggtccgcggcggacgcaggtgcggcgggcccatgcgcagcctcacggcttgcggtggaacgcgcgcacgcggagggaccgaccggggtcggcccgacccggtctgggctgagctggcgccgacgtggcgcctacatggccgccacgcgggccggcgggaggtagacgacgatccggccgcgaatggacggcgggcggcggcggcgagcggcggagcgaaccacggtgatacgggcaaaagcgagcacaccgggcggttacacgagacgaggggagacgaaccaacggctcggatttgccgggggttgctcgacggcggcggattgcggcggtggcaaccggcggcgggagaagagggaaacggcgacgaggccacgagaggtcgattcccggcggtgagagcatctacgcggcttcgggaactcgatgctagcgtcggattgggcggaactacgccgagcgaggccggcgacgagcgggtgatacggagctcgggcggcgacggcggcgagcacgcagcgagcgacggcaacggtcggggcggcgccggctaactacgggaaggctactcaagctactaccgaaagctaggggaaggagatggagcgatgaggaagaacggagagagacatcaccgagaagaggaggggcgctgtgatgagaggccgacggcgcgggagtaatctctccggcctcgggccggggaagaggaaggagagggtgcggccggagtcctcttccgcgtccttgctcgtgccggcagagggaggaggggcgcggctccgtcccttggcggcttgcgcgcggagtggcgggggccgggcgatgacgacggtgatgacgggggggcggcttggagcggggcggcgacaccggcgactggcgcgcgcagaggctgacggcggcggcgaccgggcggtcggccactcggctcgcgcgcgcggcttgcaatgggcggcgtccgcgcgggcgcgcgcacgcgaacacggcgcgcgggaagcggctttgcgagcggggagctcgcgcgaggggagggggcgctcggcgcgggcgactcccgcgcatgcgcgagcagcgtgcgggcgaggctgagcgggggaaaggaaagagcgcgccggggggggagagagagagagagagagagagagagagcgcccgggagagagatgggccgagctggattcggcccatcgaacccgggggaggcaaactagacttttgcggaggaaattgatttggagggatttggattcggaattgaactcgacgattgatcggggattgagatcttgagatggcacggacactagacaacaaacaaagaaacaaatttcgcaattagggtttttaagagataattttcccgctaggcgccacgacggaacgggcgctacaatatatgattataaaaaataataagctgaaaatttgtttttttagataatggaatgaaacatcccggcctttactccaaagagctacagccaattattacaaaaagtaacacacttataaaatcttaattcgagatgaaactatcaaaccaaccaaaattaaaagaaagacctaacatgacaaggaaaacattattccagcctattagaaaatctccatccatggttggcaaaaagttgcataaccgttgactcaagagtacgacatgcaacattcaggaaaactccatcttcctcacacttttgtagttgagcccacaaccgaagccaatatgttgccctgaaaattacttgcatataggaaatagatggtgatttgtcaaaaaccctatcatttctacacaaccacagagcccaacataaagcagaggcaccaacaagtatcaactttctcttgtccttgtccacaccctgaagccaaccattaaacatatgaggtatgcttctaggaaaatgtaatccaaaagaaaattgaacagctctccaaataaactttgcataatgacaatccataaacaaatgctggatcgtctcatttttcatgcaaaaacaacatattaaacccccattccaattccgtcgtgcaagattatcctttgttaagatgactcccttaagcaaataccacataaagatcttgatcttaagcggcatcttaagcttccaaatgaacttatttctatcaatgtaaccattgctaattaaggctaagtacattcactttactgaaaaatgtctattttgatgataattccatctaaagcaatcagcagaatcatccaactggatatgagcaatggaagcacacaaattataccaaagtgttagattatgtccaactaaagctctcctaaaagaaacatttagtggaacagaacccataacactagcaatagaggcactcttccttctaacaatagcatataaagatggatacttgtctttaaaggctatataagctgaaaatttgtaaagcagatcaagtgatcaactgaatgtctgaatcccatcgtttgcccttttggttatccatcgcaatcaaaattaaattttaatttttttttgaatttatttcaagcttttttagttacagtgtttttttcatcgttgacttttaaattatttgaatggtcgttgaccatagtttttttttttaccaacctcgatcattccgaacatgtccctgtgataacgtcggaaacttgtgcgacggatcagcatgcatgagccggtttccgtcgcacttgtgctcacctcatcactggtcgcgtggatcaaggagttcggagttttattctccgaatccctttcaccgcctcatcgaggcctcgccggagcgccgccgcatcgtgcgtctcctggttaggagccctcgtctccggcggatgcgtgcgcacacgaggagcagccaccgccacaccggcgtgagcactgcggcaggatctcgacacagccatgagctgatcgcagcgctcgcaggtgaggtcagaagaatgcatcaggaatatctcatcgtgatctgatcatagcagattaaaacatgtcgatgtcaaagatttttttttgggtgctcgtgtatttcagccccgtggccttgtgttggtgcggtttttcggctcatctaagccgcacaggacggatctaacggccgcgagacatctcaaatcaaatgggttcggagttttgttctccgagccccgtctcgcccccgcgcctcatgcacacctcgccctgggcgcgcacgcagtacgtcccagcggcatgagcaggcaggcagccgcggcgcgagtgatctcgatcgcgtcgtggccgccttcgttggtccaaatgcgacggggaacgtgcgctgcgatccacgccacgacgcacgccgcgccgctcgcgggcgagggatctatgctatgccgggcgtcagtgcaagcgaagcgatcgaaggtcttccggcctaaacaccagcgatgacgagcatgatggcgtcaatgcttgctcgctgcttgatctgggccgcctgtgctgccgtcccatcgtggtcacgtcggaaacttgtgccacggaatgatcgatgatcagcatgagccgggcttccgtcgcgtggatccaaaggtgttcggagttttttgttttttctacgaacccaccttcaaccgcctcatcaaggcctcgtccgagcgccgccgctgcatcgtgcatctcttggttcggaaccctcgtctctggcggacgcgtacgcacacgaggtgtaggatcggacacaagtaaccaagcctattaagggggggtgaatggtagggaaaaccaaatacctaaaaacttttagcggaaataaaagttaccctcaaatcgatggaaatctcgacgtagtcctgtcgccgccgcgggttgaaccgcttgcacgccgccggtcgaaccgcttgcacgccgccggtcgaaccgccgaacccgatgaaacacaaatcaaagaactcttaaagtagatgacaactttattacttctctgtatttacaaagtgcacgaacagcactccttacaaaaatctcgactaaactcgaaaccctaactaaactagcaactcaattgctctcaaaagcgataccgggaagcctcacgctccccctctatttatacataaaaaacctcctactcaaagtaggtgtagaactcctattcacaatagaactcaataactcaatttcctttttctcgaaaactacagccgcgccgcaccgaagtcggactcctcctgccgtcgcagcgaaactccagccgccaaccgagccggactcggtctctgtgttgtgcctcccaggccaactgccaatcggacatgcaagcccacgtgctgacgtgcatagccttccatccaatctcagcacacagccacacatgcatgtactaaacacacgtgtacagcacacagccacacatgcatgatcaacatacatgcatcgataccatccatatgcatgctacagtaccacgtgtactgtagcaccatatacccttttctcgatttctcactccaatctccttcgcgaacaccggcacttgcacgcacacctcgtgaagcccgttgtaaagatctctcccacatggtgtccatccaccgtgtgccatctcatatccaacttcgtcacccggtattcttgaccgtctggacctcaactcctccctgagtttagttccgatccccaccgttgaccgaagttgacctccaagaatccagactctagtcaccttctcacatggtatcccgaccgcactagacctctgctcctccctgagcatagtcccggtcctcaccattgaccaaggctgacctcaagtcacctgcacacaatcagacaaaacaaccgtttctgggcacagatatcacaacctgacccacattagtcacacgcactcacaccaacatccacacatctctcaaaccaattctttgataaaatcatttgcacagccaattgttcatcataaatattaattatgacaatgatttaacacgaggatcgagcaggaaacccaagccggcgtaccgaaagaggcactctagcatggcaatcccgtcagcgagcgatacacgccgcggcgccacgcgcgcgcgcgcgcgacagcccggttcgcgccctgagcgcgcacgcagtacgtcgcagcggcatgatcgccgtggtgcagctcgccgtggcacagcccaaccgcccaaataaaccagacggccagatcgacgaggaacgcacgccgcgacgacggacgaacgccacagtaagcatagtagcaaccaatcaagaattgcagctaactggtagtaacaacattcacatggatgactatatgcgacccaagatttgcctctgctcatttcatccttctcactgccgattagtatattggccgttcctctatttagggaatatacatgattaaaagaagaagctgcaaatggaggaaacaattttgatccctcgagagaatgtcgctcgtttgtttaaagccatccaaacaattactatgaaaaattctaaaaaaaaattgatagcactcatacaatataagtatgagccggtttctgcaatcgcacactgtgctcatctgggccgtggcagatcaatggacgcagtgggttccgagagacgcatcgtgcgttccctgcttcgatcggaaccctcatctccggcgggcgctggtacgcgaggagccacccacgcgcgcggccaccgacacgcgccggcatacaggaagaagcaccaaccctgctggctgctgccgtcatggtgatcctgtcagcgagtgatgtgaacctgattctcgccacgccacgtcaagccgcgcacgcccatgacagccggattcgcgaccatgctcaggcaggctcgcgccatgatcccatgagcacgcagccgcgcaacgtgcaagatcgcacaccctgacaaggaacgctacgacgaaccgccacgcgccgacgacgacgacgcacgccgcggtactggcgtccagaacaacgctcttctcgacccacacaaacgagaacgatggcgtcaatgcctctgcccgtacgttttactcagtaagaacaccacagccatgcctctgcccgtgccaccgtctccatcgtggcctcgccctgcgacggttcaacatgagccggtttcccctcgcattttgtgctcagctcatcactggtggcgtagatccaagggcgttaggagttttgttcgccgaacccctttcaccgcctcatcaaggcctcgccggagcacctccgcgtcgtgcgtctcctggttcagaaaccctcgtctcccgcagacgggcgtacacatgcacacgaggagcacccacgcccacgcagccacggccacaccggcgtacaggaagaaagcacactagcatggcgtacgacagtcgacagccggttcaaccgcacaaatagaccagacggccagacgaggaacgcacgctgcgacgacggacgaatgcaacaatgaactattagtactagcaaccaatcaagaattgcggctaactgcttcttgaacaccagagacaacgagcttaatctgatgccgtcaatgaccgccgcttgatcagctgcgcacaaaagcctgatcgagccccaaggggggttcgtagctagtttaaaacgccgaaccccatgttttccttttttactaggcaagaacgccaccaccggcctctgaccgtgccacgccggtgcacccgagtgctgccgtcgcatctgttaagaattggttggattgccacgtttccaatcaaacccaagccagcacaagaagcatcacatatcagcaggagcagcagaagctagcacttggagacgatcgaacagaagaaagctaacgcaacggacggagaagctatgccgggcgccatcacaaacaaggtccgcgtcacggtcacggtaacaccggtatacaggaagaaagcacactggcacgtgcacgcatgcacgatgcatgatcacgcggcatctcccacataaccatgaactgattactcctatatccgttccaaaaaccctggaaagggacagatcgcaggcatagttattagaccggaccggtgatcaaaccggtaaggcactcgggtcattggtttattgctcggaccggtcaaaccgccggtttaaacgggttcaaatagatgtttgttatattggtttcacaacaagccgcatagactagtggtggaggctctccatggaagcatggaggttttgggttcgaatcacaagttctgcagctttttccgtatttctctccaacttcacgtgatgcgacgcgttccagcggtcgaaccacaccggtttttgtccggttctgcagtaaaccgcccggttcaaccggtttctcgccggtttgattgcagaccgatcttttagctggaccggaccggccggcgccctggttctagttttttctggtcggaccgctggtccagtccagttctaataactatgatcgcaagtcagaatgcatattagaacattaaaaagatctcgtcctgatctgatgataagttcataactgattctggtaagagtttccatattagaacatcaaagatttttggtgcttgtgcgttcactgttcagacgacggggaagggcgatacggagatgaggggtgtagaggaagtggggcaggcggccggacaaggtgaggaaggcggtgacggaggagtttccctgccgtggaacccgccgaagctccatcgccggtagtgccgccttgcct

SEQ ID NO: 66699 - DNA, 1702 bp, Oryza sativa
tttagtaggctataacctggtcaattggtataacttgtgtgcttcgatcatggttgtcaagtcgtaaagtcgagtcgaggtacccctgaaccaacttgtcgacttggtcgactagtccacgactagcccacgacttggtcatgcaaaaacagtggatgcaatatataatctttactagtattatactgtgctaaggaatgtatataatataaactatggactatagagttgcaaagcaaaacaataagtcgacaagaaataaaactaaagtactaaacacaataagccaattagcatggtgaattggtgatttgctatgactaatcacaactaatttacggctgaatttacgactaatctacgactaaccacgagtaaccacgactaatcgcacgacttgctatttggtcaagtcatggctctttagtcgactagcttgaccgactttacgactaatcacgactagtcgggcgacttgataacaatggcttcaattgtgcatatccatttgacagaagaaagtgaaatatttaaatgaaattttcatcaaaatagtaactcggttcggtctatatacttagctttaattaataatacttatattgggaggaacaaaattaactggatacttaagatgcctcttaagattaagatttttatgtggtatttgcttaaagggatagtgttaacaaaggacaatttggttaggagaaattgaaatattagtgtgagatgttgttttttcaataaaaatgaggggatccatcatttattcatggagtgccattttgctctggagagcattacaggtttcttatggtttatatcctccacatagttcatctcatatctttggggattggcttgtgggtattgataaagaaaacatgaaacttattattttaggagcatatgctatatgttggattctatggtttaggagaaatgatttgttttttttttgacaaatcaccgctcaaatattatatgtaggttttttttgggcaacgtgctggatccggttttaggctcaactataaaggtgtgatgatgacattaagctaataaatactgcatgtcgtaaactcgagtcaaatggtatgcaacttttcaccatcttgtggggtctttaccttgtattggtgcatattagtttatgcttgcttcatgttatttgggcgagcttttttagatttgttggtgtgtgctcgttattgtgtgaatttgtgtaataattggttgtaactcattaagtaaagatgaaattttattatgttgtctactccctctgtttcaggatataagatgttttgactttggtcaaagtcaaactattttaaatttgaccaagtttgtaggaaaaagaacattttcaaccaaagacaaatttattatgaaaatatatatttaattatttatttgatgaaatcaatttagtattataaatattactatatttatctgtaaaattagccaaacttaaaacagtttgactttgattaaagtcaaaacgtattataacctgaaatggagggagtagaaaaaatagtaggcgtcgggaaacagtagtgggtgtgtgcttttaggtcttgatcgaaagtgcttcctcgtaggtaaaaccattcaatctgagcgtagctttattcgattgatctttctttttagttgttactaaaacaacttttgtagactcttcttacct

SEQ ID NO: 66700 - DNA, 1282 bp, Oryza sativa
aaaaagagatacgagtttgggaaagaaggggaaagaacacagccgaagcagggttcgtgcaacctcctcaaccatagtactaaatttacaattttgcattatctgtgcgaaacaatagcacgattttcttaaaaaaaagaaaagcgtaacatcatgcttacattctattacaccacctaccttggaataaaattccttttgcaaccatgccaggacaaaatttctgtgacaaaaacagcacaagccactcgcgaggccgtcggcaaagctccacgtatacatgcatgcggtggcttgatggcgaagtgatggagccaagtccagcatcatgtcgatccaacgtgtcaactccaaaaaaactttaaaaaaccggtccagcgggaacgcgcagcgcaaacgaacgaggctgccgcgtgggccccactcccgtggacccggtccgcgcgcccctccccctcggctgatgtaataaatcctttttaaattaaaatttaaatgaagaaattcgtaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagctcttttcttttacgttggtcgtgtagacgctgcagcttctgaagatccgctcttcgtggaggttgaagccgacgtttgggaaagtgagcaaggcaagtcacatcatccttgaacatattggatcccattttataaaattattttgatttaaattattgcattatcgctttacttaaattcccgcgttatcattgttttatttagcgatgcctatttacctttgttatgaccttattattattgttattgatattattaccttgttcaccctagattaaacaaaaccccaactagtggacactctactcatggtaccactagtatgaatttaggtagatgcttcgctggttaattaggcaacattaggtggttttacaactctagactttgggaatattctcatcatctggacactatggaatggatggattattgtggaattggattcacacctccccctctattcaaaatcctcaaaatggttttaggctaggcttggggtgcatggttttgatagtagcacctcggccatataaggaccggtcttcgggcctctgttgcaaagcactaccgtacttccacatgtctagtgggtaaggcttagtttgtggct

SEQ ID NO: 66701 - DNA, 662 bp, Oryza sativa
caagcatccttctccccgttgggaatagtacaaggaaagaagccaccctagactacaccaaccatgcaggttgcacctactggatagatatatatcttgggatccatgtcaagtgatcatgcaacttagccattgttgagcatatattatatatacataaaaaataaaaagcctaggttcattgtactgtaggtgaaaacaagggacgagcatatcaggaagtgatgttaccgcttagcgatatgattatggtgaactttgaaggtatatcagaatggacattgacgaaattaaactgcatgcctagcttgctatactactaccactatatatgtaggttgctgatggtgattgacaaaataattgtccgtcgatcgaagtgcttttcaaaaggagctaatctcgatgtaacaggggaagtactccctgcactgcgtgtatggtacgtgtgtcgtgtgatgtttaattcgattaagctgcacaacctaaccttgaatgtacccataagatagtatggtatctagaagaatagagaacgaagtaccttatcaaaatatagggccaataacttctgacatgtcagctcctatatgaattttggtttaagttgtcatgattttatatgtatggagtacacctaatacatgctcgaagttatttgc

SEQ ID NO: 66702 - DNA, 3797 bp, Oryza sativa
atgccgctgcctcctcttcctgtgtgggctggcttttagtccagcggtcagcgccccgcaaacgcagcggccgtatgttgttgctacgttggttcgcgcgggcgcaacttcctctacgagctcctctacggccgtccgttcgccggcgccaccaacgaggccaccctccgcaacatcgtccgctgcctctcgccttcccctccgcctccggctcgtgcggccccgccaccgccgacgccgacgcgcgcggcctcatcccgcctcctcgccaaggacccgccgcccccctcggctcccaccgtggcgccgccgacgtgaagtcccacccgttcttctagaccctcaacctcgcgtccgcccgtcgtccctggcaccggcgccgtgccactgcaccggtcgcagtcgggcaaggcggcgccgatgacgactaagccggcctgcccagtccagagtacagacagaagagagagaaagagaggaggaaaggagaggctggtcttacgttgacatgtgggacccacgtaggtctcgcgctgactccgccgccacgttgaacaaaactaggttcaaaaccgctgagagatctagtttatactagttttataagttgggggatacgttgtatctggttttgcggttagaggacgattttatagctcgatgacaagttaagggaacttagatgtactttttccatttcgtttcttcccacattcagatgggcttggatggcccattggagctgcattgtcacctgctgcatggctgtatggcccatgatgctgcacgagcatgcaagcaagtaaccgcgtagagccatgtacgcgccgtggtgctcgctcgaagcttcgccttgaagttaaaagttttaaattttggtatgactttttttcagaaagttttaaattttatttaaaagtttaaattttacgtatagaattttcaaatttgtagtaataaaaaggaaacaatgttcatggaaaaagagaaaaagaatagtcaccgtaattcaaatcgtgattaatcaaaacctgattacgctaatctgatcttatctgctgcccatgtgaacgtgagtatgtccggatgtccccacctccctgcactgcgtagctgtgcaatcgcgtgatgggctgggacggaaccgcgcgcgactttcgctggcgcagacgcgcgctataggtaattcgcactgggggatgcgaatgcgatgcgatgcgatgcgatcgtgtgaggcgggggcaagtataaaggcgacacgtgtcaatcaattagagggaacaaatggaccaattagctggcaaaatttttactccatattcatattttaatgtatgacgccgttgactttttaacaaacgtttgatctttcgtcttactcaaaaaatttatgtaattataatttattttattgtgacttgatttatcatcaaatgttctttaagcatgacataagtatttttatatttgtatagaaattttaaataaaacgaatgatcaaacgttagttaaaaagtcaacggcgtcatacattaaaatacggagcgagtaccagcttgagatagatagatagaagcttgcgggatgacccgccagctttagtaaaattcgtacttctgtcgagcatctttatgatattttagttgttgtggcagtagtattggttttttatccattgttttcattcataataattattttagacctttgattttttttcataatacattgtcaacaactataaagttaaatcatagaaaaatatagttaaatataaatattccttttgggttggtaatatttatcgtcttagacaattacacggtctccaaaaaataactgtaactgctaatttttattacaatacaatatatatagaaatatcaataaatatatgattttattaaactacttttaagactaatccatacgtttgctctgttatttaaaaatttgaccatagctttatcgaaaacaacaagtattaccggcccgaaggaaaggaagtataatgatactacatccaactttaaattttagttcaattattagttagagtttttaaatttgaatttcctaaaaccaaaccttatattatcaatgaaggattaaactcctacagttccttttgaaagtgattgtttaccatattatcattgtggattgtttatttaattaacaggataaattaatatttaaaaaaactaattcacaaatagattacacatgtggtcaaacaaatgcattagaagaaagttgttttagaatgtatttttaaaagcatgtagcaaataacccgtttcaaaaatatggaaacaaatctgaaaagaaccggcctagctagtgccctactctctccataaaaaaaaaacaacttctcgagataaatttggacaagcatttgtccaggtttattcttataagttattgttttccgatgtggagggtgtgcatgcatactccgcaggcaaagagcagatgaatcaacaaacgacagtatacattgctcgtactggtaccaggcaagtatatgtagaagcacccctccctctgcgtgtagctgtggatcaacaagtgacttttgttttggaatttgcaacacacagacatgatcccgtagatttaaatgaagtggtggatgcatgcagattaacacacagcatgctgattttcgtagctggcatatgttctgaggaagaaattaagcttgtaattaagtatctgctaactgacaaactacaatagctcgatcacacatgatgatcagtaacaacttgatcaattgagtcaaatatggtgccgtctattaatttccaagctgttagcaaattaaatgaattggtggatgcatgtacataccagttcacttaattacattggagaactcatacaggcgtcctcgagtggagaagatgatcagtccgatctcagcatcgcagagtatggcgagctcgtaggccttattcagcagaccgttcctatgcttgccggatgtcacctgacggcttgtcttcctctcgattctccctatgtcgatcaatcgatctcccttcacaaacatatacacaaccacaccctcctagtcctctatttgcagttcattacagaagacattcagcaaaacagagagagctgcccgacgccgctgaagcttggaggagaatattcattagctcgcggcaacaggccgcctgacaacgacgctgtccgtcaccgcggcagctggttcaatcgccaagtagccgcaggcgccattatcgccacgcgcatggggggcgaaccgaggggattcgtgctcgcgtgtgctgatctcgtccgccgatatcaggcaagtgaagggacggctacggagatggcgtcacgcccgcgcgtgggaggagagggcctcgccatcgtcggaactcgtcatatatgttgggatatgcgtaggctacgataacaaaaattaaaattttctatcgcgtaaaccaggaaccatgtaagtattagatcatatatcattaccactcgacgcattgtgcagtggaagaaagcgctaagaagtcaaaggaattctcgcgaagtagcgcgcgtcgatgtagaggaagttgtcgatcgcaccagctcgaccttctcctcctcgtgcgttctcctcgttgtattcccactccaatcagcaccgcaaaccagcggcgcctctacggtatccacacgtacagggacggaacgccacgcgcagatgtgctagcacccgcgcgcggctaaggttttgctcggggaggggagtgacggctagggtttctcacgtaatgcaatac

SEQ ID NO: 66703 - DNA, 7558 bp, Oryza sativa
gatctacgcggaggatttggggtacatgtctaccccatgcctttctccaccttcagatgtcaacgacctaaatccgcctgaagaccccaacaacataagtgttctgcacccagctttcatcgacgacggtgacattgatattatccaggaggacatttacaactttcgatatgaccagactcctccaagagatgctcagtcaccggcaacccggttcctgcgccataaacgtgactagttttttgtttagtttacttaatattcgccactaacaattttatgtgttagaccatgtgtttatctattcacattgcccgtactcatagacttgaagaattttatttgttggtgtgctgccttccgcttttttagtgaataaaaagaatgtttccttgacacctattttgtgccgtggaatagaattgcaacaccgaatagtggagttaaactataacttgtcagcttaggtgatgatttcctctggtttatgcaggtgttatagttaaagaataacttttgttttaggtgcctaatgtgcgcacacactgtatgtgtttttaacgttggattccagatccaaatcgcacaaaccaaacaacaatgaaaagaatgaaaaatgacttaattaatttcaaatgaaatactcaatggtgagtgtaaaacatcgtttaataatggtaaaaaacaagacgagcagcataaagacggtgttatataaatttatagtgattatactgtcttcatgcggactcgctttcataaccactggaagattcgtccgcatgtgcttgctcgtcgtctgtaaaaccagaacactctgctgcatcttcagcccactcgtcgtccaaacatcttcgtagcgaagggccctctctgttgtatctccttgttgtactagcgaccgcagtactagccgtgcttccagcatgcgtaccacggcctctacccttgcctgttccccgtggcctgcctctctttcccttaccccttcttgaaatttgtaggattcttcgggcaagtatccgcgtagtgcccatccctcagatggcaccacccacatttccttatgcacaactttttgccctttgctccaagttgaacttcttcctccgggccacgagtccttccttttttcctcgacttgggggggggggctccctgctaattttggcgatttcaactcgtccaacaacgccttcctgcatattggtgtcaaccgtcgcagtagtgtcgcgcggtatctcctctatttggctgcgcagtcccttcaaaatagccatagctttgtcaaatgctaccttcgatttgcatgccgccctaaccactccaaacgcttcaatcatcatcatgtttgtcctgtaattttcttgaacaccatcggtccagttgcctctcggtcatgcctgtcaaatggcacgtcgctcttcactttctttgtgtacctctttaggatgtaggcagcgggtatcttctcaagttgtacatgaacaaatgcccggagcatgtgtgtgcaaaacatgcctacaagacataaaaaaaaaaagaaatcaattggaccagcttatttgtgaagtgcgataaaggattgctggaatttttaatgcgtgcataaatcaagcttgaggttggtatgaaaaaaggacatgtatgctcccactgtttgcactcgcatgtaaacacccctgcgtcaacatctgcaattagcttgaattgcttctgacaccaatcgtgtttttcagaacgtttggtgtgtgatactatccacccgttgcggaaatcgtggtcttgtgaaatcctcaagtcggtgctgtcctgtagcgcctcctcaaacaatctgaaagccgccctggtgtacagtctcgacatctgtataacaaatggccacctcacagccaacattggctttccctgcacaaaagagaagtcattagttgtgtgtgagttaaagtttaggtgaattataaaagtgatgtaataccgaatcccctctgtacagaatatcactaaccgagcatgctcttgtttcagcagcctccttctccttcctatcagttataacctccaacattctcctagcaaaacggtggagcgtagtttgctagtcaacaaacttgtgcttcaccaacttgttcatgctctcactgcgctgcgtggacgtcatcctcccgcagtagtccttcctgaagaacgcaggcacccacttctccctgatatcatataaagctttcatgatgggacagccctccaaatcatacctctttaagaattgatcccaggatgtttcaaactcataaggtttgtaagtttgattgatgcacaacatcatgtctggttcaatttgttcgttccgttcaaaaattgtgttcagcgggtcagagtggcagttaaggatatgccatcgacacagccggtgtattatcccagggaagcaccttccaacagcgacagccattgcaggatcttgatctgtaaaaaaaaaagaaatggcgtaaaacatatcatacaggatgtgaagataaatgggagtaacgcaaatattttatggtggatgacagtaggaaggtttatttaaatagacttgcctgtcaggatgcagcgcggagcagggaaattcgccatgcacttgttgaaggtgttgaataaccactcaaatgactccgccttttcgtctctgagcaagacacatccaaacagtgtgctctgcatgtggtggtttgcaccaacaaacattgcaagtggcatttcgtaaatattagttttgtacgtggtgtcgaacgttaccgcatctccaaagtcggcaaattcagcttggctgctatcatgactccaaaaataagtttttaatgacaccattttcatcgagctgggcgtcccagtaaaactttgggttttgcaacgtgcactcgttgaaaaactccaacagcttgttgatgtcgtttgcattttccatccggacattggctgctttcctgcgtcgttaagttaaaaaagaactaattgaaatcaacatgtgtgactccatgcaagaaaacaccataaatacttcaggaaagcaacatcacaaaaaaggaaaaaggggttattttgaagattcacctgttctctacgtcgcgggtcgtgaatgggattttgtccaggcctccatgaagatcatatagaacgcccatgatacagctttgcggcacgtgactttcttgcattatgtccacaatcttcatagccgtgtcatcatgattcttatgtgcacgcatgggctttaccgccgaaggagatggcgttagagggtggttgtgctgtagctcgaccacatcatactgtaccgatgagagcacgccaccgtcatagttgtgcctcagcttcacataagccttgcaccccattttcttggatggtttcttccgttctctatcacaatctgcgacctttgacacatgcttgccctctctcgtacaacacacctcgtgaatcgatttgtgcgtgcggctcttcttgatgtcaaaaccagcgtgatatgcatatgtcttgtagaagttgtatggatcgtcgtatgtagggaaagccatacctttggtgggcaccatgtgcggtggcacgcaaggaccctgttgaataataaacgaaaaattcgtacttaaatggacgatgaatagttgaaacattacgaaagttttgagaccattcaaaatttattgtggctgctgaatatgacatgtggagtgccagttaaaaaatggcttgtggccatttgctagcgtattcctgatgtgtgataagccggtggtactgtcatgtgcaatgtgtaagttaaaaaattacttgcgtattcttgttactaattctttgaataaatgaaaatacctagcaagagtggtagattctcagttataaattaacctatatcatgaatatatcgttattagatgttcataaaacatagatggtcttggcatgggtattgagttacattttaactattgaaagcgataaaagatgcttctcggtaaagaatcaaacacgtggggtatggatcattgtgaaagtaaaaaaataacttgattcttcatgaagctaattatttaaagtaaatcgaaagtacatagcacgagtgctaggtttagagctataaattaacttatagtatgaggttatcactcttagatgtttgcacaatatagttggtcctgccttgggcgttgagtttttttggaactatcgaaagcgataagaaatgattctcggtaaagaatgtcacagtgaaggtatgtcatgaaaagtggtaaccatatagaaacatcacatcattctacgatttgtgggatacttagtttcgtcatacgaaaatagcaacaaaaagaaacattaaacgtggttggacaaagtgtgcgtttagtgcaaaactattgcaatgtagccgtcgtagatgataaccactaaaaaatgggtttgaaggaatggaacttacatggctatataccctattcggcgtgggggttgcaatgtcgttgtcatccaaacacggtggcatccctcgagagcaaatgtctcctgcttggtgcatgggggtgcattgttgatcgaggagtgactagcggagcagacgacgtggcgctggtgatctccggcgacgccatgagcagccaaggaagagccgccgctggaaggatgtgctccgagtgccaccactaactggcagctagcatggtttatgattttttttttattttgtgtagtgtttctctatggacggatgctttggcaataatgacggatctgcatgggttgcacgtccggttttgtggtgtttaattttgaaaagaaggaatcgtgagttaattgtacggtaacgatttgtccgataaatgctcaggccgtttctttttttttttcaccgaactaattattttgaaacaaacgctgtggtgataataaacggtactgtcagattacgagttgtaaatagactatagtgtagtgaaattgtcgcgaccgagaaaattgcattttcccgaacgctagtgtattaatccccgtcccaggaaaagccggggtacaccatacaaacatgatataaaatacacatctttattatatcgataatatttacattattacaaaggcacttaaggcctgacaatcaaaaataaacagcagcggactagcgggcctacggctccatcttcacaggcgctcaactggggtataagccaagactccacctaaggcttcttctccaaagcttctcttactgaagaggggagaaagatagagaaagaatgagtacaaccacagtactcagcaagtcacaccggcagatgcatgattaacgcaagggggtacaaggggtaatgatataggggttaagttttgcagaaaacagcatttaaagatatttagttgctcaaagctatttcgtaaacacgattctagaactatacaatattatttatcaaggccgtgaaccctcacgaacctgccttaacccaaggcctacgatgattcagaccgaactggcaacccgaccctgggtcccagctcgtcccaagccaacccaggccaaccattccacattttagttattgagcaaattttaagaattaaaacactaacttgggtacattgctcggcttgcccataaccgagggcgcggctattcgaataggttttactctgatcagaggtgtacatctttacccacaagacacatcttcctcacgtgcaccacgtgccacataccaccacggtatacagacggaagacgtgacatagtttccaacccatcctagccatagacaagagtaccgaccctaccccacctacggccggaacctccgggacaggtaggcaggattgagcccctagcagcaggacaccagccctgtgccataacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtactttgcaacagaggcccgaagaccggtccttatatggccgaggtgctactatcaaaaccatgcaccccgagcccagcctaaaaccattttggggattttgaatagagggggcggtgtgaatccaattccacaataaaccaacaattccaaagtgtccaggtgatatgaatattcccaaagtctagagttgaaaaaccacctaaagttacctaattaaaatagcgaagcatctacctaaaatcatactagtgataccatgagtagagtgtccactagttggggttttgtttattctagggtgaacaaggtaataataacaataacaataataataaggtcataacaaaggtaattaggcatggctaaataaaacagtgataacgcgggaatttaaataaagcgataatgcaataatttaaatcaaaataattttataaactgggactcaatatgttcaaggatgatgtgacttgccttgctcgcttcaacttctacgaagagcggatcttgacttgacttgacttgacttgccgtcggcttcaacttctacgaagagcggatcttccgaagctgcagcgtctacacgaccaacggaaaagaaaaggcttttactctaataaactccatataacagcagaaacaaagcacaaaaatgggttcttgacttcttaagaaaaaattagagacttgaacggtccaattccgagttcaaatggtcaagttatggccatttgaagtttatatgctctttaaatggatatttgcgaatttcttcatttaaattttaattaaaaaatcggatttattgcgtcagccgggagagagggcgcgcggaccgggtccacgggagtggggcccacgcggcagcctcacggtccacggtggaccgggtgcacgcggcttgcgccggccggcgccgtgggtcccacgcgtcagccgcacccgagggcgcgggcggctgacggccgggccccacctggcagccgcggggcgcgccggaagggggcctcgccggcacggccgacgggaggcggcgcgcccgcgcccctatggtcgccggcggcggccataggcacggcggagcggcggccgagagaggggagggaagggggaaacgaaatggcggtcctcggctcaccccgggtcgacggcgacgacgggaacggcgaccgaagcggagagaggcggcggcgcggctcaggtcgacgaggacggcggtgctccggcggtcggcgggcgaaacggaggagtggacgaggtcgacgagaacgcggcgaagccgaaggaggcgatgccgaagcgggaggaggtccggggcgacgacggcggcgaaccggagctcggcggcgacggcggagagagaggacgacggcgcgggctcgattccgacggggagagaaagcggcgagtggcggaaacggaggagggaggcatggggagcgtttaaatagggttgggagtgagagagggcggccggaggggaaggaaatcggcgcggcgatctcgggctcca

SEQ ID NO: 66704 - DNA, 5788 bp, Oryza sativa
cacacccctcactgtgaaacagtctgttctattatcctgaacatgagatatacatgcatgctccagtacttgcgcatgttccagtacatgcgacaatagagatcactgggatatggttcattaggataaggagattatctccaaatttgtttcaccttcttatccattgtaactgaatactgtaagccatggtagaggctgtttctaccactatttaacagagatgcggcccgaggcaaagggttcaacgcttcacattttatcacatggtatcagatcctttttccacctcgatagatcgcatctttcatccacatggcgtcgtcgtcgtcttcctcaggcacggcagccgccaatctcctccaaggccactcggtttcagagaaactcgggaaagccaaccatgcattgtggaaagcgcaagttagcgctgcagtgcatggagcccgattgctgggctacctcaacggcgatatcaaagctccaaacgccgaaatctcggtcaccatagatgggaagaccacaacaaagccgaatccggcatttgaagattgggaggccaatgaccagcttgttcttggctatctcctgtcatctctttcaagggatgtgctgatccaagtcgccacatgcaagacggcggctgaggcatggcggaacattgaagcactctactccaccggcactcgagcaagggcggtgaacactagactcgccctcaccaacacgaagaaaggaacaatgaagatcgccgagtatgtcgccaagatgcgagcgctttgtgatgagatggctgccggcggtcgtccacttgatgaagaaggccttgtccaatacatcattgctgggctaaatgaagacttcagcccgatcgtctccaacctttgcaacaagtccgatcccatcacggttggggagctgtattcccagctcgtcaactttgaaaccctccttgatctctaccgcagcactggtcagggaggagctgcttttgtcgctaatcgcggcaggggcggcggtggcggcggtgggcgcggcaacaacaacaactccgacggcggcggcggcggcggcggcagaggcgcgccgcgtggacgcggtggcggcggccagggtcgcggtggccatgggcgcggcacaggaggccaagacaggcgccctacctgccaagtttgtttcaagcgtgggcatacagcagctgattgttggtatcgcttcgacgaggactacgttgcagatgagaagctcgttgctgctgctactaactcgtatggtatagatacaaattggtatattgatacaggtgctacagatcacattaccggtgagctagagaagcttaccaccaaggagaaatacaacggcggcgagcagattcacactgctagcggagcaggtatggatattagtcacattggtcatactattgtgcatacccctagccgtaatattcatctaaataatgtcctttatgttcctcaagccaagaaaaatcttatatctgctagtcaattagccgctgataattctgcttttcttgaacttcactcgaaatcttttctataaaggatcaagtaacgagggacgttctgcttgaagggaaatgtagacacggtctctacccgatccccaagtcctttggtcgctcaaccaacaacaagcccttggtgccgccaagttatccctgtctaggtggcatagccgtctaggacatccgtctcttcctattgttaagcaagtcattagcagaaataatctcccatgttcagttgagtcagtcaatcagtctgtgtgtaatgcttgccaagaagcaaagagtcatcagttaccttatattagatctactagtgtgtctcaatttcctcttgaacttgttttttctgatgtttggggccctgctccagagtctgttgggagaaataaatattatgtgagtttcattgatgattttagtaagtttacttggatatacttgctgaaatacaagtctgaggtttttgagaaatttaaagaatttcaggctttagttgaacgaatgtttgatagaaagattattgccatgcagactgattgggggggagaatatcagaaacttaattccttttttgctcaaataggaattgatcatcatgtgtcatgtcctcacactcatcagcagaatgggtcagctgagagaaaacacaagcatataattgaagtaggcctttctcttttatcttatgcatcaatgcctcttaagttttgggatgaagcctttgttgcagccacttatctcatcaatcgtatacctagtaaaaccatccaaaattctacacccctagagaaactgtttaaccaaaaacctgactactcatccttgagagtgtttagttgtacatgttggcctcatcttcacccttacaatacacacaaactccagtttcgctccaaacagtgcgtgtttttgggttttagtactcaccacaaaggatttaagtttcttgatgtgtcatcaggccgtgtctacatctcaagagatgttgtctttgatgaaaatgtttttcccttctctacactccactcaaatgcaggagccagactcaggtctgaaattcttttgttgccgtcccccttgacaaactataatacggttagtgcagggggaacacatatagttgcaccagtggctaatactccattacctagtgataatttaatttctaatgctgctgatgtgacttctggagaaaatagtgcagcacatgaacaggaaatggagaatgagcaggaaatagagaatgtcatgcatgggaacgacgtgcatggggacgcggcatcgggacctgtgctggatcagccaactgctgacagcagcactgcgccggaccagggagctaacaccagtgacgcggtctctggcgcagcttctgacgcgggtggagacactgccaccctgggagctggagcagcaaatggcgcagcagcaggtggcgaagaatcccagccggtgccgcctgatgtgacgggtacagtagcggctacagtagcccctgcatcgagaccacacactcgtctgcggagtggtattcgaaaagagaaggtatacactaatggcactgttaaatatggttgtttttcttctactggtgaaccacaaaatgataaagaggctttaggagataaaaactggagagatgcaatggaaactgagtataatgctttgataaaaaatgacacatggcacctagttccatatgagaaaggacaaaatatcattgggtgtaaatgggtatataaggttaaaaggaaggcagatgggacacttgacagatataaaactagacttatagcaaaggggtttaaacaaagatatggtatcgattatgaagatacttttagtcctgttgttaaagctgctactattagaattattctgtccattgctgtctctagaggttggagtcttagacagttagatgttcagaatgacttccttcatggattcttagaagaagaagtatacatgcaacaacctcctgggtttgagtcatcctctaaacctgattatgtatgtaaattgaataaggcattatatgggctgaaacaagcaccaagggcgtggtattccaggctgagtaagaaacttactgaacttggttttgaagcttcaaaggctgacacctcattattctttcttaacaaaggagggataattatgtttgtcttggtatatgttgatgatataattgtagctagctctacagagaaggcaactacagcacttctgaaggatctaaacaaggagttcacacttaaggatttgggagacctgcactacttccttggaattgaggtaactaaagtttccaatggcgttatcttgactcaagagaagtatgcaaatgatatgctaaagagagttaatatgtcaaattgcaagccagttagtactcctctttctgttagtgaaaaattaactctatatgagggatcacccttgggtcctaatgatgcaacacaatatagaagtatagttggtgctttacaatacttgaccttgacaagacctgacatagcttattcagtaaacaaagtttgtcagtttcttcatgctcctactaccagtcattggatagcagtaaaaagaatcctaagatacttgaaccagtgcacaagtctaggacttcatgtacacaagagtgcttctactcttgttcatgggtattctgatgcagacggggcaggtagtatagatgacagaaaatcaacaggaggatttgcagtatttttgggttctaatcttgtgtcctggagtgctaggaaacagcctactgtgtcaaggtcaagcacagaggcagaatataaggctgtggcaaatactacagccgaactgatatgggtacaaaccgtgttaaaagaattgggaattgagtctcctaaagctgccaagatttggtgtgataacttaggagccaaatatttatcagctaatcctgtgtttcatgcaaagacaaagcatatacatgttgattatcattttgtaagagaacgagtgtcacagaagctgttagagattgattttgttccatcaggagaccaagttgctgacgggtttacaaaggcactgtcagctcgacttcttgaaaattttaaacacaatcttaacctaactaggttataattgagaggggctgtgaaacagtctgttctattattctgaacatgagatatacatgcatactccagtacttgcgcatgttccagtacatgcgacaatagagatcactgggatatggttcattaggataaggagattatctccaaatttgtttcaccttcttatccattgtaactgaatactgtaagccatgatagaggctgtttctaccactatttaacagagatgcggcccgaggcaaagggttcaacgcttcacattttatcacactcacgaatatataggatctatcactcgggcctccaaggcccgtaggactcttattcggatccctatccgaattaagctcatattagatctccatccaatccctttattccggcccattaaacatgcgaccctgtaggttcatgtacactcggctataacccgaaaacttcttttcggtccacgcgtcaacagcggcccctagcagaacgtattgacccaccgggcatacataaatatcatattggctgaacctctagtgtattcttatatgaaccttcacgatatcgattaagctcaaggctagatatgtgtcatcctctaatagctcaatcattcactcgaacctattgatagattatataacttgtgattgactcctcaatcacctttggtatgaccatacacttccataatctacaacatcgagggcccagagatatctctccataggaggggcaaatcccatcttgattattcatatcccactatatgtttcatagcatacccgaaaactacttttataactacccaattatagagtagcgtttagtagtccctaagtaagctactatacatgttgagaactatgataatttcagatctaaggattcaacaccaacactaaatgagatcactgatgacacaacacatatggctcttgcagtgtctcatgttgggtctatccaacaacatattccccaacatgtgtccacattattaatttggtatctctataccatgatccatgagacatgatcatcaattaatacatgtgttgatcatctaaacatatttgctccacatatgatatttgatcagggatcctttagaaataggaacaaacaacataaaaagtctcat

SEQ ID NO: 66705 - DNA, 1847 bp, Oryza sativa
aacctcaatagtagttttattatgaaagatgagatacacatgccaacccaaaagaatggacaatgccaaagctagtggacacaaaaataccccgcaaatgatctgcacatttgaaacatattattcacttagcatattatacaaggtcatattatacagcatgactgaaacagcccttctgaggtacttacaattgatgttctagaagaatcactgcctaattgttcatttttaggcaaactgtgcacagcacctcctataaccagaacctgttataaatgttaatcctcacattcttaatttcctaacaaggaatagctgctaaaataaaccaaggatattgaagtaccagtgaatataagcttgcttctacagcatacagcacaaagactaggaaaatcttgttttttcatgtccaacacaattgttaatccatatacagtgatggtcctgcatatattaaaaaaagggaataatgcaaattggaactacaaaatagaaaacattgaactcaacactattactacaagtcagcaccattcttagaacacatctcttgcagacacgacaatgatgagcacggggaggcttataatgggaacatttctgacaatatctcaaatcgccaccctgcaatgacaggcatgcagaaataagcaggcaaaacacataaagaatatgtgatgagaaataattccagtactaacaataatgtatataagtgtaatgttccaaagagacccatggcttttcattatagagcaaaaaaaaatagctttccttttcaaaacctttttctttacacaaaatgcccaattggtgtgttcgtgcgctaaatgcatgtgaaatctgaccagaataatcatcaatgtttcatttgaaactactggaaacaaaagaatatcttctaatgcaagaacatacgagcgcaacaagtcaacaaccggtaagtctactgaaggcaggactagaatacgccttaatggttcaacaagactaactgatagcaacataattatagccaatgaaaccttagtaacaagcaaaagcaaagcagattgaatgcaatacattatctttatgcaggcacctattgtttaaacgccccaaatgatgtaaagcccttacacactgccaaatgggaaataaataatactatcagctgagctaccataagctcagaaaataattaatgataattggtaactatccagcttcctcatcaaccatcattatgtatttaatgtgtgcaatagatcccaaaacattaattttcgaaatctattgcacacattaaatacataatgcaaaccttccaattcaccaaccaagcactcggcatgcaagactagacctaagattcgtacttagatccaagactatataatccataatacaaaggccctcatctcgcaatatgtgcattcttagcagaagtacaccccgtaagttcaaatatggatcataacagtatgtgaagatcgaatgcaaaacgcgctcacctcaccccctccatagccccatatcctcggatgcacacctacatgctgttactctcttcctccccaaagacctcaacgttgagctcaaaattgccatcccactctgaagatctaaagcccacgcacggaatatcagctcaggggatcttcctaatcggcaatgtccgaaatctaaacccaaaggtatcaaattttgaggccgaactgtccaattctgctagcttcccactccaaggatctaaactttgcagcgcaccgcggggggcgcccgcgagatctgggtggccccgacggaagagggtggaccggccggtgtaccttgcgcttgatctcgtggatctttta

SEQ ID NO: 66706 - DNA, 8381 bp, Oryza sativa
tcgtcgcagccggtgagtcggtgacaataaatgttgtggaagcactgatggtctgagagcaggtacaatagcaggctataagccagctccaaatatattttaaggagataaacaaggagagagaagagcagcaggctacagatttgtagccagctgtagcgcgaagaactccaagacacagtgtctgtatgacaggtgggacaagatattaatagtgtagtatgtaactattgtatgaacgagctattaaattggctataaataaattggagctagtaaacttgctctaatgcatactcatccgggaagcactgccagcaacctgggcttcagatggaaggagctagatagacacgtggcagaattttggaggtgtctaacttaaatttttatggcgccacatggcccaatcggaggcttgattcttgaccctcaaatcgtatatagagatatgcagatactgtcgaatccctcacgctgatggccggtgcaaggtgcaaactggaggtaattaaattgatgactacttgattcagccctgccctgtgcaccaagtcattgtgattctataatccacctcctgttttaattaataactctgatggttgatcaagtttgctgctcgatcttcatcagcttaacgccatctgctttgtaggtttctttctagccaaagcaaaaacaggagaaaactcccctcgctctggaacacctccgtgcagcaaacgccatccctcgtctgttttgtactcctaaaacggaacgactcattagctatcttttttaaaaaatcagattaatatatttttaaagcaacttgcataacactctgtttaataatttgaaaagtgtgcgtgcgaaaaataagaaatactatgtgttgagaaactgaaccaacaactcagcgggtttacatcgtctaccgttgaggctgacggcaaacattgcaattgcattcatccgtgcgaccgtgccacacatcctcctatcaacagctgcgtgcagtgatcccaccattatgattaattagggcctactaatcagcagaattacttatttttcctccaaaaaatcagaaaatagaatatgcaccggtggcaaaacacgcaagaacaaaagcagagtagattgttttttaagatttgatgcattccatttttctaacttatatcagtttatatatgtgacatcccagcctagggcttaatagaattaatagaatactcataagttacaacttcttttctggaagccaatcttcatataactctgaggttaaacgtgcttggcctggagcaatttgggatgggtgaccgatcgggaaattctaacctcgtgcttggcctggagcaatttgggatgggtgaccgatcgggaaattctttccgggtgcatatgactctgaggttaagcgtgcttatcgggaaattcttcccgggtgcatacgagtgaagacaacatatgcagaatacgagtgaagacaaaatatgcagaaaagacttgtgttaatctgtgaggatagtcaaataaatggctgtgagttgtattctcaaggattttgtcagtaccttcatttcgctactagtttttggatgaaaaatactatatctaagacatagtaatagtgcaacaatgctgtttttgtcaaatgaatacttcaatattttataagatactcccccgtcccaaaatataagcatttttggaacgtgacacagtcttcgagatactacttttaccaacaatatatatatataagtaagatgttttaaataaaagagttacatattatgatattttgtttaataataaatctaggaacatcaattttatatgattgatattttttaatttttttttctattaatagttaaagttgaaaatgtttgacttgtcattatgctaaaaatgtttatattttgggacagatgaagtatgtacaattattcgagtatttggatagctcttagtataaaagaagcttgctttgctgtagtattatgctctgctttacttctgtgctcgcgcgctttgctgccgagtgcgtattctatttgctgattttttttaaagagaaataattaattctactgattagtagtccctaattaatcataatggtgagatcacttcatgtagctgttgataggaagatgtgtggcacgaataaatgtaaatgcatcggcaatgtttgtcgtcaacctcaacggcagacgatgcgaacccctgctcagcctaataattgacactggatgagtgaaaattattctaccatattgtgccaatttttaatctaattttctcgcccacgtgtaaactctgaatgctcactgtcaaacaggtgattgttgagctcgctctgttgtacttacaaagttaaaaacatcatagtaaaccaaataaaagaactccgtatcttatatttataaggtgttttacttattttctaaatcaaaccatctaagaaaccaacaatataaaaagaattcaaaggtcggttttttagcgtatttttataatataatattataagttgttttgactttagtcaaaattaaattgctttaagtttaaccaagtttgtaaaaaaatagtagtaatatttaagttaatacaaatatattacgaaaatatattcaagaaaactaatataatattataaatattactatatttgtctataaacttagctaaacttgagttagtttaactttgatcaaagttaaaacgatatataaactaaaacggaggaaatatttgtttggacttgattaaacttatgaaaaaaatccattttgttttactacgacgtggacaacgcggggtctggaggcaacgaggtacagctcgtccaaagtctccaatgccaccggctaggatggagatggacaacttcggctcgccgtatcagcaggcgtggccaccagcgcaggccaccgtcgacgtcgcgggtcggtggagacgtacgtcgcgcgttaggaagaagaggttctagccttctaggatgttcttgtcagctgcaagcagaaggttgaggccttggaggctatagagacaccggcgaggcggcgacagcgccgcttcgggaaggtgagggtcagggggttggtggtgacggtggcggaggaggggaggagctgacgggatgcagcccgcgcagcttctggtcgcctgcgctgaggcggtggtgtgtgctgcgaccgcgcgcaggcggcaacgctgtaggccggcgcgcccgtgcacggcacggcgttccagcgcgtcgcatacttcttcgtgcaggagctcctggaccggcgagcatccgccggcgttgggccctgcgagcatggcgttctgcatcctgtagtcgtcgtgcgcgcgggaggcgcgacggcttgcgcggcgaggcgttccgtacctgtggttcgcgcacttcgtggcgaacgcgtgcacgctgcaagccttctagggagagagcaacgaccacgtggtggacctgggcatgacactgggcctcgacggcggaaaccagtggcgcggcctcctcgacggcctagccgcccgagctagcgggcgagagcgaagatggattctattaactcagagtggacgttcacccgtttattgtatgtttactagatggttacgaaaattttttaaaaaaattgacaaaatagatcaatatctaatatatcaatccacaaacatgcaagttcaaattcaacttctacaagttgtaacaaaaataacaaatttaattgtaaatatgcatatgtaatttgagttttgtttgttatttttgttataatttttagaagttgaattttaacatgcatgtttgtggattgatatattatatattgatatatcttgttcattttttttcattttttttctcataaccatttagatgagatacaataaacgggtggacgtttactcgagctgttaaaatagtttcccaacatgaatgatgaatattactacgtgtcaagattatgaataccacgtacctaatagtagttgactaaatctcggcaggacccaccacatactatgtcttatacgaaaactaacctcggatatggagggagttccggataaagaaagacaactagagttctacatgaaaacgaaaggactactcaaattgtatccatattagtttccctagttctacttggacaaggggacacctataggtataaatacaaggccccctaggaggacaagagacacggaacaatagatcaaacacaaaatcaacatacaagccaacatacgtcaagacaagacgccggatatcgacttcagagataagcatagctagtcccctacggtgtctatggatactgtcagaagagacatagcgttgtctttgatctcgccggatgcggattcgaggaggaaggctatcctgttgtcgactacgagtcaacacttcagaccgccaagtcgacaacagttagataggctaccccaaatattgtattggtgtgattatggtgaataagagtaacgaccggcttcggccaacaggatgtagggctattacatgtaagataaggggcccgaacatgtataaaaatccctgtctccatctcttttgcctcaatctcgcatataccatggtaccaacgatccccataccatccagataccatagtcgcgatatcaaacatcgacactacgaatgtggattttcatccctcgagggaacatccctccgttgtttgcatgtcatctaaatagttataaaaaaatttgaaaacaattgacaacatagattaatatgaaatatatcactctacaaatatgtaagtccaaattcaacttctacaagttgcaacaaaaataacaaattaaagtaaaaatagttattgcacattcacaactatatttgttatttttgttacaatttgtagaagttgaatttaaacttgcatgtttgtggagtgatatatttcatattaatctatgttgccaatttttttatatttttgatgactatttaggtggcatgcacgaaacgaggatatatcccctcgagggatgaaatgactttccctattactactccctctgttttagacagagcaagtttaatagtatagcccactactagctccaaatcatttatagccaattcatataataatagttacttactatactatcatacctggtcccacctgtcatacacacatcacgtcttggagtccgtgctgcagctgactatagatctgtagcccgttgcttttctctctcttcctttatctctttaaaatatgtttatatatagctggcttatagactactattgtacctgctctgagacgttttgatgatgctgttcagagcaagtttaatagtatagtccactactagttccaaatcatctatatctaatgtaatagccaattcatataatagtcgcttactgtacaattaatacatggtctcacctgtcatacagtgctgcatgtagcccgctgcttttcttttttttatctctttaaaaatatatttatagctagtttatagcctgctattgtatctgctctctaagccggtccacaacggtactgttcatgcgacgaccgcgtcggcgtcgatatcgagggttcagtattccgtacatccccacagtcccttgacctctggatcaatcgatcgatccacgccacgcatgcggagatccgcgcgaatctcggagcctccggatcgattccgttgcagctgattagttataaacccgtatctcaactgaaaaaaaaggatggatgtatacgggactgctcgcttatatgtagaccttcctctactcgttggtaaacaatttggttatacgtctccgcgttcttctctcatggcggcggatccatccccacagatgcataagacgaagaaactagtcagggtgaggaagcaagtagaggtggtgctgccagtagaggtgctgccgccgctgccgccgttggccgtcatctgcaagcacaaggaacacgtatggatcacgcaggacgattacacattcaggttgttcgatatcaacctggtgctcaccttggctgccgtcgggtgcgccgggctaggcttcttcctcttcccgaggaaccgggccctcgggatggctctcgccgccgctttcttcgtgggcttcttcgcgcacgccaaggcatcgatgctgctccactgggacgtcttcccgcggttcgtcctcgccatcctcgaccggggccgccggcttatggcggtggcgtgcgttgccatcgtcgtggtttgcgttctccgcttcggtacccaggacggcgtccgccgtgccaccttgttcatttggaccgtcgccatggcgctggccgcgctgaccggctgggtcctccgcgtcgagaggcgcgtctccgccgctgcggaattcgttgaattggacggcgacacgagcctttggaacatccgcaaggatgggcgtctcgccgccgttgcagatatcgaaggagacaccacgttttatttgctgacatctcgtggaattattccaactggctacgatgtagtagtacatactgccaagccatgtgttacatgtgtatgatcgatcaggtgatcgaatgattgattattagcgccgttaatcaaataagttacgcctctctgtttccggtctactggcctgtacgtggatgtctgggtataaatgtttggctagaattcttatgtgtgaaaagaaacttcagatttgctataccacattcgcatgaaaattagcgcaaaaatttacatttgtttttttgtttgtatgatttgtgctgcgatcgtgtgctttggtgtgcttctccttttcatccagcgaccagttaagattcggtgtagagggaggctgaggcggcggcgacaggagaggcgacagtggtggcaacttaatgggaagcaacggtggtgtgtgaaaaaacggttagggtggaagatgggcaatggtggagccacctcctagatctggctgcatcgttgcagtttggctaattcttaatagccgctcgggctcaacaatgttgctggcactattaccgaagatgagggaatagatggtttgttgacgtataggaaaaatggttggccaatgagaaacgccattagtagttgaggatgaaggaagggatggttgtcattgacgtgtggaaaaaaaattactacctccattttaggttgtaagacatgtttaactttagttaaagtcaaactactctaactttgactaactctatagaaaaaatagtaatatttacaacactagcataatttcattaaatctataattgaatatattttcataatatattagtcttggattaaaaatattacttcctccgttccagaatataagaagctttagagttggacacggctattaagaaagtgtaatgccgcgcttcgagcaagacattaaagattaatttaataaaaacctatccgcgaaaagtttcgttctttgtgtgcgagtctaagtcgtgccatggaatctcaaattttaatctccttgatccctctcatcgacatccaaaatccacctcatcgaaatttctcttccaattcaagtctccgaaatcaaattccaaatgtcaatcgcttcctttgaatcctcgtcaaatacttgtccccgttaccaaaaatatcaattcccattttgatttccccctctttgactccaccttatgttcctaagaccaagtatcaaagttagatccaaatccttctcaaattctctccaaatcaaaagtttctgacgaaagtctaattagggtccctcttgctctgtgggccgattttctcttcccggcccatctctccctctcggtccgtctctctctcgcacgtgtgtcgctcgtgtccaggagcaagagagagcgccgccgtctccttcctctctcactcgattttgggcctgttcactttgatgccatttcaaccttaccaaattttggtaaagttaccaaaaaagtggctacatttagtttgctgctaaattttggtaactatataagaaatcctgccaaaattttaaaaattttggcaagttgccaaagttttggtaactatgccaaaattttggcataatgttttttttggcaacaaagtgaacaggccctttctctcccggcgccgacttcccgccaccgccatctaaatccccaccaccttcgctggctcccgccgtgtcaagccctggcaccgcccgtgcccacgcccggccccgctgcctctgcgcgcatccatccaaggatgggaggcagaactccctgcctcgcctcctcctccttcgcctttttcccaaatcggcaagagcaaagctccccttttctccctactttttcatttttcctctcccggaccgatgccctgcc

SEQ ID NO: 66707 - DNA, 18945 bp, Oryza sativa
  unsure (1)..(18945): unsure at all n locations
ggcgccgtgctaagaccgcgtgcaggcggcaacgctgcaggccggcgcgccgggcgttccagcgcgtcgcgtcgttcttcgtgcaggagctcctggaccggcgagcatccgccggcgctgggccctgcgagcacggcgttctgcatcccgcagtcgtcgtgcgcgaggcgtacgcggaggggttagggatgtacctcgagttcagaggaatcaaccgtggcctcgagagcctccacatcgacgacctcggcgtcgacgccgacgaggccgtcgccatcaacagtgtcctggagctccactccgtggtgaaggagagccgcggggcgctcaactcggtgctccagaccatccgcaagctgtcgcccagggcgttcgtgctcgtcgagcaggacgccggccacaacgcgccattcttcctcggccggttcatggaggcgctgcactactacgccgggctgttcgacgcgctcgacgcggcgcttccgcgctacaacgcgcggngggcgcgcgtcgagcagttccacttcggcgcggagatctgcaacgtggtcgggtgcgagggcccggcgcgcgtggagcggcacaagcgcgcggaccagtggcgccacagcatgagccgcgcggggttccagtcggtgccgatcaaaatggcggccaaggcgcgggagtggctggacgagaacgccggtggcgacgggtacacggtggcggacgagaaggtctgcctggttcttggctggaaggggaagccggtcatcgccgcctcgtgctggaaatgctagaccgccggcatccggtggccggccgccggagagaggtagacaccgatgctggacgtaaataaagagctcgatcgagcaccattgtccgaccatggatgatgggcaaacacgatgctgttcaagccattatatgagcatgaacacttgtataaataaggccactggttagaggcttgttgttttacaattttgtgtaggttcttattgtttaattagctcatctaacaacatacacttatattgtccttttattttctgtcaaagtgcaacatgacacatcaggtttgtggtgggctgccctgaactttgactgaagacgttttgtacactttgagggagatggttggattttatgatggatgattagaagatgttcggggggatacaaattgggtttcttttgtgtgtttggtaaaaatttggctatcttaaccaaacccttcgtatggattcgtttgtgggcgagccaaaccctatatcctactccctccgtcccaaaatataacaattttagcactcaggatttgtcccaaaatataataacttatccatcaacattctcttcacaaccaatcacaatcctccaccatttacttttctcacctatctccactactcatccaatcataaccttctgccactcacttttctcacctacctccactactcattcaatcataatcttctatcactcatttctactctcttaataaccgtgtacaactttaaaacttcttatattcttgaacggagggagtaattggttagagccacctttgctgtcactagagttcatagaggttgatggttgcaaaggataagcatatcggagcatagatcgcaacacatatcatatgaaaagaaatatgtaagattttgctcaccgccatcccttccctcattcttggtggcggagctagtcgacattgtcaagccaaagcgaataatagcgtttctaattggctggcctgtcttttccataagtcaacaaacaaccaacccttctctcatctctctggtggagccaatggcgtcgtctgtcttgagcaactaatggcgtttctaattgtctgatatttcttccacatgtcaataacaaccatcccttccttcatcctcaacgactaatggtgtttctcattggccaaccatttttcctacacgtcaaaaccatctattccctcatcctcagtaatagtgccaccatttttcctacacgtcaaaaaatcatctattccctcatcctacacgtcaacaaaccatctatagtctattccctcatcctcagtagtagtgtcaccatttttcctacacgtcaacaaaccatctattccttcatttttcatacacgtcaacaaaccatctattccctcatcctcattagtagtgccagcgacatcgttgagccccagcgactaagagttagccaaccatgcagcctgatctaggaggtggctccaccattgcccatcttcctccttatccgtttttttcacacaccaccattgctgggttgtggccaatgggcgatcgacgatcgatccccatcccccctatacgctctctctccccccttcctcctcccattcttctcttcctactacaccataaattttaaaaaataaaaaataacaaagttggaaaaaatatgtatagaaatactatatataaaaaatatttgaatttaaattcaaatttgaaacggatatgtaaacttttgacttataaactttagatctataaactaatatttgaattcaaattcaaatttgaatcaggtatgtaaacttttgatttataaactttgggtttataaactttaggtgtataaactttagatgcatagaaatactatatataaaaaatatttgaattcaaattcaaatttgaatcggaatataaacttttgatttataaattttgggtctctaaactttagatgtgtaaacttgaggtgtacaactatagatgcatagtaaagtaatgcggtgaaaaaaaaaagagaaaccgtgcggaggagaggagagggggccaatggccccttagcaatctcgaccattgcttcccattacgttgccaccattgtcgccgccgcctcagcctccctctacgccgaatcttaactggtcgctggataaaaagaagcacaccaaagcacaagatcgcagcacaaatcatacaaacaaaaaaaaagtaaatttttgcgctaattttcatgcgaatgtggtatagcaaatctgaagtttcttttcacacataagaattctagccaaacatttatacgcagacatccacaggccagtagaccggaaacagagaggcgtaacttatttgattaacggcgctaataataatcaatcattcgatcacctgatcgatcatacacatgtaacacatggcttggcagtatgcactactacatcgtagccagttggaataattcggcgcacccgacggcagccaaggtgagcaccaggttgagatctaacaacctgaatgtgtaatcctccggcgtgatccattcgtgtaccttgtgcttgcagatgatggccaacgacggcggcagcggcggcagcacctctactggcagcacgacctctactttcttcctcaccctgactagtttcttcgtcttctgcatctgtggggatggatccgccgccatgagagaagaacgcggagacgtataaccaaattgtctaccaacgagtataggaaccggatggtctacatataagcgatgtatatatccatcctttttttcagttgagatacgggtgtataactaatcagctgcaacgaaatcgatccggaggctccgaggttcgcgcggatctccgcatgcgtggcgtggatcgatcgatcgatccagaggtcaagggactctagggatgtacggaatactgaaccctcgatatcgacgccgatcgacgcggtcttcgcatgaacagtactgtcctggacgatgggctggccgtcttgaacagcattgtcaaaacgtcttataacttaaaatgggagtagtaatattcatcattcattgttctctgtgtacgccatttaggtttgtgtaatatgttctctgtcatgttgcactttggcagaaaaggagcacgatacaagtgtatgctgttagatgagctaattaaacaataagaacctacacaaaattgtaaaacaacaagcctctaatcagtgggcttatttatacaagtgttcatgctcacacaacggcttgaacagcatcgtgtttgcccatcatccatgaacggacaatggtgctcgatcgagagctctttatttacgtccagcatcggtgtctacctctctccggcggccggccggccaccggccaccggatgccggcgttctagcatttccagcacgaggcggcgatgaccggcttccccttccagccgagcacgaggcagcctttctcctccgccaccgtgtacccgccgccgccggcgttctcgtccagccactcccgcgccttggccgccatcttgatcggcaccgactggaaccccgcgcggctcatgcggcggcgccactggtcggcgcgctcgtgccgctccacgcgcgccgcgccctcgcacccgaccacgttgcggatctccgcgccgaagtggaactgctcgacgcgcgcccgccgcgcgtcgtagcgcgggagcgccgcgtcgagcgcgtcgaacagcgcggcgtagtagtgcagcgcctccatgaaccggccgaggaagaatggcccgttgtggccggcgtcctgctcgacgagcacgaacgccctgggcgacagcttgcggatggtctggagcaccgagttgagcgccccgcggctctccttcaccacggagtggagctccaggacactgttgatggcgacggcctcgtcggcgtcgacgccgaggtcgtcgatgtggaggctctcgaggccacggttgatgcctctgaactcgaggtacatccctaacccctccgcgtacgcctcgagctcccgcccgatcgctctcatggtgtccatgcgcgcgccgacgccggtgacccgcacgcgcgccggcttgccgctggcgcgggcggcgaggccgtcgaggaggccgcgccactggtggccacggtcgaggcccagcgtcatgccgagatcgaccacgtggacgttgctctctccctcgaaggcttccagcatgcacgcgttcgccacgaagtgcgcgaaccgcaggtacgggcacagctcgtaggccagcgcgagcgcctcgccgcgcgcgccgtcgcgccccgcgcacgacgacggcgggatgcagaacgccatgctcgctggccccagcgccggcgggtgcgccagcggcagccggtccgcgagcccctgcacgaagcacgacgcgacgcgctggaacgccgtgccgtgcacgggcgcgccggcctgcagctcgcgcagcagcgccgccgcctgcgcgcggtcgcggcacgccaccgcctcggcgcaggcgaccagcagctgcacgagacgcatcccgtcagctcctcctcctcctcctcctgcgccacccccgccgccgccgccgccatcaccggcaccgacccggaacgtcgccgtcgccggtgtgtccatagcctccatggcctcgaccttctgcttgcaactctcaagaacgtcccagaacctcttcttcctgacgcgcgacgtctccgacgacccgacgacgtcgacggcggcctgtgccggcgaccacgtcggctgatacggcgagctgatcatgtggtccatcctggtgaccttggagaacctggagacgagctctacctcgttgccatcaaacgccgcttcgtccacgtcgtagaatcggtagtaataatcaagttcttgattagtacaaataatcgttgaatcttgttgctgtgtcagagtcagatgatggctctgctgctgggaacagtctgagatggagttgcatggctcaggggacatgcccatgttcatgtgaggtttgcaagggcaaatgacctaacaaaatttgttacaaggttaatacatacccggtatatatagacttgtagagttcattagtatagtgtttcattagcttaaaaacattagcattgtgtttaagctgtctgacatctcaggctagccgtttgcctgtctctcttttcgataagtagtagtgctactagaaccctagctaatactagtgttttttatttggttaattacgatgctgtttaacttgttaagtaagtacaatgcagataaaactcacaatcagtctgtctgacagtgaacattgagagattacacgtgggcgagaagattagattaaaaattggcacaacatggtagaataaatttcactcatccagtgtcaaaaaaaaatcagaaacatgcacagttcagaaatgcatctctatcgtctgtgctattcaattagtagatgagtacaagacagatgagggatcgcgtttgttgcacggaggtgttccagggcgaggggaattttcgcctgtttttgctttggccggagagaaagctgcaagcagatggcgttaagctgatgaagatccagcagcaaacttgatcagccatcagagataattattaattaaaacaggaggttgattgtagaatctcaatgacttggtgcacagggcagggctgaattagtctcttcgttaatcgttaggagcaaagtggttatcaatttaattacctcctgtttgcaccttgcaccggccatcagcgtgtgggattcggcagtatttccatatttgaatgtatttttatatttagactgctaatcttcgccacttcaaattcatagtgtcaattagataataacaacataaatttcagaaaaatctcatggagtgaagttcggtacgctgttgtgcaataagggacacagtacaaaaggcaaatgctcgccggcaatagccagcaaagaaagaatacagcagttgattacagctacacgcagagtgtctgaattctgcagtctgaacgcatgcatgcaagattgattccactaatcaaacagctaatctcgatcaattaagtaaatgcttttgctcatctctatgctcatggagaattaaaatagctggagaaattggagcactttcacccaaaacgtcactgtggacgccactctctttcgtctgaaccgcagtagcacgatcaggctcagctccgatcgagggccaggtatacattcttcctagttcgagcgttaaaattttagttgccgtatgattagtttgtgcgttaatactccttcatcgacaatgcgtgtgagatctagatgattgacaagtgcatgccattatgtcatcatgccaaccataaacaaattaattatggtgttactgatccaattaatatcttgctaagtcatgagtgtaacgcgaaaaaatgccgtaatgatatagttcttaaccataaaaaaatgtctaacatcatgcagattatcttcgtgtgttctaattggctttactcttattgtatgatgctttcacagaaacaacaggatactatacgcaatggtgctacacgcttgaaattggtaaccaagtaacttttatttcagtttggatagcgtagtacctacagaatctcatggtagaatctacgtgattttaaaaacattattttagtagatcatattatcggtagaagttgggggtttgtcccatctcgtcttttttaagctcttttctattcacttctaaactttttggctgtgtgtctacgagcagaggccggagatgtaacccatttctattatcttaaaaaaaattgagtgtaacgtgaatgaaatatctctagcagcttaatgcgaaatatgaaaattaactagctgtagtgaatctatggtttgtaaatagttcggtactactgaacatgacgtacgcatcagaaaattcagtactatttttaaaatataaattggttcaaaatatatatcgagcttgaagtggttctgaaactgaaacaagtggccttgcattgttcgttccgcttaatggtattctaagatacgtggattgatgattgatcaaggcaagaagactgttgtgcttcctttcgctttcaaatgaaatttgaaattatatagcatttcgctaatcgctagtcatgcctatgtacatcatacatgagccctctctacagtagtcagtttgtatctgaattggttttcaacttggtcggcgcagctaatcatggacatttggaacaccagtgtgctagtgcccatttgtttaattttggcggttcagattatacagagtggtttttcttgagatttctcccggtcccaatccattcaggagaagacaggctatatagtgacatttttgaaagggacaccaaagccagataatttccatgttatgtttggtccaaaactggcagcagcggtaactaattactagctaggttaccccgatgcacgatgcatcttacttaggtaattttttacattttcgccgaacatagtggagatgaggctcaactttctccaacttgtgtagctctgagaggaagcaggcgtacgtacgcatgttttgcagttgctttcgtgatatacacgcactcgaaaggttaaaaaaagtaaaaaaaaataaattggtcgatttaattgaagtactttttctgaacagatgtatgtccagattagtaataataagatatgtcacttttaaaactgttttttccgtcttataaaaaacgaatttagaatccgatatgacacatccgatattatattgattttttatagtatggaggtataggtaatgcgtattccttgtacgaggagggtgaaaccatcgtacgattagtgcgagattcgtcactactgacgatcgcaaagcaggaaccatgcggcgaagtggtccaattctcggttaattaattgcaaatggtagttaagaccgatgttgcatcgatgagatgggagcgccaacgggctaatatttatgcctactttgaacccatgggtttcagaacgaatttggatgatgaattatcgccgaatcagttcgattttgctggaatttgaaatttgggagtgcctagcaatcattcgaatgatttttttcattcatctcactcggatttttcaacatatggatgtgcgccacgttgcagagggaaacggtctagcttaatcgtaagttctaacaacggacccaatctaatagttataagtccaaagaggtttaataaaaaaaatgtcatcaacatatgcattaaaaagttacactgtaattttagtataattacactgtaattaatttgtaagtagtatgtaagtttgttctttggacacaaaacaatattggttccttgctcagttggtaaaaggcctttgttcggcaacaagagatcgtgcggtcgactcctcgcttacacgtgaacacacacattttattttcccacccggtccaaaaatcgaatgatatgtaacaaaaaatctgtcgcaagatttatagcaaaaccgttgaaatttttcgaaacgacgccttacatgcaaagccgaactgctggggttttggtaattctccatgggctaacagctgacatgaagcttaacttttattgggccaagcccatttgtgtcataaatgggctagcgagtaaaagttgccaagtcaacccggcccatgtgcactagtctacggtcttcttatacgtgtaccagcgtgcgatgaggaggtaggcggcgaagttggcgacgcagagcgcggtgagcagccagaagaagtagtcgaggtggccgcggttgatgtcgtcggggatccacccgggcgcgccgcccctgcgcgccgccacgacgacgagcgccgagctggcgtagtcgccgagcgcgaacgacgtgctggagagcgccgagcagaggctgcgcatggcgtcgggggcctggtcgtagaagaactccatctgcccgatcagcgtgaacacctccgacgcgcccaccaccgcgtactgcggcacctgccagaacaccgacggccgcgcgatcagccggcggcgcgccgcctcgagcgcgccggcggcggccatggcgacggtgaggatgacgaggccgacgcccatccgcgccagctgcgtgaacccgccgtcgtggcgcgtcacgcggcgcgccagcggcacgatggcgcggtcgtagagcgccacccagagaatgacgctgagggtgtggaagatggagagcgcggcggcgggtaccttgaagcggccgaggctgcggtccagcgtgtcgccctggaggatgaaggtggtggtcacctgggtgtacgccgccgcgtagatgatgccggtcgcccacaccggcagcagccggagcacgcacttgagctcttccacctgtgtcaccgtgcacagtcgccacgggctctgcgccgccttctcgccggcagtcttcaccgtagctctgtccaagaacctagatcaacaagcagccgagttcatgaggcaaacgatttgaataggtgatttagggcctgattagtgagcttaaaattctaaaaaatagttagtcggtaaccagtttctaagaatttagaaaagctcggttttccagcttttgacttctagtttattttctagattttacaactacaacttttcaaaattatgaccaacgctaaactttttaagggagtttttaattctagaaaaagctgcagcagttagaagctctccaaacagagccttagttgcgccatgacaatatgacatgtcatctcaaagaaagggtcggcaattaaaagttgatatatattattctaaactagctgaatttttatgtgcagtgcatagagctaatatatgttccactaaagtaaacttttttgtttacctccctttgataataaatatttgacgtttacttgcaaatgttccactaaaagaatatttattagtaacatctcaaactttgaactttctttgtttatttttgtggcaatcatggtttttatatctcttagtattaatgcgatggcttgtacataaagaaagacttttaaaaaacttgcatttattatacttttgtcgaagttgaattaccttgagttacaaataaatttgatgcggagtgagtgtaacttaacttgttggtttctttgtggtgcaatccgatcatccagattcaagtttagacttggcgtgagtgctcgcatttgcggctaattatttttttcagtggtacatgacgtaccccttgataccaagacattcgcagtgaattcgttagtatcaaaatatgttgactcagtcttttaaagatgctcatagctagaaataggatgtgcatgtatgcatttataggggtgagtatgcgcgcgttgtgagcgcatacgtttgtactatgtttctaaaaagaaaaagaaatatggcatattatgtgtttatggagtgatatttcacatattaatttatattatcatattcattttaaagaaacatttgagtgacatacgagaaaggagaggatgcccgcttgagaccttgttcgttcgatccctacaagaataagattgagaggaattaattccacatctcataataggtatgaaattattcttcttcaaattctcttgtgggtgggattaaaaggaaaaggcctgaggcggaaaatccatctccttatagactagactggacgattagtactattaacacaagaatttgatggtactaatatttggggttaatcaatccacatgatttttagcaatctcaaatcattttttcctccaattcaaagagaaacgacaaaggcaattgcactaactggaaatgcatacgcttgctcacctaaactgaccggtgtggaggagtcggcggcggccatgtatcgccggcatgccatcgacggcgtcgctctcgtacagcatggacgagtccgacggtatctccacgtcgaacttcctgaccgcggcgaccaccacctgcgcgatcctcgtcagcgggctgccccccggcggctggtcccgccggtacgtggcggtgccggcgaggaacacggcgacggacagcgcgctgaagatcgccgggacgccgtacccgaccccccacccgacgctggtctgcacccacaccagcacggtgccgccgacgagcgagccgcagttgagcgagaggtagaaccagttgaagaaggagctctgccgccggccgcgctgatcgtcctcgccgtcgtcgaactggtcggcgccgaacggcgccatgatcggctccagcacgccgccgagcgccaccaggtacatcccggcgtacagcgccgcgctctccagcctgatcaccgacgcgctcgccgccagcacgccatagccctgcatgctcgaaaaagaacacgcgatgtataaagcgtgagctagagctctctgcacacatccacgacgtacgccggcggcggcgacgaacgtaccacggcggagatgaccatggagagcacgatggtccagtatcggccgaggaaggcgtcggcgaggtagccggcgacgagcggcgcaatggagccggtgccctcccagttggtgacgttgttcgccgccgacttgctgccctcgtgcagcctgtacttgaggtagttcaccaggttcgtcgacacgccgaagtaggccatgttttggaagaaattgttcgctgatcgaccaacgcatgcaccaaagcacagaagatcgatatgcaagtatgcaacacgttacacgtactgggatatactaccaaaatgtctgaatttacgagcgtgttttactttaccgaggatgaaggtgcaggcccaccgattccggcgatttgacttccggcggtcggcggcggcgccgccgtgccggtcattcgattccacgccctccatggtttcagcaattcagagaatcagagatcctggaaaaatggctggaaaaggatgcagggttggtgtatcagagatgctgcgaggctgaggtcgaaggtttcgaaggctgctggagctgtacagctctatcttcgatacacctatacgatctcaatatcttggcccttttacttagggaatggcttatccctcagggataagccttatcgtttactacatgtcatttaaatagttataaaatatttaataataataataatataatataatatttgatatattacttcgcagtctagtagcatttaataaaatgcaccatttttttatttaaaaaacactttcaattaatggacttgcagatgcaacttatattctactgaatgcaagaagcaaaaccaacatgctagaaacagagctaacatgcaactagtactagtaaagaaagaaataaaggaacttaacaatctatgagccgatttcaaaacgggaagaccgccactcaacaatgctaatgaggaaacactatactatttcaaaagaaggaagtttggaagcaatccaaggagcagaacaacatggatatgaaaaaaatataatccactacttggggaagtgccgtataagtgtaaagcaataaccacaaaaaggaggattatactcaaagagtcaatgtctaaagaaataggagtatattcctatgtccaaatcaactaattcaactgagcatctaagtttaaattctacctatgtaggttgtaaaaagacagtaaactctaattaatatacgtttttgttttattgtaacttgaagaagtctaatctgggcatattattgtaaaaaagtcataaagataattatcaaatgcttaggttttaaaacaacagtacacataaatttgccttcaaatattattataacattataattataagtttattgtattttataaactcctaatatcaacagcattagatattcatgtcttcatcgataaagggtagagatggaagatcacatcgaaatgccttaaaatttcatagtggcatgtattttaataaaaataaataaatggtagagcaataagtaatttgaaacgagcggagtatatattggtagtgtttagcaatatctataaccagtagagtattcattagagttcaaaaagaattcctaagcactattatgtactccctccatctaataaaaaacaaacatcacattagatgtgacacatcctattataacaaatctaaacataagtttgtctatatttattataataggatgtgtcgtattcacgagattagtttattttgtgatggagggagtacgacattattcatcagtcacccccgaaggtactagcatacactgaaatataggctgtatgttgaccataggggtgaaaacggtaacggtaattaccggccgaccggcgttcgttttcgactttctaccggccgagccatatggaaatggtaatcgaccgaaacaaaaatagaaatggtaaaaaatatggaaatgaaaacagaaatggttttgctgttataccgatcgtttccgtatttaccgtattctcgtggaaattaccgtttcttataatatggtaattaccgtattctaaatatgtcgatattataggacatgtctatacttgacccacagcttatagattgaatgactcttcaataaaatctctaacttttgtacatggctaaaatgaagttaatttataatttatatagtataagcttgaatttatgtatatatatatatatataacatacttatgtaaagttaaatatatgtttttatagtttaatgtttccgtatttgttaccggtttccgatctgtaccgacatgtttctgtctgtattgttccgtttccggttttccgatatttccgatatcgttttcatttccgactttaccgtttccgatttcgtttccgagaaaaatatggttacggaaatggttgaggctgttttccgatcgtttccgactgttttcatccctagttgaccatcataccctctattcagtatgggccaacatatatgtagcccactccgccatacaaagcccaaatccaaagtgatgtggcctattgaagcccagcccaacactgctgatatacggtcgatgcaagtacggcaaaccttacggtttagggtacggtgggccccacccagctaatctacggtcttcttgtacgtgtaccaccgtgcgatgaggaggtaggcggcgaagttggcgacgcagagcacggcgagcagccagaagaagtcatccaggtggccgcggttgatgttgtccgggatccacccgagccgcccgccgcgcgccgtggcgcgcgccacgacgacgacgatcgccgagctcgcgtagttgccgagcgcgaacgacgtgctggacaggccggagcagaggctgcgcatggcgtcgggcgcctggtcgtagaagaactccatctgcccgatgaacgtgaacacctccgacgcccccaccaccacgtactgcggcacctgccagaatatcgacagcggcaggtaccccccgtcgccgtcgtcgccgtacaggccgtgccgcgcgatcacgcgccgccgcgccacctccagcgtgccggcgacgagcatggcgacggtgaggatgacgaggccgacgcccatccgcgccagctgcgtgaacccgcgatcgtggccggtcacgcggcgcgccaggggcacgatggcgcggtcgtagagcggcacccagagcatgacgctgagggtgtcgaagacggagagcacggcggcggggaccttgaagccgccgatgcgcgggtccagcgtgtcgccctggaggacgaaggtggtggtcatctgcgtgtacgccgccgcgaagatgatgccgctcgcccacaccggcagcagccggagcacgcacttgagctcctccacctgcgtcaccgtgcacagccgccacgggctcggctctgccttgtcgccggcggtctccacggccgccttgtccaagaacctgtgaatcatgcaacaaaccggacgaggaatggctaatttagtcaatggactagttataaaactttcgaaagaaaatttctctaaaatctttcaaatataactacactgtaactgtagtgtgtttgtattattactcaagtgtaaatcgaatgtaactagtaaaaaattttacaagtcttgtaacagcgcaagtggctagcttgcgtggcttgcgagcataggtcctgagtatgattgtgcaagcgcacaagcaaatccaacggacgaaaaatggaaagttttttttaccctattttctgtccacgtaaatttagcaaatccgtttaggggaatagatagatcgtcttaattacttctgttccggcgcaaacgtaagagtgggatgttgaaatggtcacggtgcatgcgaaaatgacttcccaagttctcattcacctctacccaggtcagaaccaaatggaaaatgatgagaaatggaccagacacgagtacgacaaacttacttctcattcatctccacccgtaatttccaagagaaaaggaccacatttatatgcgctcgacgactccaagtcaaccaaaagtattgcccggctacaaactttctcttgaaaaatactcgtataagcattttgaaagataccccaaattttgtacgcgccttatggttgagaacgtctttctttacaatctaatcgctagtctttctttcactaaaaaaaataccgtcgatgtcacaaggaacagtacgcaaattaggtgcaccggtagactaaacactgtcactagagtcactagactactataaactttttttaaaaaaaattcagagaaactactgagcaagtgagcagtgtgacacgtgtcccaatttttaaggcgatgcatgttacgcctactcacctaaactggtcggtgtgcacgagccggcggctcccctgtatcgcggacatgccatcgacggcgtcgcagcactcgtgcagcaacgacgcgtcggccggcacctcgacgtcgtgcttcctggcggcggcgaccaccacctgcgcgatcctggtgagcgggctgccccccggcggctggcaacgccggtacgcggcggtgccggcgaggaacacggcgacggacagcgcactgaagatcgccgggacgccgtacccgatcccccacccgacgctggtctgcacccacaccagcacggtgccgccgacgagcgagccgaagttgagcgagaggtagaaccagttgaagaaggagctctgccggcggcgctcgccctcgtcggcctcgtcgaactggccggcgccgaacggcgccatgaccaccaggagcccgctgccgagcgccaccaggtacagccccgcgtagaacgccgccgcgccgccgtgcagcagcgccggcgccgcggcgctcgccgcgagcacgccgtagcccaggacggagatggccatgaagagcaggatggtccagtacctgccgaggaacgcgtcggcgaggtaggcggcgacgagcggcgtgatggagccggtgccctgccagttggtgacgtcgttcgccgccgacttgctgccctcgtgcagcctgtacttgaggtagttcaccaggttcgtcgacaccccgaagtaggccgtgtactgcatgaagttgttcactgcccccatacgtgacagcatatgatgcatccatccacatcaatcacagatgcaaaatcatctcgaaataatgagataatgagtatgtgttttgtgttaccgaggatgaaagcgctggcccacgtggtccggcgatccttcttggacgtccggcgatcgtcggcgtcggcgtgccggccattgcaggattctacaccttccatggtctcagcggtttcaaagaacctggaaaagagttgagacgatggggacgatgcatacaagacgaaggctgagggtgaaaggtttcaggaaacggacctctgcactgaaccgtttggagcgatcgatagagctgtgaaggccagctgctctatcttcgcattcactccagcttcacgctacgctctcggtatattcgtcgcgccctttaatagacactctcgtagggtggttggatttttcacattttggtccttttgaaaaacttatttcgtaagtagacccctagaaaaacttatcccaaaaatggtcctttttggggcgccagagtgcctggcgccgtcattcaacaggacggcgccagcctctttggcgccgtccccctgccgacgtggcggggcgatgctgaggtggctagggggagtgcgccagagtggctggcgcccccccgaatttttttatttttgttttatttgtttgatattttttcacgcttagggacacacaagaaccaaccatagaaaaattgaactcaaatggacgtaatatgtgacatgtagaatttttcctctcctctcctctctccgaactagtgcagaggagaaagatgtgcaacttttttatttttattttatttttttgatatttttttcacacttaggaactcacaggaaccaaccatgtaaaaaataaactcaaacggacgaaatatgtggcatgtggaattttccaaagctccaccgaaaaacttctctcctcgaaaacacaatcttgcaagcggaatttggaggttttaatatcgccgaacccggcaaagctggagagaatcggatgtaactttttctgtagatgcccgtgcatatattatttgcctgattccgtgtccgtatgagaaagttacgcctattttaatagatgacatattttgtccgtttcggtagagttttggaaaattctacatgtcacatattttgtccgtttgagtttatttttatacggttggttcctatgttctcctaagtgtgaaaaaaatatcaaaaaatgaaataaaaataaaaaattacatctctatgtactgtttaacttatatagagattaagtaatttcatatagtggtagagtgcatatagtggtaatattttgaattagattaagtaatttcatatatagtggtagagtgcattatgtttaacatgttgatcaaagagttttactaaaggagttatggtctaattttagtgaaggtgcaaagtagactaagtggtatgctagatattttcagacttagctaggtggtagttcgagtttaaattttttttgtggttggttgtatcgtgatcctgagtgtgaaaaaacatccgaaaaaataaaataaaaatgacaccgttgcaactccatatagagaaacaggaatggaggcggcggcgcca

SEQ ID NO: 66708 - DNA, 2174 bp, Oryza sativa
tgtcgcatataggcaatgtgtttatccatataaggatagtcggcaacgtgtgaactgttgcgtttgccatatcacacgaatgatctggcgcctactagctactgctggaatggaagaaatagcccgccacgcgcatcactctctcctgaaaatcacggcgcatcttctaaaatgccaaaattagagcagccatttttttgccgtatgcgtcgtgctgatctgtctcgtcacgaatagcaggaaaaataagatcagtccaactttgcaatgaatctagacgcgcctgcattgcaaggaagaactaccgctcaaaagtgcaacagcgatggatgctgcctgcagggagagtccagccgtggtagtaacacacacacacaaaaacctgtggctacagtaaacgcaacaaagacacattcacacaacacgtccacgtataagaagcaaacatagcacagcaactcagcaagaagcatcggtcacggcagaaagttaccgcccagctcggcgataaacaattacagacaagccaggtcgtcgtcactcgtcacacacattggcggcttggcgcgaacaaatcggcaaatctgtcgtgcgcggccaagacgctaaaccaagatgataaaagccgcggacacccagccgctacggacgaggagtacacgtggccgtgcttccctccaaaaaaagaaaaatataccgttcacactaggtcaccactcaccacaagtgcaggttcagctcaatacaggttcactgaacacgactagcagcagtacatgttggcaggaagaaatgaacaatgcgatcaagcagaaagatatactactccctccgtcccataatataagtgattttaagtttttgtttataacgtttgaccactcgttttatttaatttttttttcaaaaataaaaaacgaaaagttgtgcttaaaacactgtagataataaagtaagtcacaaataaaataaataataatttaaattttttttgaataagacgagtggtcaaatgttgcaagaaaaaactcaaaatcacttatattatgggacggagggagtagtactttggtgtctgccctgggtattatactgctcaactggattcggttcgcatcagatgggtatatacaaaactcgcaactgcatcagtttttataatttttttatgtacggcgtgacagcggtggtactgtttgtgtgaaggccaagttgagaattttgtttgcagcataatgttccctcgagtcgtctccgtgcagtgtacacgtgaagaaagtagggaggcagcaggatgtacaagaatgccgtcatgcaagttgtggtgtcaactcgcgcctaagacggaaaagaaaattggttttgtctgcccataggcgtttgacggagcaaacaggggagaaccgattgatccatttggattagtgtcaatcaagtgtcaacgtctctgggaagcctagatgaccctgctttggtcaatgttgatagcgacggatgtggagagattacagtgttgagttgttgacgaggcgaaattacatttggaattcgcaaagagtacgactggctaaaggaagaagatgtgaaactcgtagctgggccaagtccgggtgagccacaggcccatagtcttagatgctgtggcccgcttaggactatgaagcccaaatgaaggcccacttaggaccatctgattagtcacaaacgaagattagtcaccgttgcgctgcattcacttcagatgaaaatttcctccttcaagaagtagatggcaatgcgacatgtgcgcttaaatgtccagttcttctttcgcaagctgggtcggctcaatttggcgttagctgttatgtagctatctccgtgtgtatcggaaaattgtacagcccaatcttctttgtcagcaaagacatacgagcacctttcagttatgctgtccatctacctagaatcctccttgcctccttcgctatgtatatttctcaatagcgactagaatccgcataattgtcacgtctacctagaaatcgctagattcagaccgaaggtacatttgacatgggcatcgattgtgacatgtttatgagactagtttttgttgatttttctgctgtttcaggtcatattgggtgatcactgttggaaatttggtcataattcggcatattttaatccaa

SEQ ID NO: 66709 - DNA, 9512 bp, Oryza sativa
gggaggagagcggcggcgccggccaccggccaccggaaggttcgtctcctctctctccgccttctgctccccccggatgttcggttgctttgttggcccccacgcggttctcgctgattcgtgtacgctcttggattgttgctgttagggttcgggagtggtggtgttgggtagtgaagtcggctgcggcgatgttgtccaggatctcgcagctcggggcgcggcttctgcgcgagaacagagctggtacgcacccttttcgtgtctctcttgttttttattggttaatcctctggaagcagctgagaaatacttccaaaccatgacgaatctatacattatcacgaatgattaaagaggagagagcgatcgatttgtatgaacgatatgcatgcttccactatccattctatggccggtttaggctgagccactattgttgagtaaatcttggtgctataccattggctttttattgttctccctcttgtgcagtagggaatttggcaagcagtacaaccagctattatcgaggtcaactcagccgacgttttgtcccaacggttagtccaatctgtatcttgttgttgtgatgcctagtggtgagtttggacgaaaattttgcataccctttgtatgtgttttcaccgagagcttaacttggccaagtcaactgtatcttatataccctttatgatgtttgcattctgaaatttgtatagctgttactgacaatccctacaaaaagagcaatcataaatgttttctagatatgacatggattttctgaaatgaccaatatgaattgtgcattctgaaactgagagacaaaagattttatctatctgcacattctccaccaccatctttatcttgggattatgttctgtactaccagaagagatgatttaccatttgcaaatgtccttgtatgtaatgagcactggtctgtaacttttcagaagaacatcttattctccacagcaacaactagtagtgatcgtgacgatggcagtcagagcaaggagaagtaagtatatttcctctcccctttcttttcctttttctggtatagcatgaaatttgaatacctagcaatatttgtattggacaaggtagtgatgtatcccatgtcgttgtaatgtgagtttcttcaatgtctttgttgtctttaaaggggcttctccttcagtttttccctcctaggaaatagctgtccaaaacaaccgattaatttttctaatgagcaaatttctttgtgctgcacaggatctctgtaacatttgtgaacaaggatggcacagagcagacaatcagtgtccctgttggaatgtccatcttagaagctgctcatgaaaatgacatcgaacttgaaggttactgatttatcattgcaactgtactatgctttcaattcttaacttcttttgctgataagaacagctataaaaagcaaattatgtttacccaatagacatggcgtccattattgattacttgatgttatttgacatgtttcatgtattgactattgactgatttttaattgtagttagtaacttggtctagtattttgggtactgcaggagcatgtgaaggttcacttgcgtgttcaacctgtcatgtcatagttatggtatgctctatataaccattcctttttttattatttttcatgctattgtagagattgaagtgccactaactagccatttcaattttgtccaggatgtaaattattataataagctagaagatccaacagatgaagaaaatgatatgcttgaccttgcatttggacttacagaaacgtaagtgaagatatcttgaaggttttattaatttggcttatccagtttcatggttccgtggtgcttgctgtctgattatcgtgcaaacaagaatgttgggtatcaaccaatgagtatgcatggtattgttagaatagtttaagtagttgatggccatagtgagggagggaggggaaaacaaaggactgggggcatttgatatgagaggatacgatatgcagttgcttccttaatcatcctgatatgtctccacctgtatctgtgtgcaacctttacaaactaattgccgctatccgtgacttaagctatatgcatgacataatggaaattaaagacaaagtaacttatcaaccaacatgttaaaatagccaagtgagatattctcatgctggtaagttgtaattgtataaataccatggtagctttgtatgcactagagtttttgttcaatttaaatgcgtgtcctttctaatctggcatcaattttgtgaactgtattcaggtctcgtcttggctgtcaagtgatagcaaagccagaacttgatggcatgcgactggcattaccagcagctacacgaaactttgcggtggatggctttgtaccaaaaccacactaaaagactgataactgagactgagaagtgagaacacaggttcttacacagcatcatcaattttgtagcccaacacttgtaacttaaacaacagcctttggtgttatgaggcttttgtgttccagagaggatttgttcattgttgagctcctcggttagttacggaaattattatttcatcagtgccacactaccaccgggtgaataaaatgcttcttctgcatgtttattggcttatatggtgcatcagcctttaatcttgacaaaaaagtgttgacattgtactggggccagctcttttaggccatctacaatgcgtagctcagcgagtggctttggctcacggcgtccagctcccgttcgcttgggcgcttttccgcccaagccgtcccccagtagaggcgcgcgtcttcttgcaagggacgcggctctacgagctcctcggctgggggaccgagcgaggagtcgcgttgggtcggctgtggctaggggaggagcatgtggaaaccgctctctcccccggtttttccccttctaccctcactagccaccggaggaaaatagataggcggcgatgagagagcgagggagtcgccgtcattactagtaacttctaactacacccatattatagtcaagtgcagtacttaaaaaaagatcagcgaaatacctacacaagcttagccctaactttggcggcgatggcaagtgaataggagcgcgaagaggaatttttgtgaagatgaagcggtggacaagacgatacacagtatcgtgttgttttttaggaatctttaagcttttttttgggctgaagtccattaaacatttactgaccttccacgggtttttagggactcaagtatatttgtctttgcagtatgcacgtggaaagtatccaataccttgaaaattctcttttcttgctgttacacaaccttttatttagaagagttggtacaatgtgatttaaataggtggtgaacagtgagctttatagtttacactttaactttttttacattaaagataagcactgtttagcgtatgttaaacaaatgcaatcagccaactgctgcgtcattgtttttatttaacaaaaaccacatatgtgtgcaactttttaagaccaatatctttggctttatgatgttcatgatatttcttcttggttgttaatagggagttggtaaatccattttgagtattattaattcatatttgacaccatgtttgccaataattgtttaataaaaccactcgactggttgatttatctactctctgagtatttatttagttatattcaactaattacatagtcagggctatacataattatgtgtataaaaaaattcttcatcagttttaattttttttcagccctccacaacctcatatttgggtttgaaagtattcaagagactatggaagagatattaaagagaacgaggaaagagggcgaggaaaaagaaaaggagattagggtggctgacatatgaagattaggatgactgaacatgtggccgtgtgagattaattttttttatatatttatcattgacatgtgggtcttatgagcggcacataggttgaaaccgtttttgaaaccaccgaataggttgatttacaccggtttttaaatatgaggaatgtattatactcggttttacgattgaaaggtgatttacacaggcaagagatggaggagggagataaaatagacttgttcctttcaaaaagtagcccaacatcttcattctctctcctaaaaacgaaacaaagggtacacacgaaaaaaaacaaaaaagtctcctcgtcgttgtcgtcctccttccgcggcacgattcgccggcgggaggcgggcgcgaactggaatcactgtagcagctaggctaggctagaagaggcgaggcgagtggtaaatgcttgcctatctaggccacgcaaccctaatctcaaatccgcccttccgccgcaattcgaattccaattcgaattcgatcccccacccctcccctcctcgaatctagggtttcacctcccctcccctccgctccgctcgccggagccccaccatggaccccggccgaggcggacgccggagggccggcttcgagcgcgcctgccgcctgcccaacaccgtccactccgagatcgcctccgcgctcccgctccccacgctcccgctcaacctcggcgccggcctcctcgacgacgacgaccccctcgccgaccccgaccgccccgacatgatcatgcaggccgccaacatcgcccgcatcctcgccgacaccgacgtctcccacctgtgagtacccaatccccccccttcccttcacttctccgcacgcctccacgctgctcatttcgctcgtgccatgctgcaggggcttcacggaggcggacaacgtcgagacggaccccagccagtgctcctggctctggagggaggtgctcaagcataaccccgacgccttcaccatcaaaccccgccctctcccgccttcccaaggtaaacgctctgcaaattgagccttcccctaggacctcagcctccaattgctccattctgccttgtaccatcgaattcaaaatggactggatagttacttacttctctggacttagatttttcttctacatgtacttattactgtgtgctaagcttctgttctagctttgccagcttcaaaatgcctgtatgaacagtagtattcacagtgactgccttggactaaacattccctgtgttgctgtctcgtgctatcatttagcaccgtgttgctgtgaaccttttagtacagttgcattgcatctcgtttgttaatggtgtgctgcatgttggatgagttgctgctctgctcaaggttaaatttgctttcaagtttcaacgatcgcagttccatgccacgaaaactgaatttcgtccattgttattctgagggcttttacaatgcttcagaggtactggaggtaccttcttctgtgttgaatatctacccttgatttaaaaaggtaacttagaaatagaaaacacatagacatgggcagttttgtaattgttctttgccaacaaacttctctccttgacggtcacccatttagttgctccatggtgatcagctcttggttcgctatttttcatcaatacctgtgcacagattcctgtaactaaattcaaaagtaatattctctacccttctaccccttcgtatgatctgtaaagacaagagacatggacctggcgatcctccttttcagaatatttcaccaatacgtgttgtgaaagttgattacttggttctagtcttctagtacataattgcttggttcccttcttggtcatgcttagttacatgaatatgcttttattatttacagagccccatgcaagattactaaatacagttttgttactaaatacagttttggcctacttaatcgtgcttggttctcctttatctattttcaagcaacagtaccgagtttattcccatgttttttttaatcgactgccgccttctaatttgatataaatatacaatcacgtatctaaccctccacctttttttttaacttaatacctgccccacatttttaataccttaccatagctacctttccttgtggatcattcgattacaagcgatgaacggatgtagcgcctccaaagcatcctaggtctcttctatttttcatgtggaaagcacttcagtgttctcttcttggttatctatgttgtacatctctgaatttagtttacaacaaacatatcatttttaaatacttctgtcagtcggtctacactttacaatgtaacctcccatgtgggctaagtttccttgtgatgttgtgctaaacttgtgtctacctgtcgaagctatgtgcctgccagtgagtgatgcatacaacagggttgctgctgcctatgtctttgggtccagatatgtctgcattgtagtgccccaaatagctctgttctgtgaatggccaaaggcattaacagtcagatgagacacggctttgaatacatatataacgacatgcagctgaacatacatgtacggtttggttcatgattgtatagggcgtaacacctttgggccccctaattttgcctaagcccgatggcttattgtggtttgtccattagagaactgctaaacttcgtatctttacttatggtatttgtatgtttatgagggctttccatttgtgatttcacgctgattctgtttaggccttggtaggtttagtttgcacaaggttcaagcttattttcctaaatagttatgctagaaatggatgattctctactatcttcaggccccttcattattgtctctttcatgtgcaaacctcgcagtattgtcatcctgcagtccaccattgcacagatccacgttccattaacggtgcctctgttactattcttacactacagagaatattgtcatcagaaaatttcacccaattgtattgccacctttttagtgagctgttttcagttgttgttgggtggtacttaatctttcattctacatgtatgctctgctatttctttctaccaatggaaatatttcataccaatgaatttgggctacaaagatgatgtaatctttgttaggttctatattttacattctaggcacataaataactaccttatctccccgcttttgccggtcgagtcacagtctttatctttggatgcttgtatggtggtactcttggcgcaacctaataggatagtttttcgtacggaactatgggtatcccttttgatccctctagctggtcctattccgattcattcacccagcgatcagtaatttggcaatgctatgccatatcttatcaatagtatcccaagtagatggcaagatgcaaatagaggaaccaattaaagatgtattggagtaacaggatcaaacgagaacacaatgaaagtagagaggcttaaattgttaggtaccctgaacttagtaaattctatttaaaaaccactctgttccttctcttagttcgcccacatatgtaaagtatactgcattggggaccgtatgaaatttttaattttaatctgaaactgagaattggctgtaatgagtcagatagttgtgggaaataagacaagatccacttggtagctgcagggactgtatatggaaggatagaattgttgacttttatttgagcagcactaaagaatgattctcaattatttgggtaacaattaaatataacctaaataataccggagtccctgttttcttaagaattaagaatttcaatgatactcaatattctaataagatgaacccaagaatcacagcggtgagagcatgtacttttgtacctcctgctctgagtcgatctctggaagtagtgggcgaaaaaagtccttttgtaaaaatgggtaaaagcgtttgtttggattctgtttttgctgtttacacctcctgaaattcctgcattccaaagaagtccttggccttgttttttgttaataacatgagtgttacatggctctatagaagttgataaatttgctgctgtactagcgctgtaacgtgcgaaagggcttgcagcctagcggttatagtgctcaagtagcatctctaggtcctgggttcgactccccatgggagcgaatttcaggccttgcttaaaaaaggtcactcgttggccctttgtaaaaacacgtgttaagaatcgacctatggagggcggaccctcgtgtaggaggtaggggtcttgaagcacgggttaaggactgtttttacgcgttaagaatcgatctacggagggcggaccctcgtgtaggaggtaggggccttgaagcacgggttaatgactgatccatagggagcgagatcgcatgtgggggatcagggttcgtggcctttcttggccggtttggttgaggcttcttcttaatgaaaagtcgtgggggtggtctttcccccaccagtcgagtttttttagtgctgtaatgttcttttctttttctgcacctccatgtatatgtaatgctattaataacttaccgtcaacatggaaaatgctaagataagaatttgtcatatttcctttttctcattttggctgcttttgtccttgcaatatagtgaaatattgtccttccaatatagtcaacatggaaaatgaattgatagcagtgctaattctacactgaaataacactatcaatatagtgtttgtttttgctcgacaaacacaattcactatgtggcttaccattcaattatagttcaataatctgcattttttggagttgtgaatgttttggactgtgttactctatcaagctttattgtgcatcatatctaacttttagttacattggtcaagtttttcagatccccttgaaggccaagaaaatcaaaatcaggagcatgagaagcattttgcgcatgttgcgccaaactttaatagcatgcgaaaggaccatggatttcctcgggatgaccctatcccacatagcgagcatcttaatgtatgcagtatgctagataccatttgtttcttactataaatgtgcatagttcagcctaattactttgtctttgtgctatgctattttctgttgtagaatgatctaacacaagatccagttgcttcaaagaagccaaaagttaggaagaaagaaatccataattctgcttcaagttctgaccctagcattcctaatagtcaaggtttactcttgttatctctatatctttctccatctgccttcatttttgttctcaaacactcagtggattcctgtttgaattattttttgtagaagttatcgccaacttctgtgagatggtagaagatttctgtggaagagtagaaattcctgatgatgcagatggtgatgagtggctatcaattccactgaatgatgctaaagttcttgtaaatgaaatcacatttgttcggtcaaaaaagattttgcatgagattccgatggatacacttacaaggctattacatgtgatagaccgtcagatccggtgttctcaaggtttatcaatagacgtgaaggaaaatgtcagcgttgggctgcagg

SEQ ID NO: 66710 - DNA, 42780 bp, Oryza sativa
ctatagctgtagcgcgtttctcgttaaaagcatgtactactagtatcacaaattacaggcccggtagatcctactactaggagttaatagttcctagaggtgcgaggtgtgtcctagatagatatccgatcgaacatccaataatcatccatgtcagcaggaactctcaacctatgaaatgaaggggaaaaaaaagaaacagaagagggaaaatatatatatggtcactggatgctgctacttttatacaccagaagaaagaaaaggagggtgaatatgtataccagacataaggaggaggagttggttctcctagcgagcgttgacggactggcatgagtcatctagttatctgcgccacaaaaggctgcagcagccagcgaaaaggaattgcctctgctgctgctcctgaatcgcgtgaaatcatgggggtcgcccgctcgtctcgtccgtctcatcgctccccctcctgtactgacagacacgacgagattcctctcctctcctctgctccccttctcttccttccatcatcgatccgccgcagggaggagggatcaggcgacgaccaccaaaaacccacaccgatccgatgagagagagagagagagttgggaggccagatccgatctccccattagtaacttatccctggaaagaagaagagagggaggggcacgcgaaattccatccctgcccctctcccttatctgactcactccttcccttcgctcgctattcacggactcatcgtacgctcggctggagtactttattagggctggctgtgttttcccaactaatctcttttttttccatcatcacgttttttataaacttctaaacggtattttctttcataaaatttatatatataaattatttagaaaattaatattgatctattttttaaataaaatatagctaatacctaattaattaaatgctaattgatagctttgttttacatgcactgtaaatttaatttcggaaccgcaatgaacaaacacagcctagttgaggctgccttcgcaaatctatcgatttattagatatataattacgttgacaatatttacataaattaattcgtttatattttttttatgaaatttaaaatttttaatgttaactcactgttatttaacatacatcctttcaaatatatcttacatctaatatctatagctctgtcaaacataatttttatttttattgaattccgatgagaccccttggtgccaaatttaaagccccatagttattgattgttttgtgcattcttatccttatataagtggaaattcaaacttttaaaacatgattttatgaattttttttctcatcatagtttattttataatattgtctttttatcactaacaacacgaatatataaaaggaggcaattttgcatctaaccctattttgcacaccacctaccaatttgaccccttctatgaacttcgttcgtttgatccttgttttaataataactaaagatatagtttggacttattatgttaaggtaatttgacactattttctcaaatcttttaaattagtttgacctaaagattattttttgtcaaaaatttcggtttgacagatgtttgacaaatttaatatagactagaaaaaatacccgtgcgttgcaacgggtaaagacgttatttctataatatattaagagctgagcaataaattgaaatattgtatcgctatacattataattgaaaaggttaatgaaaattctaatattgggatcgctatatattataattaaaaaggttaataaaaatctttcttgggttttgagccgaaagccttcattacttttcagcccaaggccagtccgctacctccctttatttggcctgcttgcttcaacccagccacgagtgaagccgttttcagccctaggccggtccgctacctccctccgtttggcttgcttccttcgacccatcaaatccggctgaatctttctcgatcacccaaaaatggttaagggtttttgatccacttacctcttttcgttttacccaaaatcaaagcgtaaaactcgagataaaaacaatgggggaagatcgtcgtcatcatcggcaacagttagattaaatccgcaaaataaagctaggaaaatcatggagaaaataatgaggaaggagtgggaatcgatttttttttcaatcaaattggagtgaaaacgcacaatcgatatggcgccggcacagcgcaagggttcaactcggtagacgtgccgcaaatagattggataaaaaacagacgagaaaaaccaaaagcgcacgggataaaaaaacaggtgacaaaaaaaccagaagtgctcgggagacacgcggtgaacaaatcggatttaaaaaaccggaaaaaaaaccgatagcacgtgcatagaaaaaactctttctcgtgaaaaaaaagcaaacggactttttttttgtttttcactggcgagacttttcttttccttttttactgtagtcggacgatttttttttctttttttactggtgacgacataagctttttttttctttgttgagtcggaattttttttaccttttgagtcggactttttttttcttttttacctactatatggaaatttcttattatttttaagtggagatagagatacagagattaaaccaaaacataaaattaaaaccgattgaaacacggatgacgtatcaaataccggcaaaaacatcttcaatttttataatagtagagatagagatttgacaaaagtgtgagtaaactataacaaattcttttgacagcatccaccaaaaaatgcatatatcgaatcaaaaagcatacgtacatatatattttagatcaaaaggctatcgcccagctttactgaaagcataagaagtctgtgtacagaaataaggctggggattccagcttacatatcaagttcttagccaacgacaccggcaacaaagctgctgactcagcacaaacataccatacaaaaagcaaaagaattaccataggatgacacataggataaaagagttttgaaggcactctcttcacagtgcaagcaccactagtgggacccacaaatatcttcaccaaatccccaactgcttctcctccctcctcactcatcacgccaccaaatccccaaatccggcgtcagctcaaccctcctccatcgcccattcccccgccgcctccgcccctgccgctggctatcccctcctcccttcgccggctcctcttctccctccgccggcgtcggccggctctcatcttctccgggccgagcggtggcgtcgtcctccgggccgagcggcggcggcgacgtcctccgggccgagcggcggcggcgctatcctccggaccgtgcagcggcgtcgtcctcaaggctgagctgcggcagcgtcctcgaagaagcggcggagcgacctggccaaggcggtggagctcggcatcaacgggctcgactcgcgtggcagcggagctcggcgtcgacctgtccaaggcgacggccgggagaaggaggaggtgggggagtagatctggccggcggctcgttctcggcgttctctccttggcggccgcggagcccgctctctcctcggcgcgctcgtcctcggcgttcttggcggcggctcaagaacgggcggcgcggttgtcctcggcgttctaggcggcggctcaagaacgggcggcgcggtcgacggtgccgcctcgcctcgccgtcggccgagcgcgcaccggcgagcctttcccctccctctctgtccgccgccccacccctctccctcccctattccatcctgccgccgctgccgcatccatccagccgccgccgccatttttgtttcatgggagccggcgccacagtgcaagggagagggcacggggcggcgaaggcacgctgcccacagtgcgcatgcctcgcgatttcagcgtcgcccttgacgaagtttcacgtcgctatgtttggtcacgagtttctctgtttggtcccgggtcttagcgccacgtcgacgaaaatcctacatagcacaacaaggttctgcttcacgtcctcgcactgtgaagggcctaagagctaccaaggcttttactagttactgccctctatccggcagatcagctgcttcttcctacttcttggatgctggcatgcagtgagaccctcaaagcctccagctctcccctcagcttcaatggaaccaggtttttccactgtaagaaaaatgacaatgctttataaggcacatacgtacatatatatagtacaagcttaccaagtaaattataatgttcgcatctattttttatgtatctttaacgatgatacaacagtgatattaaacatacgtaatggccacgctactactgtctaacagcataacgtcatgtcagccttcacacataagcacacgcatacatacgtccaacaagcaagtaccagcgagcattctcccaaaagtttttcttcttagaggtggggtaattgtcacgcccagaaattcccgaatagaattccaaacagaatgtgcattaaaatccccgtccaggaccggccggggtacacaagcgacaaagttgacatatagatccacgtcttacaaacattataaaagtcttacataaatgcagcggaaaacttaaaggataactggagctaagccttgacttggactgcagcgggaacaccactccacaggcatcctcgacagcacggacgaagcctactcctcggagaaaccatcatctgacgcatactcaaattctggggtttggggaaaatagagcaagactgcgtactacccactgtactcagtaagtcataccggaataggggtatgatgcaggaaattatcaagggatagctataatggttcatttgcataaagcggacgattataaacagaagttgaaagcagtaaaatagttgtaataattaatcaatattaatcatccactgtccaacgctataccacgttgtaacaggcccaaccatccacctatactagtcaattccattagactggtctagggtgagtataatcacggtgaatctagttgaccgcccataaccgcgggcacggctattcgaatagttttactctaatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcaatcccctctcgtgcctaggtgaatccggaagccgcataggccgtcgcagggtccatccaaactccatcacgcccacccttacctggatgcgtcggctagaggaaagctatattacaagcccagccgttgcccacgctggcttgtggaaagtacgaggaattcttccagtgtttcccacgaaccgttccttaattgccatgggtgcgaccatcaaaaccatgcacccacggcccaccatttaatattaattaattaaccaacaccggagcggtgagcattaaccaacaacaatcctagaatttgatatctatgcattaatgtagttccccattgtgtgctagttgaactaagcaaagctaagcattccctagtccaatctctagtcatgttatatcccaagctaacaaaggaacatgttaccagatagcatggctatgacagtaggtaaacatcccatagtgatattgtaaaacaatgtagtatttgaaggaaaacaatggagcatttgcaatataggatcaacatgttcaagtgacaagcatgacttgccttgctctgcagctggaggaatttcggcgacaatttcaaggtacaccggagcgtcgggagagccggaatctaagcgacaaacaaagcaaacaatacaaacatgctataagactactgaaacagagaacaaaatcatttttaatggattctacacattttccttgatttactgagacttgaatgggcttaaacggagctcggatgaatcagttatgaattttagaagattcactgtgtttttactataaacggaaaaatccttaattgatttattgcgcaataaataaatcccggggagagagagagggcggcgccgacatgcgggccccacatggcagtgactcgagagggcggtccacggcggaccgggtccacggaccggggaaaaccggcgtaccacgtggtgcacacgtggcaccgacgcggcgtacacgcggcggcaacgcggcggccgaaccgacggccccggtagatcggacggcgggggtggctcgcggccggcgcgcgcgggcacggctcaagccggcccggcggccatggcgcgcggtggcgcggcgcgcatgtggcggcggcgcgagatggcgaccggcggcggagagaggcggcgtcgcggcggctaagcggcaacgcggtggctagcggcgcgggagagagagagggagggggaaggggaggcctcaccgacggcgaccgacgacggggagcaatggagggcggcggcgacggcaggacgatctccggaaccacctagcgaacaccgtggaaggggttagtgagggagagggaattggaagagggtgaggacaccggccgaaggcggcggccatggcggtgctcaccggcgaacggcacggagtaggttccggcggcggacggggtggcccgtacgatggcgaatgcggcggcgtcgtcggcgcggatctgcgcggcggctagcggcgaccggagcggtggcggcggcggcgaagaggagggcgacggcgctagggcgttagagggcacgggagggctcggcgagatggggaaaaagagagaggggtggcggtgacgcttaaatagaggaggggaagctcggacgtggtcggtagaggcgggaatcgccggccgacgcgggggagtgggggaggagagagaggcgggattcgaatttcgaatcccggccatctcgggcgcgggcgcgggcgagagggagggggagtgggtgcgggggatgcggcgcatgcgcgggcgtggccgacgtggcccggaggaggcgggaaacgtgggcgcggcggtggttgcggggcgcggcggcgccggctagaggaaggggacgggcccgacaggtgggccccacctgtcggcgaccccgggagagagaggagggaggcggctggctcggctaggcctcggcctgtcggccggcccagcgggaagggggggggaaaggagaatgggccggcggcccaattgaaggaaaaagagaaaagaaaaaggaaaaagaaggaaaatagattttcctgggattaaatattgcttgtgctcaattttaattggttaaaattatttctagagctctgaaaattccactaaaaatcttgttagaatatttcgacatgtagaactcaagaaaaattccacatgctaaatccgattattatttgcattaatttattagggttttctcttgcttttacaccgatattttctctggtggattataaattcaatttaggcttgggaaagaacttcagggtgtgacagtaatcctggttagaggcggggcttgcccgggtttaagtttgcttgagaccggctcaccattcttcatgtcgatgtaattaaaactttatttcccccaattttaatgaaattgaccggtcaatctttggccgtcccgacaaaaaaaaaagaaattattttgttaaatcctcattcccttttactcctgaagcagactatgccggcctgctgttaatctcatcactctctccatcagctgcattttctataatccttctcagacaatctatttccgactgttgtagcttgtgataatcttttataaaaagagaagaggaaaaagaagaagaagaaaattgacctgctcgggttgcatatcctcttcttttttcttgagatggttgggttaatgaaagtgtaactggtgcaggtatataacatgtttgcgtggtgctgctgaaattcgtttgcgtttgcatggtagaacacacctttacccttcaaatttcaagtaaagttgtgcgaaccttgattgacccttgtgtgctgtacagtcatgttgttagtactggtatggtatctttgttttcagttcatatatcttcgttgttttctacgaaatttcaataaagtttgtgtgaaaattctctatgctacatacaggttcttgcattcacatattccagattttgctctctaaggcctcgtctgagatagctgaaattgataggttgatggataatgtgatttttgtgatagccatttgacttttaaagtagtactagtagcttggaaaacatacaaacaagaaatcaaggttgtgttagttcacactaaaattgaaagtttggttgaaattggaacgatatgatgaaaaagttggaagtttatgtgtgtaggaaagttttgatgtgataaaaaagtggaagtttgaagaaaaagtttggaactaaacaatgccttagttcacaccaaaattggaagtttagttaaaatcggaatgatgtgatgaaaagttgaaagttaatgttgtagaaaaacttcgatgtgatggaaaagttgaaagtttgaataattattttggaccaaaacacggtccaaataagagaagataatccctccggagcgtcgaagagtctaatctcctgatggtgtacggcggctacggcctggaaaccagaacacaagcacgactggaaaactttcgacttcggggtaacgtggctcatctggaaattaagaatgcaatgctcaaatcttagacggaagagcagagcaatttatgacggtgtttacatgcaggtgtgtaaaattttgacgtgtcatatcgagtattatataggatgttgcatagggtatttggacactaataaaaaaataattacataatccgtcagtaaaccatgagacaaatttattaagcctaattaatctgtcattagcaaatatttaatgtagcaccaccagggtttcaaaaaccgccgggggcccggttaccgtcacccggcggtacggcggttaccggcggtaaccgcggtaaccgcgcaaaaccgcgacaaatttacaaatcgaaatttgaattcaaaaattcgggcaaaccgcgcggtttggcgcggttaccgcgcggtttgacgcggtaaccacgcggtttggcgcggttaccgcgcgatgtgtaatgggttgcacagtaacgggccggcccattttttttttctttttccaattttcaaatttattctccgttttgctctcaaatttgaataaatattactcttttttgagaaatttcttcaccataaaacactataaatcaagcactaccttcactattttttttgatttttttcttttttttttaaatttttgaatttggacgaattttattaaaccgtaccgcgcggtacgggtaaccgtacccccgcggtacgggcggtaaccgcggtaaccgcgcggttaccggcggtttttcacacctgagcaccacattgtcaaatcatgaagcgattaagcttaaaagattcatctcgcaaattagttgcaatctgtaccataattattttttagcctatatttaatatttcatgcagatatttaaacgtttgatgtgacatggtaaaaaattgtaaggtgggatgtaaacaggcccagtgcaggagtggaaaacttggaaggctgcggggttagcaagcaaccctacgattagtagcggttttggtgtgtggcaaaccagtggcctggttcggtgtgagagccttggctctgcttgtactacaatacaattttttgaaccctctccttttcaatatatacttcggccggctacgccggtccggcgaaatatttatcaacattggccgtgtttatatccaaactttcaacttttttcatcacatcaatctgtcatatacacacaatttttcagtcacatcgtaccaatttcaacccaaacttttaactttggaagaaactaaacacagccaccgtgaaacttgcatagcacaatgctttcccatagaaaagattcggttctatctctcttactttttttccctgttatttaagtttcactgctaagcaatatgcatatttcactgatgtcttagttgatttcagctgtttgtaatttgcaattggatataaggttaattgctctactattttgtattacgaaaacttgaggaaggcttgcatatattttcagttccggttccatctcgaatagatactttatcgaatgcctagcattaacatttgtggcgttgagatgttataacttaacactaaaattccggtttgtatttacataaattttttgacattgtttattgttcaagtaagtttttcataagagtcaaattgtcaaaatttcggtcgtttgagacgctgcccatactccgcattctccttccctgaagaattgcagatacacaaggctcccattttaccttttctttttttttaaaaaaataacaagaaccacgcataaaaatttaggaaccgcaactggttaaaagatcagtgcactgcacatttataaacagcaaacaatgagaagattaacaaaatcagcggcgcatgaatagcccatagaacgagcgctctgaccagtacgaaaacgtggagggggaaaaaacgaagccattaaattaaacagaaccaagatcgcgcatgaccactactgataacataacaaaatgtagtagaagacgagcaccatacatcccctcagtgtcacatgcatatactgagaacacaattcaaatatatgttaatatgttacacaccacggttaggacaaaaggatattaagtgcaatggctgttatgtcagcaataacaagtcatcacaaacacacgatgagagctgataacaggagaacaagtgcttcctttcccgaatcgtttgcatgcatacttacgcactcccatctattttagcactcaaagtcccaactgcactggacgcaataaatatcgctgcaacattaccgccccacattagcttatctcgaaactccccattgggcaccccccaagaagttaacagcctgtgtatatgcatgcacatatatgaagctgaatccagggtgaaaaaaaaaagaataacaaacttgaacttgtaagctaccacatacctgttgagataatttctatcttcgctcttcagtttcctcacttcctccacatcttcaacaatctccctttgtgccatcgcctcaaattcatcaaatcgcctgatacttttgacctgattatcattcattaccttgaacatcaattgtgacaagattgatcaagaaacgagtcctattgttagagagagaagaattcatagacttcaatatcaatagttttcaggatgtcttcccaatgttaagagaataaaatgaacatttgcatactgcagggtaaggttagaagttagaaccagagcgggccagtgctgtgcagtggtttgcaatttagtgagttgagtaatcattactaatgcaagctatatttttctgttagtaactcttcaaaatgattgtattctctgcatatgctttctttttttacaaatataatctaacatgaatcacacacacccacatttctttaactatatgcaattatttttttaggcatacaaatttgagactggtgcatacatgggttatttgcattcttaacatgtactgcagaagattgacatttcctaacttcaatctatgttggcaacttggcatcaacaaggaagcaaaaatcacatcgttcctagaacatatcctctctaagctttgaatggaagcctatctagcactccaaacatatcctctcgaatttgcaatatctttgatataacatcctaaagtggattttgcaaggtggttttacccatgcaatatatgtggaacatacacaccaaactctctcctatgtatcaatctctctctctctttcaccaacaaaccaagcactggaacaatgccaacataccatcacagttggtcaaaataaagagtgaggattgatgaagtatcaaagtatcgttgtagtttgccaaaactgcctgtttaagcttcccataggcaaaaccaccatggaaaatcacattctatggggttatatgggttaaactgtaaactttttccgtgtgcacattttttttgggtgtgtacgtgttctggggggtggagtgggggatctgaagctggtgttgaagttccagttggtggattggacttctgttcaaagtttaggaggtggaccatttattctaaccaaacagcattatattcatgtggccatctttttctcccttttctgttgagaaagatactcccttttatttaataagtaataacacaaggttgaactacatagaaagattctcccttttatttaataagtaataacacaaggttgaactacataaatacaagaaaaaatcacatgggagtcagagcatcattttaagaactagtataacctaccagcgatagaaaatacaaagcacatttatcttgctgaagtggccaaaacatcatttactgatagcccacctaacaaagacacgatacccataggtagcggtgtacgatacctaggtaccatgctgagtcagcaacataaactgcacgattcaacactatggcgctttatagtctttatgtaacaaaataatgcctttgctagtacatttgacagtctttgataatgtacatccctgacttgttacccgagtaaaaactaatgtgtgattgtgatagaaccaggacaaaatatacgaaaacaaaattagaacgagaaagcttgtaagttgtaacatataccaacgtaacttgtatcatacatatgcggaacgataaaaagaaaagtaaattttgctgtatatatgttctagatcataattattatgtctggtaggataggatttagatggtaagtaaattacctgtattatattatatgactggattgttatcatttcacagaaacagcgctccaagtaggaaacataaataagtgattacaatagcgaggtcagtgaccttgagttcgctcaggctccctcacctaaggggattgtggtgcggaattgatccgctccaatcctgtcccttcctcatagggattagatgaacaagtaacagggagagagatggatggatttaaattggcgtgcgtctcttaaccgcacgaatgcgccatcctccctccctcaaagtatttgtatgcagatagatttttttaataacttttgatttgtaactgttgtataattgtgtaagaaacgaagggggcaaaaaaaaaaaagggggggggaacgggaggaggatggaaacggattaggtggtacctctcccggggaggaagatgaggaggataatctgctgctgcacaaagagcgggtgcggtgggggagaagcctctgcagggcgggccgaagcaacaaaggcgcggacatcgcgggcaccgtgttctgactctgagctagggtttcctcttcctccctctcgattcgattcgatgcgagttgtagaggcttaggctgctggaataaaataaaaagaaaatcagaagatgatgggccgggcctacccagacagagttaaagcccaaatccatcgccacctcttgtctctcaagagaaacggctccaagttcttttcctttttctacttactattattattatataatatatataaataatcctcacctacccgacaatctctctcccaccccacccctttctcgtttcgttggaagaagaagaagaagaagaagaaggtggtttcgctggaagaagaagaaggtgaaaccctagatctgatctcggatgacggcgcgatcgttgttggccggtaggatggtggcggcggctcgccgcgccttccgcagctggcccctccacacaatcacaaccaccaccaccaccgacgccgccactgccatcgccaccaaggaacagcacaaggtatgcaggagccttgattgaccacctgcctatctttgttcatgttgggttgattgatccgcatccatatccgctcgcgcgagcccttcttttgatttcgattctgtatctcgtaatttggtcgatgcgtaggtggtcagtcgtcttgatgtgatggaggatataagctttccctacatgacacgcgagatggccgccgtactgcggcggagccgtgttgcggctgtcgaacacaacaattttaacatcaggcagcttgctaatccttaccatgggtatgttggcttctttcctctctctctctctctctctctctcttatatatataactggagtatctcggacgcaacagcacaatcagtttatgcatattgatctaacctgtctcaatttgcattgttcgtaggccggctgatggagatatcctgtatgacagggcatggattaacaatcttgctctgctttttactctctccacgttatttggggcgtttagtactctagccaagctaaagcagacacggacagtggaccaatgtgtccagacccaaactagttaaagcaaccactgaggttgtatggattccagtcccaaacttgttaaatcaaccgctgacgttgtattggatatcatactctgtatgtcgtaatacttaatttcatatgctattgtcataacttgagaattacttcctatatgttagctttatatgtttctggatgttctgttgtgtctgcccccaaaatacaacttgctcagttaagatttctcatgctactttttgatgatttgttcaccatgtcgttaacatggcagcagtattaggtttaggcacatctttcttttgttattacttattgcactggaatatcatcaagctagaatgtggactacctactagcatagcaagttacagtagtgtattatagtaatgatattgagcttggatttggcatatgttgtgcctacacgactcttttacatgaatcagagtagagtgtgtggcttcgaaagctgcctcctttggtccatcatgcctgctcccgtaacttgctttaaaaatgcataggaagttataacctactactgggagtagctactcccaccctagtagatgttctcctcactttctaattgatattctgctatataactagttgattttctgctccatttctagttgaataattttctgcacattttcagttggtagattgctcgtttcatgtcatatatatactgctttttttctgccctatattctgctccttgtcaagatgatttaccgatcctcttcaagtgaatgtatattccgctcattttcatgttcatattctgtttctttccaactgattattttctgctcccaacgaacatgaaaccatgccgaggataatcatcatctgatctcttttaacaaatcccataatgggttttgggaatagcgtggctccaagcaaaggaattaagagacgcagaatcagctgtagcaagtccaactagcatatggaagtcctcgtggacagataggcagtaacgcagtacaaacattttgtgccttatctttgtgtttaactgatccatctggctaacgaacttctttgtacaggaatctgctatgtattcttagctgcgtgcagcaaaattatctagcaaaatgcaatcaatagcacaacaacagggcaatgaataaaactccctactcacctgagtacctcacaatgtctaagtgtccctttaaaaggcactagcaatcgtgcacatgcaatgcacattttcagccatatacatacatacatacatacatacatatatatatatatatatatatatatatatatatatatcataagatataaataatcacattaaaaaatataatttttatcgagcaactttatgatgctttaaaaaatgcataggaagttaaatcaatgtgcttcatcaacaggtgatctagtaacgatgcacagataccagttaaatagcatgtcctttattttaagatagctaaacatgtactttctctttctccgtttcacaatgtaagttattctagcatttttcatatttatattaatattaatgaatctaaatagaaatatatgtctagattcattaacatcaatatgaatgtgagaaatgctagaatgacttacattatgaaacggagggagtaccaaaattttgcaaatcaacataatctaaggaggctacactataaagaagcttgtaatcatgctaaagaaaagagagtcaatattgataatttgttttgttagaatgtattatcaaatttatattgaaccttacatatgaataaacatatctctgaacttctataaattacacatgtttatttacatggtgaatcattataatctaatacaaccacaacaaaattcctaaatgaatttcatggttatccactttcgataccatttgaagatctggctttacattcagactacctttacccgattacttgcatattttgaattcgagctctccattgatattttaccttgactaaatccgttggttggttttgatgaaaaaaatgattccaacttgcatatgcagctgtaacagttaatcttcaaagttcacaacgaaaatatgtgtaatattgaaagcaccttataggaaggaaacatgtatagaatgaatcaaattctaaagtaattaaacaggtgcaatcttttaacagtgtaatgcccatattttttattgagagggatggaccagtgaaccatcatctctgctagtagaaagtaaattccatgcataattctcaaagaatcagattaaaaacatttagtagcattatctgaaagctaaagaataatttcttttagtgcaacaaatgattatctctacattacattttaatcaaatttggaaaaatataggtacctgaacaagtgtaagcctagaatttggaaaactatcatcagctttatgaaatttattccttcgtttttgttgcatagaggatggtggatggttgggtcagcacctgaaaggaggagcatagtactaccattcacctaaatcaagaccaaatttcaaaagtttgtccaacttatttggtagtgccacatgttttttttgtgggtactgttggtacaaaatccaactagcgtaatcaatgtgtattctgtattcgatcggctcgagatgagcgaagtttacatatttagagcaagttcaatagtatagccaactattagctccaattcatctatagtcaatctaatagctcattcatacaataattacatactatactattaatacgcggtcccacctgccatacacacattgcgtcttggagtccgtgctatagctggttacaaatctgtagcccgcttctcttctctctccttatttatcttattaaaatatgtttgtagctggcttatagcatgctattgtacctgctcttatacaaaggccattgaaaggggaagttacagtgctatcgagatgaactgagtgactgccatgcaggccagctcttgggtctcttcgtcatttccctggggaataagttcatctaaggttccttaactttacactgaatccgattttcgttcttgaaccccaaaaccagatacaacttgtcccttaactgtcaaaaccggtgcaaacaaggtccctcggtggtttggaaggcggttttggctaatgtggcgcttacgtggctggcttgactaggtcttcgtcccacgtggcattgacgtggcgcttacgtggcaattctatcccagaaaaataataaaaactgtgggcccacatgtcaattacacaaaaaataataattttaaaatggtggggcccacgtgggccccacatgtcagcctcactcctcccttcatccctctctcttctctctttgttcttcctcatcctcactcccctctctctcttcttcttcccggggagtgccggagcggacggggcgggtgggcggtggagcaggcgagcgaggcgggctgtccgagctccggcggtgggcaacggcgccagcgacgggagcctcgaccgggggagaggaggcgccgcggtagctggagccggggtggtcggcgcggcggcgggtgaggtggtggtaggcgcggcggcggagagaagctgctgctgcatctccagcatgatgcagactctgctttccggattgcttgctattggaagaattgaggagtcgatcgactactattggaagagttgagctagataacttatcactgacagttaagctatagctattttttttctccatatctgaattttcttttgttgacaaaaccattgctatgcggccaattcatagatcatcaggcacacgttcaattcacaacaagtacttttctttgcgaatccacaatccccgctacgaccggctgcctcgccatgccagtatatgccttggcgaccccttcccgggctggtcgggagaccggcagcgtggtggtcggcgccgccgcggggtcttgcgccggccacatccccgccctcagtaccgctgccaccgctgtcgaactccatatccttctcgagtatgacggcgatggcgccggagtggtcatcctcgtcgtcggagcccgcggtcgagcgctccgactcctgcggctactggtccagctgtcgcgtgagcagccacggtcaccaccacgaggccgcggaagacgacgacccgtcggagagggaaggcggcagcgagggcgccgcctcgccgaggtcgccggctgcagtcagtgtccgaagaagagagaggataatggaaagaagaggatgacatatggggcccatataggtcccaccatttttttattttgtatgtgaaactgatatgtaggtctcatggtttttattattttttcggatcgaattgacacgtaagcgctacgtcggtgccacgtcagttgaagacagagtcaaattagccacgtaggcgctacatcagccaaaaccgccatgtaaaccactaagggatctcatatgtactggttttgatagttgagggacccgttgtatctggttttgcggttcaagcatgaaaatcgaattcattaaccagttaagggaccacggatgaacttgttcctttccctggtgacaaggttgggctatgcccaccaaggaaactgggccggcgctgaggaaatttaattttaacttttctaggggaaaagaaaaaaaaagtgaagcagatggttttctcaacagaaaaaataccaatagaaaaacaagatggatggtttctagatagagacaaagaaaaaaaaagaaaaagggaaagatcgactgtgtatagatggaaacaaaagaaataaaaagagaggcacgagagaaattgaagagaggcatgagagaaactgggaaggaaaaaatagaggagatcaggaggcactggagagaatttgggaagaaaagaaaaggtaaagaaataaaaggggagaacgggaggtgctgatttttcacgggagaaggaggagattgggaggaactgattttttccaggggagtggagattgggagagcactaattttttttcttcaagaggaagggagttgcgcgcgtgaggaggggccgagggggaggagaggagttgcgccgtgcgttgggggaaggggcggacaggagcgcggggccagcatggaagggcgcacgcgcgggagaggataagggcacccacaatggttatctataagctctttacaagagatctatgtcagcatatttttctatttggaaggtattaaacgaatagagagagcaaagctatctactaacttagagatagtctatagagaaaaacgaggcaatgcatgagagagctatagataacaatgtagacatactattaaggtggtttactattaatcgagtcaggtgaatgggagggggagggtttgggcttgttagttgctaaaacacctatgataggtatggcctcaataaatgcatgtttaaaaaaataaaattgactgcattaaaagaccaaaagggcatgaaagacaccatgtatataactttctagtttattgttgtatacaacgtgcttaattatattcattctatgactaatttcatgttaatacactgtcaagaacatcggtttaaaaaaaactagtcctatttctaacaaaacaatttgaagaacaaacagaagctcctagcgtactgtgcttccaactggtgcttcttctgcttacgaccatcttctccacatgataccgcggcgacatatgtacggtcgttggatcactaagatgatgaaccagcaacttatcccttcctatctttagatcttgactaagaaaagaaaggaagctgtcacgctacttaatctgcaaaacgaattggtacccgtcagaatataagaatgaattgaaataaattacacacgaatcacgctggcaaccgccggtgacggcaccggtgaacctcgcgacgataagtggcggcgacgatgaacctcatggacgaccggcggtggcgatgacaaacctcatagcaaccaacagcgtgtaacgtcgtggcaacgaagctagcggatgaccggcgacggcgacgaaaccttgcagacaaccggtatagcagccgtggcgaccaacctcgcggacgaccggcggcgtcacggcatggcgaccaagctcgcagtagcagtagcacagcatcatccaccatccattttgctttagaattcgtgctatcaaaaaactgagtattaaacgaattagcgtcctattcctatccctattccctaatccgatctgcgtccggccatcgtcttcttcttcttactgtgggagtgcaggcctattcttgttgggccctcaacagaactcggcccagcaactaaaaattctcacagcctctttttttttcttcttttctggctcgaaaaatctttttatttttcttttcgtttctcgaagttaagaataggacgcagttcttctctcggctctcgctctcgtcgggagaaatttggaccggcaattctgttcccaaaaaaaaaaaatcgtacaattccgcagcctaaccctagtcgacgcgaacctccagccgccggaagatgctgcgaccagcggcggcggcggcgggcagggccatccggcgagccgcgtaccactccgacggcgcccctcctccccgcaagctccggggcccccgattcagccctctcaacaggcacaaccacgaggtacctcagatctatagccttgttcgtgcacccatctagagtttacccacccaaatttagtgtagaaagagagagtttttcatgtcttgttcaaagtacgaattagtcccaaatcctcctggctcagaaacccagtccctccttgtgtcatctgtttatcattgcacttgtttcctcctgctatcttcaaaaatatcactacctttttcctgtgcccccaaccttacacacacacaaaaacaacaactagggattcaagtatttagttactgcctcaatattcatgtgcaactttccaaagtattcggttcgccttcttctgggattactctatacggttgttatgttgcaatcaaaagcacactcctcttgggtaagagatggcactactgtcaaattccattatgccatagattgtccatgcttatttatgatgaatgaatttgtacaattgagttatataatttcataaggtttcaggcgttgtgatgtttttaaggtgtgtgttaagcatctgtcacttaatttgcactagaattctgactcttgctgttaccacagattaaaagcttgtcttttgttcaagcctccatctctaatttatttatctctataacttaaataccttatcttagaggttcaattaagaacgctctcacaagaaaaggaaaagctttcttgcgcacagtgcacttgtgccaaatgatgcatttaaagccttcatcttttgttcctccttcctatgttgttcaaagttagtttggtgaaaccctcgtggctcagaaaacaatccctgtgttgttcacagttacacctgtttttcctacaaacttgggaaatcttttttcaccttttcctttttttctttttacaaaaatatacttgtcctcccatattgtcagggtttaactactaccaattcccaaatattcggttcaagtgccaacatcaaacttcactcagttttaaattcggtatttctgatgctgctgcaatgttataactaataatatgccaattgaagctcaccccccttgatgaaaataaggcactgtcaagaaagaacggagcttgctttccttctattatggccctctgaatgcatgttccctagattatatatcattgtgtacacttacttatgataaatgagtttgtagggtcgtgtttccctaagattttggctgtgctcactgtgaagttgtaagaaatccagtagttcttgtgtgcttatgtagtagcatctgaacatcttactctaaatttttcaattttaagttgttcttctacagttatacaaatattgttagcttgtttattgcgcaagcattcatatacaatgtttttccttgtcatagtggttgaattaagaatctttaacatcttaaagaaaggctatgtcgggcgcagcacacttgtttaaaaatgatagattttaatccttcatctttagtcctcgtttggaagtgatgaaatgtggatggaatcaaaatggatggtctacttgattaacacggtgaattaatatcttgagaaattaacttaacaaatagctagaaacaagtgttctaaacaatacagtagaagaaagttattttcagaaatcgtattttcggaagtgtggagcaaataaatcgatccagggtagattacagttgatcatcacttcagaaaggggccttagttttatggatgacttaattatcactgtgcgggtacagtgatattgaacgtgctaaattttatggagaactgcagttaaatataattcttttgtataaatctgatagcagatgtagatgtctaatattacgcacgttgatgtgcaggttgatgcgttgctcgaggaaatcaagaatacgccggttagcatgatttccgatgacttaattatcagaactgtgcggcagtacgtaaacctctgaattgcagcttctgttattatttgttgtgtgtcttgttaaccatcctaaattgataattactattacctgtccttgtctgcttctctagttctattttggctcgtcagcagattcttgttcaaaatgttctccgatcatgggttattgctgcagcagttctctcaggctattgctgggggtacaacagagtggccaaacgtcctgtggctggctctgaaccaccaacagaagatgaggtgtagaggacttgacagtgttttcttttggagatgggagtctagaagtctgggagaatcaagaacgtagtgaactaagcatgtgtcataatctatcctgtgtatcagtgactctgtgttaactataactaattagtcctagagctaattggtgtggggattctgtaatgagagatctcgttcggtttgacctgtacatgtttctctggttgcggattctgttgccgaaactgatatgtgtaatgggagatctctttgggttgatctctgctttattttgttgagcaaatttgcaagaagataacggtttttgcccttttttgaatatcttttgcctcctcacgaaaactgacacgtgctaggctagtttgtaaaaaactcctcgttatatacataatcttacatcgaccctctcaacacctgatgtctaagctgttttttttttaatataattgtgaagtgaaaaatctgctttcagggtagcactgtagacataaagagtataggggtgtttctgaaaacaatcttcccttgttccacctatccccactccgctagccaatcaggaggcatattcatcagccctcggtcgatcgtgcaaggtgggccgtgggctgaaggcggagtcgtggacgcggagacagaaacggcgtcgcttcagctgcaatttttagttccccccttcttttttttggaaaaagtacaccgaaggtccctcaacttgtcatcgagtcacagaatcctcccccaaccgtaaaaccagatatccggggtcaaaactggtcacaataggtccttcgatggttttgaccaggttttgtcgtacgtggtggctgagtcagcgtgggatctacatggaccccacatgttagggtgccacgtcagcacacactctctctctttcccctcctctctctctctccccctccttctcactcttctctgcctttgactgtaggccggccagtggggtgaggcgggagaggaggtcggcgccgtggcggctgctggcgtcggcgggggctgcgatgggggagaatggagggcgtcggcgtcggcggcggcagcgacatgggagaaggggagggcgtcgccgcacgggtgaggtcgaggacatagacccggccggcggctcggtggagctcctcggcggccgaagatgggcctggggaggcagtagtgacgcgggaacaacgcgggcgtgcagcggtcatgcgcgtgcgtcgttggcgcgtgcgtccccgacggagcgagcgagccgccactatctcccctaccagccacccacccgaggacgagctcccgcaggttggggtaggctgcggcggggagctcccatgcgccagttgcttaggctatggacgtccaggaattggactgcgtcgtcgacgtccttgccatcgccgccaccgccgttgtagaggcaccgccctagaagggcgccgccttgggtggccgtcgctgcttggtatgcgtcattgaagtagttggaccacctgaactcgtccagcactccggcgttgtggtccatcgtcgcgacggggttggcatgtcctaggttggtggtggcgacgttggcgcgctgctgactgctcggcgtcagtcgcggcggggctgaggtcgtccatggaggtgagcgtgctggagctagaccaccggtggaggaggatctcccaaggaggcggtggtgcatgccgtccgctgcctccgacgacgccacacttggccgccacctggcgtgccgcctcgtgcaggtgggcattagcgacgtcttcgccgtgcccggggacttgaacctcacgcttctcgaccacctcatcgctgagcccggcctccgcgtcgtcgactgctgcaacgagctcaacaccggctatgccgctaacggctacgcgtgggcccgtggcatgggcacctgcaccgtcaccttcaccgtctgcggcctgctgctgcacggccgccgtcaccgcagccattggttctggaatcaggagacgggcgacgaagcaggcgccgccttcaggaatcaggagcgtgccagcgcatctccgtcgttgccgtcggcggtagctcgtcggagtggctccgtcgtcgtcggcggtggttgaagcgtgtggctccatcatcggagacgacagcctcctaggaccggcacagttgaagcgtgtgggcgtggctccgtccggcaccgtcctcgtcctctcccttgcgcaagtgaattgggcagtcgtcgagctcgaggccgcgtttgctgtgagccaccgccgcgctccttccccgccgggcttgtcgtgcccactgcaccggcgacgcactccgtttctcccgcgtcgttgccatcgagcgacggctcgctcgctccgtcggacaagaggagaaaagtgagagagagatgagggagggagagaatgggggagagagagagagggggagggtgatgacatggcatcctgacatgtgcggcccacgtgggacctactctgactcaaccgctacatcggacaaaaccggagtaaaaaccaccaaaggacatcaagtgaacggttttgtaagttgagggatgtcatatatctggttttgtggttggaggacgattttgtaattcgatgacaagttgagggaccatcggtgcatttttcctttttttttttgccaatatctattttaactgggctttgggccagaaattttttgggtggtcaggggaccaccctttggatccgctggtgatgctgaggaacatgtgaattgactgtcaggggttaactcatcatctgagtctcatcccagagttgtaaaacctgggacagtcgttaagtatcatctttgaccgttaattcctgcataaaggaatgcaaaatataatatcaaattaagtggtagggtttactaaccgtttcctctagttttggtaagtatttatacgcaagtgattttttggatgaatttacacccgtcatgcaaagaaatatacctatatgggactaaaccacaatgcaccgtcttaggggcccacatgtcatcccctagaggaaggcagtggagagtggtggggctcacaggccccacctccaccttccacaatgatagttgtgggtacaccgacctccacaaccgccattccaaccgtcatatggttatataaaaggatgagctccagccgttgcacaacacacaacaacaaaaacaaaactcactttcatattttaggcatcactttattagtgtggaaaaaatagatagagagtgaggggaaggtctggaggaatgccggagttgtcggtgctctctcctcacttgtacctcggtggatgcttcatttaataaagtaagtgtttgagatttcttatggtatttaattagcatacttaagtgagatatattctcaccattgcagattcgacacttagtatttatattaagagcttgtttggttctttaccctactaattcattggcagtgctaaagtctaggcaaactttggcactaccaaaatattggtaagataaaattatttagttaacatttgaattgctgccaataaaaagccaaattcttatagtatagtaaagaaacttctagaatataaccaaatagaataggggcgctaccaaatatttggtctcaattcaaactaacacacaaactattcaatttgccaataaactagcatcttaagtcgtgtgttcacacggttatgacctctccatctattaaaatattgtttgtgttaatggacataatgtttaataataattaataataaatatgtttttaacattttttttaagaagtgtagctataacattaatggatttatatatcttgatttgtcattaagaatatcatcgtaacaacaaataatttatcatatattagcgcaaccattacctcctacaatatctaaaagagtcaattgtagtaataatgtaaatagccacatttcttacgcgttgcaattctttcatcaccagttgaaaaactgcatatgcaccagccttcaagatcaattgacacaaaataggggatgcaaactcaaagctttttcatctaaacgaaatggcaggagacaccacaatcacattcaaatgttgcaaacctcaatcagtttagttttgtcccatgaagagaaagggcaagaagttcagagacctgttccctccataaaaaaaaaaaaccccacatctgggtttgaatctagacataggtcggctatgttaagaattaaatccagaagtgtttttttatggagagagtaattgctttatcatgcaccaagcttttccttttcaagatcctacaggagatatgtgtgtgtatttgtattaaattgaaagaaagaaacagagaaactaagtcccaatgtaaagttgagaagccaaagattacaaatatgtagtccttaaaattccaaccaaccaacgaactatcatttgtcccagaccatagtgggaaacctcctctaaacttttccaccaaaaagaaagttgaagtttatgtattcactttatacccagtttggccaatccaacagaatcatatgataaatagggattgttgacagctgagaggccaacagtctggagaaaatctttgggaaactatgcagaaagcttatatgctttataacccatcacctcaattatttttttttagacaacaggtaattgcattacccaccttggaaaccaagcccagagacaatccatcacctcaactgcattcctgtttctagacaacatacaaaacaggccaccatacatacaaagatgaatgaatattggtacaataaactgacggggcatttgcgtttttaccctattttaaggtctaactaccaaattgaccttgctttcttcagtttgctattttgaccctctttttttaaaacgaacgttaggtctggccctattccgttaaggcaacataatggtgttaattcagagagaaatgacttttatgccctcactcatttgactctattttttcaaagttttttgcttgcctaattttgtgtatttttatctgaaaatgtgacattatttttactaagataagtgacaaatctaacttaggtttgagggatttgacaagtttgaaacagatttaaattttttcagacaaaattcacttagatttgatatattttcgacaaacttaacatacatttgacagatttttgataaatttcacaaaaaatacataatccctctacaccagcagcatgcagtcctccagaccaggagagcaccggctccgtctccctccagccgggcaagaacaaggagaggcgagagaaagacggagagcagcaatagcaaaaacaaagcagcaaaattctagggagagagctacaaatcggacgtccgatgttgaaaaaaaatcggatggtcaaatgtttcagttgaccgttggtacaacattaagttatacatggtgaaacaaaaaaaatcagcctataaaacatatagaaattttgtgaaacacaataagaacacatggtgaaacatattgctatcacgtatgaaacattaagcttttattgtccgaaacatatatttttctttcacaacaatataatcatgtgatatcttgttgtaaagatttaattataacgaattcaacggtgtgattgaatcgttcatcggataagtagtttagaagaaaaaagatttttaatacgactaaatacttgcatcatgcatggtgtggggagaaagctaatagatggtaggagagagagagagagagagaagaggcatgagttatacattggtgaaacaaaaaatcagttgttgaaacattgagttatatatagtgaaacaaaaaatcagttgttgaaatattttaaaaatttttatgaaacataacaaaaacacacgttgaaacatattgctaccgtgtctgaaacattaaatttaacggattgaaacatatgtttttgtttcatcggaatgtaatgatgtgatatcttgttgtaaagatttaattataacaaatataatggtgcgatcatatcataaattggataagaagttgaggagaaaaaatattctgaagaccattatagcatgtatgtatttgtgaagtggacagggaggtagtagtttatccgtccgatttttgttggttgcgtcgaacgtctgatcctaagcatttttgaaattctagcagcagccaaacacctgctggcgagctcccgcgccatcctcgacctgcgctgcatgcctccttccgcggccagtggcggcgggctcctgtgtcgcgcgcctcccttcgcaccccgccgcggccgcgagctcccgtgccacgcgcctccttccgcgcccagcggcggcgggctcccacgccacgcgcctctcttcgcaccccgcggtggtggcgagcacctgcgcctccctccttccgcacggagtagctgctgccgccgtctgtgcaccggcgctgagagatatagggttgagagtgactggataggattgggagtgaatggatagggttgagtcatgaaaggtattttggtcagtttgattaataatgtgatttttttcttttcctaaatgaaaccctaacggtataatagaaatagggtcagacggtaacttcatttttgaaaagcaggatcaaataagcaaactaaaaaaaaaaggtcagattggtagttaggctctgaaatagggtgaaatgagcaattgtccctaaactgatagtatgaaagacctacatccaaggccaccataacgactcaacattggtagaattcaccttgtaattgtcctttcaactggtgccaagtatcaaaccctaggatagataaactgatactaactggattaaggatttgagttgtgatatttcctatgcttttctctatcccaactctgctctgagctctgaaggactgaaggtgctcaactgttgatccattattttcactacagaattgcgacaactactcccgccccgggacgatctaagaaacccttgtagcactccaggatgaggatggagtcaggatgggaaggggagagtaccttcactggattggcggtggtggtgggttcgccggggccggttgagggcgtggccgccatggaagaggcgcggcgcgggcacgacagggaggcggactgccgtctggatctccgccgccatgccttcccttgggtgggtgtgtgtctccggcaacaaggcggcgggggctcgccggcggcgacggcggcgtggcgagaaaatgaagaggtgaggatgatgagaatcttaaagcaatcccagccgttgtaaatcgcttggttttttccccttaataaaaccaaaacaaaaggaaaagctggagaaatccttgtaaatgtatgggcctgggctgaatttcagggggccacctacaaatcatgcctcggtgtcatcatcgtgtttggatctcctatgacatttcttccgcgtttagctaccaatgtcgattttggggttggttttataataggtaaaatgaagcaaacaaaagaaaatacacattgattgagataagagtactagaaaattgttggcatgcaaacaatactttaatccgttcaaatggggcgctgtttcaccaagtagatcagaattgtttcactaagtagatcgaaattgtttcaatattttaaaaatctgaaacacaaccaaatcacctcgtgaaacattttgctacaaggtttgaaacaatggtttccaaaaaaatcgggcattgtttcactttatataaaaacaatgtttcagcaaatagcgaaaggatgtttcaatttgctgcaacatttgatccatagatagtgaaacatcatgagtacacttgtaaaacattgttggtggaaaaaaatgaaacagattcacttaatagagcgtttctaatacgtgggtaatttgttgcaatggcgcgtgtggtgaggcgcgtggtaggaacagcgcggaggcgcgggaagcggtgggcgcccgatttttttttgccactgatcgggcgcctgatcgctggcatttctgggatttcagtccaatcatatctcagttccagatacatgtgcatcaaatgtactgctctattggataaactttcttttataaaacttatacggattaaggagtaacattaatttaaggtatgttaaaaattgtaagtttaataaaaataataagaacaaagtcttgtctatctctttattgatggctagcttactttatagtttatacaagagcttctcaatatagagatgtagtaagtcttatttatcaggtcgtcgataattacatcggtgatgctagctttagtgttcaggacaccgacttattccgagccattcgttgtgaactataatagcggaagaatacataaatttaccttgggagccctaacttctctgtaatctcattctcactaactaggaactcaccatgatctactgccaatgggaggcttgtctaactttgcatttgctgggctttgcaccattttagtagcaaagcaacaaaggtttggtccatctaacataacacttctacgagctttgctacgagatgatgcgtattttaatattatatatatactagataatgctccgcgctttgctacgagatatatgtaaaatcaaaggtgtttttgattattattctgtgatgaataattggccattggagattattggttttgttatttggaatttattcacgaagtggttttggagatgattggatttcacaggtgaatctacaggttatcattttatgtgaccggtcagactgggctgtgtatgccggtcagaccggcggtgatcgagcggtcggactggctagcccgcggtctgaccggccgacactgtgtcggtttcggtgatggaccgggagtcggcttggggataagacgacgtccgtggtggtcagagatcatgcgggatacttaggctagagctgatgaaagtggttgatggagattccatatggcatacgatggagttattgtgtgcgtatgggatgcggagtcgaatttggaaggagtccaaatttggtacgattggtcatgtaaagtttctttcttgtattagtgggtttcctaaggtgtttaggactcctaatatgagtttggttcatggctttaggctgcctatctcatgtataaatagagggggagcgtgagtgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaataagaaaaacggcgcagacgactccactccacaggcagcttgaccagggctacacctaatcctccacaccatcagcatcactgtagaactcttcctctgataaatgattgcaaggtgagtatatgacatactcagcaagccacgcagcaaatatgcaagtgcacaaggataccaaagaatggcataatatatggctcatttgcaaaagcagcatttagcaaacatttgagaattataaaacagtagagtaattaatcattaattttaatcaacactaaacagcacacccatgctgctcaggcccaaccatcctgaacaaccatacccggctgtacatatctatctccaaaccaggaatataccattccaaaccaggaggctaaacaaattattaccagttatagcatcttttattatgatgagaagtgtgaaactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagcgcacctttcctggatcataatcacccttataaacaaggcatggactccccagcgacccccgtgggcttatctccgccacttctcagtctggtgccccgcaatgaaccatgttatacaaaaggtaaagccgttgcccacgctggcttgtggttggcacggttaatgtttcacaaccgaaactcgtgaaccggtccttaattgtcatgagcacgaccatcaaaaccatgtgctcacaacccaccattatcaagttttagttggcaaattaattaattaaccaatcacgattaaccatcatgagctatcattaagccatcattaaataatagtgagtcataagttatcccaatagtgtgctaatgtttctaagcatggctaagcaatcatatctactatctagctgaaccaatatataaagctcaactagtcaagttatgataacccaaggtatcaaggaataaagtaatcaagaacaaaagggctataacaaacattaggttaattccacccaatgacattcgaaaataaatgcaatagttgaatagaaacaatagctttaaacgggatcaacatgctcaaagggatgtttgggatctgtgtgacttgccttgctggccttggaactcttcaaaatcttctcctgcaaaaacggactctccggaaacgtcggaatctaaacagaaaggagcaaaatcaccaaaacagcacacaaacaagcatgaacagtacatgtggatatttttaacatgtagatctctattttagaaaaaattagaaacttgaaccaactaaattcgagctaagatgaattagttatgaattttcaaagattaaatcagattaaatcatttatttagattttaattgaattatgacgcaataatgaattatttttgaaaaggaaaagggaattattgcgtcagcggctagggttcacggtgaaccgggtgcacggcggcggctcacggaaacgaacggccgatattgacccatccaaaacggacggccaagatccatcggtccacggccagaccacgagagacgacgacgatgacgtcagcggtgacgtcaccaccggcggcggctcaggcgcgcaaactcgccggcgaacgacggcacgacgacgcgaacggaggacaccaacacgtagagggcgacgcggcgaactcaccggtgaccaaaacaacggcggaagatcaacggacggcgatggcgtcgaggaagaagcggctgcaaccttcggcttgacgacggcgacggtcctccggcaacctacggcgacgacggaggggcggacgaggtcggcgacggcttggcgatcacgacggcagccttcccgagcgacgacgacgacaggatcggcggcggcgcacggctggacgaacggctacgacggcggcgctaggctacacggtgctagggctctaccggcgacgagaggcgaaggcgagggtggcgacaagtagcggaggacttggggggtccttttataggggttggaaggcggcggcgaagacccacggcgaccggcgacacgaaggaaagtctagggttcggaggagagagatcgatccgaatcgaactcgaatccacggatttccaaacgatttagccgacgattccaaaagagaaaaggtagaggagatcccgaagatcttttcccctctattgatttcaccggagaaggaaaggcacgagcgaatttggaaggagacggcggcgcggctcggctagggttccggccgggcgacggcgcgaggaggacgacgagtccgacaggtgggacccacctgtcagcggccgagcgcgcgcgcgggcggctgcgggcggactgggccagcttgggccggggagagggagagagaaggttttgggccgactttcggcccaaagccaaaagaggattttaaaaacctttttcaatttaaattattcatgaaatgcaattccatttattaaaaatacttccttagctcaaataaatcccagaaaaatctaggaattatagagttaagcaaagtatttaatgaaattttatctggccccattttatattggaatttattatttaaaattagatcttcttttctaggcttttaaaataaattctaataattccaattaaacaacaatttatatgtttaggatttttagggtgtgacagtgaggcttcccggtatcgctttagagagcaattgagttgagttttgagttagggtttcgagtttagtcgaaatttttgtaaggtgtgatgttggtgcactttgtaaacacagagagaatcaataaagtcatcatctactttaagagttcttcgatttgtgtttcaccgggtttcggcggtctaaccagcggtgcaccggcggtcagaccggcgggcacacggcggtcagaccggcggcgacaggagtcggcggcaggcattctcgacagttcgaccgatcgatctacatcggtcagaccgacgttcatcaggcggtcagaccggcgcaactacttcggtcagaccgcgatccatcgatttcgagggtaacttttattttcgctaaaagtttttggtttttgggtataccaaccattcacccccctctggttggcttagttcttgtgattcgttcctacaatatatgttagatattgtagaaatgattaaatgatttgaattgaaatattttgaaaatgatttaagattgatgatttagcatgtgtatgtttagctttagaatgaaataaattatagatataattactatatgcttgcatgtagatctgtatgtgtttagtgggtattatctttatagaaagaagagatatgaacatgtgtgtgggaggaaactaggataatgtggcctacatgtcaaagattgtaggatcaaatttaattttagagtcaaacatgcattagcatgaattattttattattaattttatcatcacacaaatctgcttaagtccgggggtcatatcaaaggcttacttctgctcttatattacttaccactatacacaccacgtttgtagaacatcgatcgacattcaaaaaccaggtcgttgtcatattaccaatgaaaaatacaacttatggctgtgctaatcccatcaaagcaactaattcaccaattaatagaaattacaattagaatgaacatcaaacagacaactatatataagtcaattattgtttattaatttcgaactatattatatatatatcacccatattcatatatagctaatatatatatctctatgtaccctattaattattatctttccagtgatctcaacacgaataagtaactacttaccgtgctaattaatccatcgaagcagctaattaagattaataattaggctacaaattaaccccaaattaaatcgatggtgtgcatgcttgtactacccatcatgcctcattgccctaggcaccatgtcatcaaggagccccttgtcgacgggaagaacactcgccggcggcgacgacgacgacgacgggtagccgccgcagctggcaacaacctgcagctcatggttgcagtgcagaggcagctgtagcagcgacgacgacgacgccggagtagtagcagcaagcggcatcgtcggcggcggcggctgcaggttgctgtacagttgttggtgcgcggagaagggtgcggcggccagggcggccatggcgtggatgtgcgagaagccggcggcggtggcggcggcgcgggggaaggtgacggtgtggtgggagtgttggccctcgtaggtggtgatgacgacggaggggtcgtcggaggagcgctccacccgcttcttcaccgtgcacttgctgttcgtgcacctgtagtagctcctgtttttttttttatatatacacacacatgttaattaattaatttaaccaagagattgattgattaatttatttgcaaaaaaagtttgggggctaattaattacatttgcagaagaaatatatacatgttggggggagatcagccagcttatattagcttgttacattttagggttcaagggtttaggaccaatgcatcatctagaatactactatagtaagtagtagtaactacacttaacaggtatactctctccactaaaaaaaatataagacttggtttgatttggtatggtctccaatgtcaaactttgaccgtcaatttctcccaaattacattattattggtactgaaactaaaaaatagatgaaagtgcaagcaaatacgaattcaacgattatctttttttttgtttctagacatatacatgattagactacttgttgatcaaaagttgtaaaatttaaatcttaaaatacgtgtgtgcgcgtcttatatttttaaacacagagagagagagtgtgtgtgtatacgttatgaataaaagccatcaaaacaactgcacatgctttatatccgactagaaaatttgtgcacaagagcatatagaagaaaattaatggtagttgcctaataaggttatggttgtattatttaataaaattacaaatagtctttactctagtgctgaaaggagtaatttgggggatatttctagcttaaaacatcattcaccgccattgtaacagccaaaaaccattggagtttgcatcataacttgagaaagatacgactacctaagtcaatttctatttaattagattatgtgatatcatgttatatatacatactagcattcctttaattatagcagtcgtcctagctatacttactgcaaccaatagttattaacatgattggacacatttttgttgcatgcgtatgtggctcaccgaaatgaaatcatagaaaatcaaagtatacaatgttaatcaaatccagaaaattaatcaacgcatttcattccctgagttgcttaatttgcttcgttggcatattcatgttcagaatcgaagtaccgtgattgtaattatgaaaaatattggagtagatacgcttttacaacacacgcatacaactaactaaaagtacgtcgtccttttcgttcagcccacaactttaatatgtgaacccactgtgctgatactcactcatagttgctgcactactgtatcaattaatcgagaatgaatgtatatatgtgctgaattaattatattaatcatgcatatcaggaactattacttaattaattagaagaagatcgaaattagagaaaccaaattaaagcaaagacatcttattactacagcatgcatgcatttgtaatactccatatatgaatttatatgtataaaatgtaggtaggcaccttggaaaaggactgttcttgacggctttctggccatactttctccagcgatagccatcctccaggtgatcgatctcgctcttcgtcatgaacgcgaaccgcggttgccgcgccctcttcttcccaggcgtcagcgacttgctcctgaacatacataaccacacgatgaaaattaatattgtagagaatttccgtcagaaaggtatatagttcagatcgagaatttaaaagttatgaaaagaaaactactactataagccatcaagtagaagtagctaggcaataagaaattatgttactgacgacttgcaatgaaaatgtcctaactcgatgcctaatactcctatatattcatgatcctgtcttaattaattaattaattacgtttgttctctcaccagatcgacctcttttgcaatttaattcgcaacctaattccaacacgtactcgtacgtacgtattcgtacttccttttgtagctagtgcgcattatctaggctacatgcatgcaccgatcgattaattggcaaatagtagtataaattaatgaaacataaacacttccaaggtactcatagatttttgctatataatatgagagattgagagtatatatatatacacgtatgtagagtacgtagtacgtgtctgaaaaatatacactactccagtacttaattatctctagcaaaaaaaatgaacataagctcacctaaaagctagcatatatatgtaaataaagacaagacaattcaatttaagaggaacacattaaattaattaggaaattataagcacatgtgcgatggaggtttagcacgcgaatcccggcgcaatgttcgaagaagattaaccacacaaacacactcccttggctagaagctagtagcgtctttttttaccgttttgcccctcggagaaatgcgtaaattaattaattaattatccacgtaaacgaattggccaccgttaaatcatctccatccaaacaaaatgcaaagcaaaaaaaaagaggaaaaactgaaaaggagatagaagagacttgaaaagttttaaattaattagttccttgtttcgaattcaattcaattttatagtatgctaagagaaccataatttggataatttggagggaaataacaagcgatttatcgagtaaattaaattaatctcttgcaacaaattaactgcgattaattattgtacttacgctgcctcggtggacgcggcggccggcttcccgccgtcggcgtcgtcggtggagcacgacgacgcggcgccgtccgcggaggacccggccggcgtctccggcagatccagcggcggcggcggcggcgtggccagctcgcccggtggatccagcggcggcagtagctcccccacggcgtcgacgacggcgagcccgttggcccagccgagctcggcgaatatggccgacgagtcggcgtacgcttcgtcggcggcgaacggccagtcgccggcgcccgccatggccatggcacactccggccggccggccagccggaggagcagcagctagctagtagtgcagcagagagagagagagagagagagagagagagagaggtcacttcacttgcttggcttaattaatttctctggattttaatcaacaccgcttggcttgctttgctccccatgagcctttttattttgtagtagtagcaactccagtgtcctcccttgtgtcgttagtgagctgctagctagctagctgtggtctctgcatttatttcactcctctctcatacgttctctccgtcgtaaaataaataaatctaatatatgatatggtatattttatatttttaatatggatagacacaccgtctagatttataatactagaatatagaatgtgttacgttccgtattaagtttgatcgtttcagaacggaagaaatacttattcatattattgtctctatttccttatgatgaaagttaatccagcctctttatatagtctggttcaattggttgagtaaccgtatattagtaaaatatacaaacaacgaaaaaaatataattagaacttttatatctatattattagcacggttcaattaaaagataaggcttgaaaataaactatgataaaataaatctctatctaatttaaattttttattgcggttaataaaatcaagcagacgacgtcatctctacaattatatataccctatattttcaattaaaataatttcaatgcatggaaatctaattaaacacttttagctaatcagatgtttaggagaggaattacaaaatttaaaatttaacaagtaagataatttagatggaatttccaatcttataattaatatttgctaaacaacttaaaaatatctaaatatttaagaagggacgaaggtgaattggttatagctggcgcgcggtactttttcttcactgcgaaacagcggtcatgatagtgaaataacgcaagtatatatgtgcaccgtcgatcttcattctgttcacacaactactcagctatagctgctactatcataaatttattcatttttacaattttcagatactgtttgaatagcatattggctatatatatagcacgtatacgtagctaacattattctagataatttatatagcagctaatgcatttatcaactagctagtagcctagtagtagtatattagctagctctctacagtattacacatataattaattaatcaatccggtaattgaagttggggacaaagatatagttcaactcaaatcgtttagtttcgcttaagtcaactcaaatcattgtcattgtcatatatacatcagctctcgctagcgtccaccgctcgtcacttaattttactccactgttaattttcatatactaatatcattctgaaattaaactgtcaaacccaaaaccttaattagaactaacttgtttgtattttgagataaattacttcagtctctcgtcatcttgcatcgatctttggacctctaactagctagctggctggatctctgtagtaattatattaattactacaaatacgtacaagcatgggaccaattaagagcaagtttaatattacatccaactactagcttcaaattatctatagtcaatttaatagccaattaatataatagttatctataaatatatattacaatattaatatctggtctcatctgtcatacacacattacgtctgagagtccgtgctgatcgctacaaatctgtagcccgctgcttatctccctcttcttttatcttctcgatatatgtttatagctggcttatcgtccactattgtacctgctcttaaaggggtgtttagatccagaggtgtaaagttttagcgtgtcacatcgggtattatatagggtatcgcatagggtgttcggacattaataaaaaactaattacagaatttgtcagtaaaccgtgagacgaatttattaagcctaattaatccgttattagcaaatgtttactgtagcaccacattgtcaaatcatggagcaattaggcttaaaagattcgtcttgcaaattagtcgcacaatttttgtaattagttattatttttcatatattaatacttcatgcagatattcaaacgttcgatatgatagggtgtaaagttttaggacgtgatctaaacagaacctaaattaaatcatgcatgcagtactagaccagtggaccaaacagcatcgagtatttgcagttcattctaacgtaacgtacgtactagccgataattattagtacggtattttatgagcaattaacgccaccggctacaaagaatagtactactccctccgtcccccccaaaaaaaaaaaaccagtcctaaatacgtttcagtgccctaattgcgatcgatcgatctaagttatatatatatattgaccatttaattatagttgataggtccggctcttatccggaatctcagattaattttctggatgtcgatcgctttgtcctcacgtccaccgatcgagcggcgccacacgttaatattatcaaaatattataaaccgaatttttaaccatattaaacaattggtggaaccaattgccagaacccatat

SEQ ID NO: 66711 - DNA, 3579 bp, Oryza sativa
ctttttagagtttttctttttataaaatcattttaactttgtttatttcttaataattattatttgtgctctgaaaattccactaaaatttgagggctccttttagaccaaggagaatttaacaaaaattctccgggccacatttgaatttttcttgtacgtattttagtgtttgccaattcttttagaattttaattaattctattattccttttagaaaatgatttttatttcgggatgaatttatcaggacgtgacaaatccaccccccttacaagaatctcgtccccgagattcgaggaggctagcaagaagataggttgggtggtcttctcttcttatttgacttcttccgctccgtcttcacaaactttcagcaaaacttcaccactcggaactgcttggcttgacctcctgttgcggatggaatcttctcttcacctgacttgaaccagggtgcaccttttagctgactcagactaggttgcggtagtttaatgatgcttccgttccagaacttctcatgattcatatctttggagtcaacctcatacaagttaccacttcatgtcatgcgtcaacactagcttgtcattactaggataccatgtttgtcatcataagaatatcatgcttgtcatttacttctaacttgccaccaactgcctcatattagctttcctggtctccgggtgatagctacttctgctatttgatgcaagggtcgataactttgcctttgaattatgcttcccaagagaaccaacttatcccacttgacatactttgacgtcttcccaaatggctttactgctggatttgttattgtctaatcattatcctgccaaatctgaggcttcgttgttagatgtgattttaatctgacctctgtagattatcttcgaacatatcacttgattcataactgggaatagctctcacgaacaagcaactcggattcactttctttatgttcagtttactttccactattctcttcatgttgtcatcatttagcattcaacgtattcctttgcaccttcagccttgatgtgttctttctcgatggatcgattgctaggaaagtgcgttgaacgatactagtgcaagtgcttttattctagtagcatctgatacaaagcccaaggttgaaccgagctttagattccactgttcaggttttacttcttgacttcttggtcatgtcacaaaagtttccatccttgtccccatagaagtacttctacctgtggtcatctctcttactcgtgaattcacctactttaatgacagggcaactgttgtagggttgattgctatcgggagtcttcctcgagtgacacaaatcatggttctcgttatcctttatcaatcacctttcgacctacttcttttcccagtaaccaaacatcttttccgatctcttccattaatcacctttcgacctttctcaaccaggtactcttcgctccgggtgttgaggatgcttctggggcaatgaggtccttgggcgtgctgtctttcagagaaaccttgaagtagttcgtcaaaagctagactgacgattgttgcctttgatccgaagaagacacatctgaaactcttagtccaaacaaatgtctctttggttgatcacttgattttcttcgccatcaatcgctaggttatttgatgcataacagattatgagcttacggaaatgagaccctaggtctccctaatcaacaacaaaatgtacacaactcacagcacttgcaatcttaacatggatccttcataaacttatcaaactcattcattatctcatgtttctctgttattacatgattgacggggaacaactataaaacaaaagtatttgaacactgatataagagtattatggttgcttctgactagcgctaggcttaacaggtactgcatttgctccagtgaccacttggcgattggcatgtctgcttccttaacaggtactacagttgtaacagacaataactttcttacgctcgggttcttcatcttgtacttgatttttttggctgctgtgctggaacatccaaaggtataatgccgatactggcctctgtcttgtcaactgatggctggggctgaaattgagcattgacaccttgtggtaatgcactcgctggagttggagctgttgcaacgcgggctataggactgcttcgggatgcatggatgacaattcgctgaggagcaagcttctgattgcagggagttgcgtggactgacgtgctggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgagatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagtggcacacgagctggcaacatgaccgattttctccacaacgagagcatgccttacgttccatttcatcttcatcatctgaggagacttgatctgaatcttcactatcagacactctacctccattagctaaaagatgctctgtcaactgtggtgcacctcggaaggtatgtcttctctgacgttttgtcattcctggtggaggccattctgtgctggtaatgatcatcttacggacttcatcttcggttcgcattggtgtttttcttttctgctgaggacactcccttgcatagtgcccttgctcatcacacataaaacaaatgatacttgcttcttttgagtcaacatgtggcacgtcaccatgggtccttcgggatgctggcggcatgctgacttgtggtgtgagtgcttggactgcctccaactgcacttgaggttgcatctgactcaggttcagaattggcgtctgatgctgctgtagtatctctataagcaattggttctggttaatcaggtgttggaccagtgtcacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggatagtaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttctgtgacgggttctcaagatcttcactcctgcttcacagctggcttcactgattactccacttcgctagcgatcctgcagtcttgcggagcttcagcaaacaactgac

SEQ ID NO: 66712 - DNA, 675 bp, Oryza sativa
atcatttgtcctttttggcacagatggttggttgaactggaattagatatttgaatgaatcagtccccccacccttttttttttcttttgcttttgctaattggagaccaccatgccagtggttgtttctgctgcctcatggaaaaactcttgatcaaactgtgtcgttccaagtcaacattcatacaaatggactgatttgtcaatattgtctactattgccaccagttttctttatgtctgatctctacagctatggattattttcagttgttttaattcaataaaatcatgtacttgtaggtgagccatgacatgggaatcgaaacaccaattcctattagtgtaaaggttgagggatttgaacaatattttctgccggatagtccatgcggcgcagcagcctcatttgagcatcccagagactgaagctgggaaaacacacaggcaataccgtcaacttctgaaccgttccctcacggttgtctcaggtaagttagtgtcaagcttctgcctctaaagtgtgtttctgtatttgcctttatgctctggcacaaatcgatcatgccaattactacagaatagtaagagcacaggtttagtaagacaataaaatctaaaagtaatagttatttatgattttgagttgaaactgaatagtggttttatcttaag

SEQ ID NO: 66713 - DNA, 9888 bp, Oryza sativa
ttagataaaaaaagcccgtcaaaggtattgctcatacctttgacgggcttctattcaacggcccgtcactggtatccgctcacctgtgacgggctagaaatgaaagccgtcacaggtggcggcccatcacctctgacggcttctaatgtatcggcccgtcacaggtgaggggataccagtgacgggttggaagcaaaactcgtcactggtatacctctgacgggttttcctttcggcccgtcacaggtgaggggatacctgtgacggtccgcggccggatggctcaccggtgacgttatctcgtctgacccgtcagaggtaatggtcactagtgaccaaatcgtttgcccgtcacaggtatcccgtcagaggtgtgaggatctggcgtagtgaatggatatttagtatttatatgcgtaacaaaaagatgtatgaataattaatattcaccacaacagtccctttggactagaacattggatttagtttgggtgaataattattttcttaaataaaaaagtttggggtgattaatggactgctaaccttcttcgtagacaacgccacagaagcccgaacaacggggcccacccactagccacagtaccaaagggtctgtgtcagggtttctctctgattcaacgaagtagtagaagagctcagtgccagtcttctcctcaacaccaatgtacctattgtgtatacattacacatgtacgtgcatatgtacccaattctatgtgatgagtttatgctcgtatagtagtagtatgtagaagaaaatgggactctcggtgagtagtgcttacccagtctcgaggtagaatggcaggcggccatggaagcccgggaggtgagtgatcaccgccgacgacgccgagcacgggagcgtcagtggcgacgacagaagcagaagaagaagcagtaggagaaggcaggtgatgaggcgcggtggctgcacgaggctgcattgccctgcggtggggcgatgatgagaacccatcgtgaggagtggagatccaagaggagcgtggctggcaagtgcttcctctgttactctgctagtgctcttatagctttattgagctctcggcaagccaatgaatgcatggtgagaggccagcggtaaaagggaatgctaaaatactcctctgttttctaatatatataagatggtgttgagttttagcgtgactattcgttttattaaagaattataaattttatttatattgttcaaagtacaagcatgcgtaagatgactgaataaaatgtgtaatgattcactgtgtcaattagaattacacactgcttcctccctctctaaataaatacagtttgagttaaagatatgtaataagtgttgttttatagtggttcactgtatctctttaatactactccgtcattctgaaatataaggccaagcacaaccacttttttcgtgatgtttcataatgtaatgcacaccatatagttaacttagcatctccattttcctaaattagtttttaaaaatcttctaacttcaagatctctaatttcattaggtgcatacattacatttattaaagtgatccaaacgagaatatggtaataactatttcttgatgtttgcgttagtgatggttgtgccttataatttagagtggaggaagcatttcatcattttcttcttgattttagcaattcaaccaatagtaatctctcctcgttttctcccccataccattctcgccacataaatcaaacaaattgcctgctccactcctgattcccctatgtttactgattagattccccttaacattggcatctccagaagaaacttacagggagcccttgcccggtctcaaggtggaacggcaagcggctgtgaaagcccaggaggtggatgatcgcctatgacgccgagcacgagagcagcaacggcaacaagagaaatggacgcaggtggcgaggcgcagcggctgcaagacactacattgccttgtgaggtgagcacccattgtaagaagctccaaaaacactagatggagccttgtgttttaccgcgggatatatggatgcgttaaattaaatgaatatatgttaaatgccataaaatttatagataaatttggtttgggttgaaaaattatgaaaaaagtgtgagaaatgataatttatgcttttatgttgaggtttggaatgtaaggaatggtagatataattgttatgtatgaatgttaagttttacgtgtttagtgagttatgtgatatgcttgcatgttagattttaagatgtactaataattattatgttgaactttaaatgtttagtgggttgtaacttagtagaaggtaaagatttgttttgttttatcaatgcctggaaactcgattattctacaacaaaaccaagggcactgtttgaacaatcaataggcactactaactgattctccatcagacagtatgcgcattagtatgcgacaggggcgtgcggtctcttgtgggcatggtatggcacctgccatagctatgttacggcgtgaatgctctcattacttctttatcagaagtctcgttgaaaggaagcagccgagaatggctgcaccggtgacttgacaagagctctggctcactggctaacctactcgatcgggtgatggaatcagtcaataagacaatattcatcggaacagtagttagctcttagtgattatgtgattaattggttttttgagttgatagaaatttaacttggatgaaaggtgtagatatctaagcagcacgcagcgccaaaagcggcaacaaaaaaatatatgagcaagaatatatgacatttataaagtagggaaaagctcttagctaaaattacttcaattataaaatatgcacagaaaaatacggattataattgttgattgcatttagggtcatatattatatatataataagtacggctgtaatatagtgtatataaatttatttttttattaattataagcatatatcatttagtttctacgtgtcgactccgtcatacctaaactttagtgttgggtacatcattggtatgcgatacaaaaaattaacgtgtcaccatgtcgttgcctcgctatggccgcggcgcccccttgaacaatcaataggcacactactaactgattcccccatcacacagtatgcgatacaaaatattaatgtgtcgtcatgtcgtcgcctcactggggccgctgctccaagcagcgcccgctcgagcacgaggtctggtttggcgcccctgagatcctggaccctgagaggggtcagtgatcgatgttgggactgggaggcgatggtagcactcagggtggtaggccggtggagacggtgatgggaagggaaaggaggaggaggtggtcgtgcccgacatggaggagggaggggcgattctatactgagagatatataggaggagatcttggaggggagcgacagggcggcactgattgggagcaggagtgctggacagtggagttgacagttgtttcggacaaaagaattttgttgttgtttcctccaaattttgccgcaaaatccctcttaaccaaaaggaggtctttcaatttaaggtccttggatattttgattctcaacatgtggcatcttcattatgttgtatgtgcactaatctttccagtttgtgttctcgggactgaatgtggcagctaatcaaaagcagggcttttcaagtaaatttcacacctcgtcgcaatgctcagcgatacaccatcgatcatatgattttatctgacaataaatttcatatttcttttttctatatgattgctaaatatcgaaatatatgagacattttccgcaagtattgtgttcgaaatatcacatgagccattggtattgttatcgcaagaaccagatagaacggtacccacaagccacaagcaggggaaaaatagaaagaaagaaacacatagcttttttttagataatgaagaaacaaataggtagcagtgtgcaaacacaaaaactctggccttcctatggaggaaaggcaacttagttttctgagtagcagactccttcacggcagcgtgggccggtagagaggatgtggagtgtaggtgggacagggtgttgaggctgaaccaaaatcacttcaatgtgcaaactacaattcaccaaccggcaaatatatttcacacattaattgagctctcaacttgccataaactttgagaatagtttatactagcaaatcaggagaataaacacatgcacacaagacacgatgatttacgtggaaaaacctcctcggtgtgagtaaaaaatcacgggaccaacagtctgctccaatcaataatgcgtacaaatggagtcttctctaaaacatcttgaggcatatcacaatagcagctatatcattaagttacatatttgatatcatcaatatcaacaatcacaattaacaagaggtataataacaataaccagagaaatagtagctttttttccttcagtttttagctgagatctcccaaaccacagaaacaaattgcacgaaacttggcagaaatgatagtctatgagtcccttccaagatatccaaaaaaagcccaatcggacatcgtttgacccgtcaaactgatattctaccaaatgccgcacaagctgaaactacagttactcgagctgataaaccaccactcgaattcagtgctctactcaaccaatcctcacaaaactaactgattgaattgctccaagtgagaaatgaactcaccaagtttggtgccaatctatcatgtttgagcctccaatcgctgacttgatgaagatcgagtaagggccaccaagctgaacaaactgcaactcttcttctacactctcctctccctcttatgtgttttgttggttgcttttcttctctccaatggctgctggcatgctgctcactctctctcaatggagactagggttttccttcctatcacagagggatgaggcaatctccacccttgatcatgatatgaattaatggctcatatctgttggacttttaggctgtaatgtgctgagagcaaaggctccacgtggagagaatttagcccaacacagtggaccgactcaaccactagcagaagttgccgttgagcggacaagctgctggaagagggtggaaatttgaggaagggtgttcctgtttttacgcacccaccttagagtgtacttgtcaactataacagcaaaacgtaatggattttgcattttctgaactaaatagagtatcatctatcctgtgctatggaacaaagttgtgtttttttttttggtattttgtgatattggctgtccagctgtggcattaaccgaatgttcttggcattatccagccgtactatgttatccactaaagactaggttatccactaaaggttttgttcaatcctctttcttgaacgttaatgtatttaatcgtacgaatttggttaaatagatgctaatttttatataaacttgagtcaaacttgtctaactcagaagagttaaaatattttataatattcaacagagagaataataccaaataaattagccaaagttacaaaaaagaaacatgtttcacagtatcaaacaaaactcaaccattgataaacctaacatatatgaccgaagtcaccaaacaccacgcatgatctgacatcatctaccattcaggatacataaccttaacctaacatatgaccaacttttgtatgaatagtttaattcgcatgaatgcacacacgtcgaggggtgatggcgatttgctttcccccatcgtcaatatatatgaacagactgtgtctttcctgatgatgtgccgccaaataaaaacttgatttaattttcttttgcagattaccgctagcaatctccctatcagttcgacacccagcggtgtggaattcgtatatacaagtatggttcacacaacaagggtgcaaatatctttgacatgctcatgtttggccacttcagtctcatatctatggatcgaatcagtacggtattagttctcacattttgtgaattccaaacgaccaaaactagggttaaattcaaaccagaaggcattcgaacaattggccaaagctaaattcatgacctttcaacagtaaacaccttgtaatttaccgttatttttttgttgtttctgcagagtttcaggcttacattgctcaccgtgaacctctgtatcggatgtgcctttgattagtatttatttaaggatgactgaacatggcattcactattctctctgtctctttgtttactaaataatgtcccctgacaatgttatactagggactgttgggcagtttgtgcttatgcacgtaacacctgaattttaatatcactagaaaaaacgcgcggctttgcacgcgtggtacagtgagcctggcccattgggcctagtgaacaggtaacaaattaatacgcatatatggaatagccagattaatagtagagataactaaagcttatattagagcttataagttggctataagattgtctctatatttctttttcctctctctttatcttacttataagaatttaatgtgtttaccttgaagcatgtgtagagttagattttactcgaaagccaacactatatatatatattttaatctctatcatacacgtaagtttatagcccactattatttttgttctaagagcaaattttatgagcaagttttatagcagaggtgattgagaccaccaatttattcacatcatcaactaattaattaagatgtagcatatgtaataaattgtctctaacataccggctccaattttcatccaatccacaccattcttttcttggagtttgtgaagagattacccctttcatgaggggtggttacttctcacatactgtcttgtagctcgtgctgcaactaactaataatatgtagtctatttttcttcactctccttcgatgttctatagctagcttattgctttatattgtacttgttctaaggttgcattcgataaagggacaaacaaaggaaacgtccatcatttttcacccatatgtcggagtgtttttacataaaaatatctgtagaaaagttacttttttaaataatcatatttctatatttttcatgtttgaaacagtcctaaatcacctgatgaagcgataatggcacacctcttttacgtatctcattttttccctcttctctcaaatatagcctaaggtatgtttgtaacttaggaaaataaaatacatggaagaaaacatttggaatataaaacacataaatacaggtgtaaaacatagaaataaaaaaacatactccctccgagttgataatacttgtcgttttggacaatggtacggtcttaaaaaaacaactttgaccattattttttattataatatgtatataaatgttaacaaatatatgattttattgaagtactttttaagactaatctatacatatagtcaccatatttcaaagacaaatattttagaaattattcataaccaaacattttaaggtttagtctcacccttgtccaaaacgacaagtgttatcagctcagagggagtagaaagtttaaaaagattaatatttggaacgtaggattttttagtggatgatttaattacatccggctaatttattttaatccctaactaaagtaggtattattaattctttgatcctcaagatctggtggtgaaaggaagcaatagctgcctgcttgcctgggctttgccagccgtacggcggcaatgtgagaaatcagcgtcagcaacgtggtacagttcattgatcagcatacaccgggtgtttgcactacatgtatgcatagtaatggcgccggctcttctagaatcatcacacggcataattcgcatgggctaccgatcaatggcctattggggcctgattacggagaaatttctggaggcctgcacacacgcacgcaagagcgtttcgtcgatgcctgcacgagcggatgcgagatcgtttcgtcgagcctcttatgcgaaactggagttgccacgtggcacgtttctccttttgatggtttgcattgaattcgtattataagatatcaatcgcagtaatgtttagttactttgtcaaaattaaaatcaattataatttatttaacttgaatcgtaaaaccaaaaattttgcactccttaacaaacaaaaccatgcaaaattacgctccataagtgagacatatttattgatatgcgacatattgaaaaatcaaaatgaatataggaaattagaaacagattgttcagcatgtctgcttccaatgaagaaatcaattatctttaaaataaccgtaaactcaaattctgttagtagttttttcataataggacttgcttgtgtcaatgtcctgattaattttgaaatgttgaaacgactctggtagcactaatttacctccctgtccttccctgcattcctccaaccacatatacctgtgtttagttaagcgtaaagtttggattttggttaaaattggagatgatgtgactgaaaagttatgtgtgtatgacagattgatgtgatgaaaaatgactgaagtttggatccaaactttagatctaaacacaagcctaccgtcaactggaagaatagcttccagtgctagctagcagcagttttgatcgattctgcccccgaaagagaggtggatgcggatatgcacatgcaaatctgcaacgccatgggcttgcttgtgacgatgcgtacttgattgaactgacaaccattgcgtttgcgtcgaaagcagttttttcagactgccaaattgtattttcggaggtggtttctcgatccgaccgcccctatgggaatgactgttaaaatacatgaaaacaactacgtagtacgtacatgtaaaaatacatttccacgtgcatctccttaagatgagtgctatggatattttcgtaggctgatatctaaaacatccgactatatatggaaatgctctttccatggaaaggaggttaacatgcccgaccatacaatacttttcaatccaaggaaaacaattccaaattcacatccacaaattccccaaattcgtcctaaattccccaattgacaaattaatatgacagtctctatctatccatatgagtttgtctagaaagaaaaatctgacaactgcaaatggccacaatgacaaactctgttcccctgccaaataaaaaaaaatgacaaaaagataagttcacgaagatcactgctcttagttgaagtgccaaagattgagcagttcggcctccacgggctttacatccggagaggtcaggcctccagatctcctctgctatgctccttcttgagctctatagatagagaggacaattttgggaggacacttaattctcgaatgtgggggtgttgagctcgccgatgatgtttcctcactgatcccactaaagccaccagtagcctccacatcgagatccatatttaggactccatgccagatcgactcttctcgggctcccgggctcccgggctcccggccaggacaacatggaggagggtagcacggagtgttttcaatgcacaattgttttgatcgatgcaatttaaatgtcatgtattaagaccgttatgatctatcacgacaaaatgtttgattaagccacaacgttcaattgcggtgcataacaagagcagcactatgtttagcaaacatagattaaggatacactgtacgtgtaactaatcacataagaactgaactcactgaaatatagtcaaacgcaaacgtgggtttaaaacctactacttgatatacaaaagagcaaattaataaaattaagtagcattacatggca

SEQ ID NO: 66714 - DNA, 644 bp, Oryza sativa
caaaattcaaaataaaaataaaataaaatccaaaattagaaaaggaaatgagagtacaagtaggaatacaatttaaaaatagctgaaattcggtattaaaaataaggaatattaaaagaagagttcatataagaacccaatacaagattaattaaaatttagaataaaaataaataaatccgaaattagcaaaagaaaataaaataagagttcaagtaggaatacaatttaaaattagttcaaattcggaattaaaaataagcaatattgaacgaagaatccatgtaagaatccaatacgagattaattaaaatttagaaaaggaggcaccacgttcgctgtgggggctagaaattcccacattaatcagagaaaaagaaaaaaaaaagaaaaggagagtccaagtagaaatacaatataaaaatagatgaaattcaaaattaaaaataagcaatattgaaagaagtttccatataagaacccaatacgagattaatcaaaattcgaaataaaaataaaataaaatccaaaattagggaaaaaaaaagagagtccaagtagaaatacaatttaaaaataggtgaaattcagaattaaaaataagtaacgttgaaagaagtttccatgtaacaacccaatacgag

SEQ ID NO: 66715 - DNA, 12815 bp, Oryza sativa
taaagtataataattagtgtaattttatacaatgagttaatctgtaaaatatattacaaccagtcaacaagaacttaattaatatacctcgcgcagtttgagaagttgatcccttgtgtaacggatttgctcagcaggctgaaaacatgaattcccacgctgcagcagatcactacaaaattaatcagcatggcaaaaggtacaaaccacataaaaagttggcaccccgcgtcttgccgcgggttttttagttttatcgttaaacaaaatcgtagttttaaatggttaggtgcaactctgtatatatacaaaatatataataatgtggctttatatatatcttatgttagtataatacaattcatgcttcatttttccaagcgtcattgtgtattgctataatatatgaatattattttcatgtgcaatatgggtattgttgtagttagacaatttgcatctctctgcttcattcaagttttttttatgaaaattgattcaggtaacgataactaataattatatgctatctaatcatgcatagtaaaataaaacacacatctttaacaataatttgagttatgcacaaaatatataacagtgctatgtgtgactatgaggtggagcaaagggaggtgattgtataactaataaatgattgaattggatgaataagtagcttcttgatcaaacggttgttatctttgtactaatgtgatctgatgtcttaaaattgttgatgatgtggcttcttgcatgtcttgctttatagaagtaaatgccctttactaggtatcaactatataagaagataatataacacgagttgcacacataaataatgatgcagtatcaagtattgtctcaagtctcaactcgttttcatgcttggctctcccattggatgagctattgcagctcttgctcctcaaaccactgctatccgaccttactcctgttcatgtctacccttgttatgcactacaagtatatcataggcattggctaatgcttcccactcaaaacatgtttgaattaagccaacaaattgtagtattcgactatcaaacttcaagacagttcagtttgcatggaaattgcctactaggagaaaggggctcttttgtttgagtatgtactgccaaatcgatctcttagtgccaaccgttaggtaagtaattaatggcattaccaatgttttggatgaatagggttataatagcaaccatatagacaatgcaaataattgcatattaacccaaacatttagcaggtctatatttaacatgtcaaatatttcatggtgcaagttcgggatcacaccatatatagaaattaaagcctacaatattttgaacaaaacttacctgaaaatcatctttagatggaacaggttgctcatttaattctccatggtcaaggaccgagtaaatgttcactcccgaggatatttgattggtttggagagagccatcccacttctcatgacctgagcctgaatttggatggtgaaacttgcaattactgccaaatttacagattccgcggttcatgtagtatgagcacaatccagtcccctgcggaattacatatatcatgttttcaccaatcaaattgtaatttatgaaatattgaaatggcagtattaaaggagccatgttgagatgaatgaagaagacaaagagaattaaagcttgctaaaaaaagatcggcttaacataactttgtggtgaaggaaataaccccacaagaaaagatgtacagaaaaacttacaggacgaagtggaagcccaagaaagttcagctttacatgctcagcttcactttttccttcactatggtggcagtggcaagctttccaaggaaaatactgaaaaacactttgtttaagaaaaataatacttccttctaatgacgtaatatttatgcatacattgatttctgaatgtagggatgggccatcgtgcaaaatataaaagaagatttttttacaaaaatgttttgagccgatgcttgtgatttgtaaagaactcgcatttcctccatccttccctttttgttctgactgaattcacagaattgcaaatttagtaactaaactatcgactacaatattatatagtcattttcaagttaccacaatgttagtggacgaaattatcagaaaactgtaactccactacgacctggattactttaaataagaaaattgtcaactgaaaatgtttgatatataccaagcttgtctctatcaaaaagtagtttgacaactttaaatgttcattttatccaaatagatcctagcactccaaacacatattcgggcacgtgaatatcttaatgaaaatgtcttgaaattagacgttataggtttttccgagctcttctaaaactgttatgcaaaccttgttttcatctgattttatatgaaaaatatatcaaacgttgactaatcttttttgaagggaatgttgtccaaacattagcataccggcatgtttacaaacattatatagcatacctgaatatactcccttcattaaaaatatttttcatagatgacgtcatcatgttatgacattatgtttaatcactcattctattcaataaatttataaaaatgttatttattttattttgttgcgacatgttttatcatttaataatgtttaagtaagacttatacttgagcatgtttgcactaattttttaaataagacgaattgaataatcaaacattattctaaaaatcaaccggataagctagagaatatgataaagctagcctatattcaccgagcaaagaaggccctaataacgaacgtaccacttgctgctgaggcaggcggtcgggagggtggttgaacctgcagttcatcccgtacttgcatctcccgaacctcaggtagtggaggcagtcgtgctccccgggccgttgcgggtgctccagcttgtcgcaaccgccggcatgcttcgcagggtggttgtacaggcagcgcatcccgaacttgcagctcccgaactccacgtagtagctgcagtccggcactccgggtcgccgtgggtactcctgcggctcaaccgccgccttcggttccgtctcgccggcgctgctgctggtgccagcaggccgccggtcatccaatgtcttcaccgtgctgctggcatgttgctgcgagggcgtcggcgaaatggcggcgggatcggaggcggaagaggaggtggtggtggccatcggagtggaggaagaacggtggtcgctgttgcaacactcgcagaggatttgcatcatagctcgatctctctgtactatgtctcttggttggaggagttaatttggtttgcttgctgcttgagagagagagaggtggtgatcgaggtagctagagagtggtgcgtgttatagtgagaagaaaagggggcgggaaaggagaaggtagcgtatgtctttcggccaaaatgatgtggcatatgtccttgttccttaacggtggaggactgaaggatgtgcatgcatatgcatgaccagttggtccacttaggcaagcaggtaaaagggaatgggagggaactaaattaagaagcgtatagatcgtaactaactgctgtaactcattaacactctctctgttaatttggcagatatagtttcatatctgtaatagtaattgcgttatggccaactgggactgtctagctctcaatgatcgacctgaaaatccatacaaatttcagtcacttttcaaccgtccaggttgctcgaatattcatgcgccagtacccttattttgatgtcttctcttcccctctgtctctctccccaacacgagcgcttcagatcgagcgtactcatcctcgagcgccaccgtctcgcccgttccagcatgccaccaccgggcttgctggctgtacgttaaaagtgcttacgagtaacgaggcccgcgaaaccggccggctcctcctccatctcttcttccctaagccggtggtggcaccattgccctgcatcgccctggtacagattggttatttggttaacgattgatactatagttcaggtagctccataaaaaaaatcgtaccatgattttatatttaattcaaaaataaaaatttgaataatccttttgctaaagcagagaaattttgaaatttttgagcagaatcagataatagaatatatgaaaactagtgaatctttaatataatatctagaaattttggtccaaaatattgaaacctacatcctaatgtaccaataaaagtgtgtagcaaccggcaatcctaagtactgggactatacaagtggaagcaacttgtgcgcaggccttcttctgcattaggaggcactagcaataatatagaacctacatgtcaatatagagtactgcagggatcctgttccagtgaaggttgcctctattcagagttgtcaaggggtggtggcaccctcgttgtggtgggggaggactggaggaggtagtttgtggtaaagaagcgtagggaggttttcacaatatggctgctttccaacagaactaaataaaacatcattttccttcacctccaagataaattgttctaggtaggatgggagagtggtctattctagtcactgatataatatactcgtgtgttgcaatgggccagacccatacaatttgggatgggctaggaaggtcaattgagatggatagggaaggcggattgaggataagcaccggagatggtggttacgaacatgaaggtgtgaaagatacaatgcacggcgatagtaagaagaggtgatggaaggcgaacgactccgcttttaattagtagagatatgcattgggcatcgtttacagtttcaatgacgaaccatcgaagtggttctaatggtccaaaccattataagttagggacaattacgttcttgacactacttttagatgtaattgtgatgttctcctaaaataggtttgtgaattttcctctgcttttttaaaatgaagttgccatataccccaactctggatgaccatttggtaggcctccaataagagattgtgaatattagataaaattaactgagaatatatgaaatgaccattataccttctcattgcactcatattggttgaaatgaccattataccttctcattgcactcatattggttcacctgatccccattcctaaatcaagcctaaccctagatatagtggtaactttggcggctgtgcacgaatgagccagagtgaaagtagaagacgaagtcccccaaaccgcactggtgattgttggcgtaggggatgtagtcatagtagtcgtgcggaagaagccgctagctttatcctaaagggttcaccggtgatcagcagcaggttagcggcgaccttccggttgccacctaccctgctctgggtcagccaaatgttctccctgtaacgcttaactgattggatagggtttagggttttcagggagaagatgatcctggagagatatgatcatcatctgtccacgacatcggtctcccctataaatatggcgctgagggagaccgggcgcaatccaaaatatggaaggttttggcgctaccgatcaacgtgcatcattaaagaaactaatagtgatttggaatgagtagattacgcgggcatggggtgaaaattaaccacgcgtgatctcctccggttttcttgtcgagagatcaaattttgccagcaatatatccatggcttgcttatggggagcacagtgaaaaattaagttattaaggaagaccaacgcaaactttggtagcaaaagggcccgtatacatgccccaccacaggagacaaagtgaaaacaaatggaaaaaagaaggcaacacacgaaaagtgcttttgaaccaaaccgatttccttttcactcttgtatttccttaacgcccaaggacaagctaacttcaggctttcttctttgcagatggctgagccaaagcacacggttgagcagtggaaatctctcctcattgtatttttttactactacctccatctcataatatttgtatttataggattcaaatttatcccaaaataattatcataatagagtactaattatcatattagtcacttctcgtttaagtttattgctattttgccctagtcattgttccactcttatctatacatcatttaaggaaaaatttgctacaggacactccaaaaatatgtaattagctgtaggacataaaaaaacatgaatttgcccgaaaacactccgaaagtatggtaatttgctgcagtataccgaacgcattaaaatataatattcacccaattgacgagagagaaaccatacaaaataacatatttgcccttcttcttccgacgctcacttgcagcgagctccattggcttgcccatggcggacaaccgctcagtgtagtcgacggcgcggtcgtgcggcatgccactgtcaccggcctcgtccttaccaccaagtccccacctgaccgcgagcgcgtcaccgagctcatctcccgcttccgtggcgccacaagctctggtggtctcctcgagacgttgcacgagctcagggacgtggccgctgtgagcgagcctaacaggaagctcctcacggccgtccccggcacggtggagtgctggagtgatcgattgacaatagcaaagattcacatatataggaactatccattttctgctgatggagtgatggctggttttgcttgacttgttgcttgctgagttgctgctgcacctgcaccgctatggcgccatgcgaccttggctggtttgccattgcctgctagcttgccaactaccatgccactgccgccgccaggaacccggcggcctcacccctcctagccttcgcctgccctcctgcatgccgcgccggctctaggctccacagcagccgccgttcatcgatggggtgacgaggatttgggtcgtgtcacgtcctgataaattcatcccgaaataaaaatcattttctaaaagaaataatagaattaattaaaattcgaaaagaaattagcaaacactaaaatacgtacaagaaaaattcgaatgtggcccggagaatttttgttaaattctccttggtctaaaatgagccctcaaattttacttgaattttcagagcaccggaaatatttattaagcaacaacaacaattatcaaagtttattaaaaagaaaaacctaaaaataatcctccttcctcctttgggccaagtcctccctctctctctccctcggcccgcggcccaagtgctctcttcctccctctctttctctccctctccttctctccctccttctcttgggcctccccttcctctcccggcccactcccttttcctcccctcccgcctgggccacctcctggcccaagccgccccacctagccgccccagcctcccgagccgcccccccccctcacgcgcgccgcacgcgcgctaaccgcgcgccccgcgtgggtcccacgcgccgggtcgtcgtcctcctcccgcccggcctccttcctctctctcccgtgaaccctagctcctttcctccctcaaatccgtgcgatttactcatgggattccaaaattaaatagggggaattaatccccattgattcctctttgattccccccaatttccccttgattcgtgtcctctaacgcccggaacggccgcgccattcccggccgccttccatggccgccggccgtgtttcccgtcgccgttccgccctctcccatgcccggctccctcccccatcctataaaatggaaccccctcactccgttctatcattttagccccctcccgcgctctcccgtggcctcaccacctctccccgccatcctcctctctctcccgtgccgccggccgcctccagccgcctctcccttctcgccggagcgccgtccggtcgcgccgtcgccaccagcagcctcgcagccgcctcctctcccccgggccgtcctccgtttagcgtggagagcaccggaggcgcgttcccgccggcgttcagtggcgtcgccgccactacaccgtctccggccggctcctgttcgtcgccggtacgccgatcgatgcctccgtctcctccttcgataccacggcatcgtctccttccccggccactcctcggtttcgccggaacaccgccgtgccgcgccggcctctccatccacctcgccggaatttccccggtcggcccttcctccacccgtgcaccgtcggccgcgccaccaccacctccggcatcgcagcggcgagccggtgacgtcgtcctcggcatcgcctcctctccatcctcgtcgttgccgacgtcccttcggtcggccgctcctcctcgccggctcctcgtctcgttgtgccgccaccgtcgtgggcatcgctgcggcgtgtcccacgccggcctcacctctgtgcagctgccgccggctgccatcgtcgtctcctcgccggccccggtcgtcatcgttgtcgtcctctcgtcgttcccggtcgtcgtggcgttcgtccctctgtcaagccgttctcgtccatcgtccgcgtccgtcaagtgtgccgctgcagccccgtcgtcttcttcgtcctcgcctccgcgtcatcaagccctgcgccggccgcgtctcgccttcgtccaaggatcgccgccgaagtcgttccctcgccgttcgcctccgtcgtccccgagccgtctccgccgcgctcgttcgtctttgtcgttcccacgcctcgtcgcgtggtggtaaggatctctccctcgtcgccctcgtcctcgtcctttcggtgtcgccccgtacccgttgtgcggctgtcgaccccggtacccgtgtaccggtgtcggtagtcgttcgcttgtgcgtgtggagaccgtgttagtgtgcccgctcggtagccacgtggtttccacgtgtgcagcccgcgtggtgtctggtggagtccgtttgtcggctactcgcctcagttgatacacggggtccgctttcgtcgacccgcggaccgtctctgtgtacccggtccaccgtggtcccttaggttgacatgtggagtctgcatgtcaacaagcgcagccttcctgtcttttccaggttagcgcttacacatgttttataattgcaaaacctaatcacaataatctgtaaatcttcatataacagcattaaacttcggatgatcatatcttggtcatgcgaactctgaatcgacccgttcaagtctcctaatgtttgttataaccttaagaaccctgtgctttctttttatgtatcgttattacttctttataggcttgtagctttgcttgtgtgcttcgcgtagcttctgtcgttccggaggttcctgaagcgtggtttgcggttgtcgccgaaggttcggaaggccgttctctctgagtaaggtaaatcacatcatcctttagcatattgaatcctagtttgtaaaattattttgatttaaattaatgcattatcgctttatttaaattcccgcgttatcactgttttatttagccatgcctatttacctttgttatgaccttattattattgctattgtttattattaccttgttcaccctaggaaaataaaaccccaactagtgggtactctattcatggttccactagtatgaatttaggtagatgctcgctgaataattaggcaacattaggtggttttataactttagactttagggatgctcatatcatttggacactgtggaatggttggcttgtgatggaattgaacacacacctccccctctattcaaaactcccaaaatggttttaggctgagctcgaggtgcagggttttgttagtagcacctcggccactataaggaccggtcttcgggcctctgttgcaaagcactaccgtactaaccacatgtctaatgggtaaggcttaactcggtgctcagtctagtcctgaacaaaaggacacggatagagatggatgaagtcgttgcgacgatggatatctctaaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaatcctagcctgcctgtcccgggataccggcagtaggcagggttgggtcggtacttttgttcacggctaggatgggtgaagggttatgtcacatgtttacgatgggttccaaggccatggaacgggagtaaagatgtgtcttgtgggtaaagatgtacacatctgatcagagtaaatctattcgaatagccgagccatcggatatgggcaagcctagcaatgtacccaagttagtggtttaattcttaaaatttgcttaacaactaaaatgtggaaaggttggcctgggttggcttgggacgagctgggacccaggtcgggttgccaattcggtctgaatcatcgtaggccttgggttaaggcaagttcgtgtaggttcacgtccttgattaataatattgtgtagctcttggatcgtgtttacaaaatagctttgggcaactaagtgacttttaaatgctgtttactgtaaaacctaacccctattattatccccttgtacccccttgcattaatcatgcatctgctggtgtggcttgctgagtacggtggttgtactcattcttgctcaatctttccccccttcagtcagagaagctttggagaagaagtcttagatggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgtcttttatatcatgtttgtgtggtgtaccccggcttttcctgggacggggattaatacactagcgttcgggaaaatgaaaattttctcggtcgcgacaggtcggccggtcggggatggattggggaatcaatggaggattgggagaagaagaattgcaaaacggtcattttgtgtggtttctctctcatcaattgagcggatattatattttaatgcgtctagtgtactgcagcaaattaccatacttttggagagttctctggcaaattcatgttttttatgtccgatagctaattacgtattttttgagtgtcctgtacaatcatttaatgaggagcaccatagtatttcttctcaaaccttaatatatgctaaacaatctagaattactattattttagaatctagaattactattattttagaatggaggtagtaatacattatattgcaaattctcttaagtcataccatgaacaaattaaattttccttcacactaaagattaaattcataacaatgaacattatatattaaaaaaaattgattgagttgaaagttctcaaaaaattttagttgaaagttttaagatgagttgaaaaggagaaaagagaggagagggatgatatagaatgaccgggaaaaaagaaaaggagaaatagaaaacgtaacaaacaagagaaaaaaagacaccaataagaagagggagaggggcatgcgagacgaggcgatagaatggtgtgggtcgattgggttgggttgtgttcgaaacgcctaattggtgaacagtcgcgcgcctccctctccgcgcggcgaggccatgtggcgtgcgtggagagggggcggcggaacggcgcgggagggaggggtccaggtacgatttttttcattttttctgttttttttcttccgtacgtttcagttttcgttctttctttctttctgtttgtttctttccgtattttttttcagttctttttcgttttttaatacgttcttgaatacatactttgtatacatatattttttagtttgtatacatacgtatacaaatttatatacacgtattttttggtgctttcatacgtacgcacacaaactatatatacatgtgtatattttctatacattaaaatgtatacatataaaacaatatatatctatacatacgtatgtatatactgtatataagtacatataaactttgtatatacgtatacaaagtttatatgtatgtatatacatatacatatagcagtatagtagtaagagagactagaggggggcagctgattgcgcgcgcgactagtcgggggtcagcgccccctggttgtgttgggctgggaatagggtgtatagtagttattctaaagtcatacgagtgatatgaaaccaacttaaacacagatgacgtattaaaaattcggtaaaaatactatcactttttataatagttgagataaagatagtgataggttaatatgatgataaagatcctcatggaattgctaaaactaatttaaatctcagcgtttcactgatcaacctaatttaggtcgggccaatgtctatcaaccaatctaagctgtgttcgcatgagtgggatgggaacatattccctccgcacggaaaacggaacgatccattagcgcgttattaattaagtattagttattttttttagaaaatggattactttgatttttttaagcaacttccgtatagaaactttttgcaaaaaacacaccgtttagccgtttgaaaagcgtgcacgcgggaaacgatggagagggagttgggaacaagggcttgcaacacacagtttacgtacatctctgcatcccagtccaccacctccacttgaggctactggcgatgaattcatcctcatcc

SEQ ID NO: 66716 - DNA, 6665 bp, Oryza sativa
tctggcgccccaaaaaagaccatttctgggataagttttttcaggggtctatttgcgaaataagttttttaaaaggaccaaaatgtgaaaaatccagctctcgtagaactccacgattttgggttttggtaatttgctctgcgtcacatataattggttatgtcgccacttgagctagttgcagagttgagaatgagagtgctgagggagggacctctggagtactgcatgacatatggtcccatagatcatcgttgtcttgcatgtcaatctgtagtatgtattgcatgtgcagtactacagaggatctgaattggagagtgctgcgtgcattgaactactgatatgtgcgaatggcaaggggcaacgttgtagcgggtacgctttcctaattaagaaaaggccaggtcaagtggtctgcatttttcatgataaaatttcacagaacttccagcctcattgcttgcccatatttcctgataagtcaaaatggctgcccatattccctgataagtcaaaatggcttattagaaaataaaaaataatttataggtaaatcttttatatatttgtttataacaacttaaaagtcagtgctaaaagaaaattatatatgttgaaaatatcttaaaatcaacttcatatgcaagtttaaaaatttaaattttagctatcgctttaatttattaggccaaccgttggtgctcttcatattttagggcactagttactttcacaaaaccctatattttgaggcttgtttcagcagaagaatcaatcctgtcaattctactgtcaacacgtggttacagtctgccccaagacacgtgtggttcactaaaacaaacctcgaagtatatgattttgtgaaaccaattacaattaaaatttactcatttttcatgccgcataaaagacgacaacacatacataataggccacaaataaacttccgtgataaatcgcttgcaaattcacactgaagcacgggagtatatatgaactccaagatttctgtaccgtcatggataaagtcatacacgcattaactctatatcataaaaagagtttcccaccgaattaagtatagtttaactggttaggtttcttacgttgaaactagtctatccggattcaaatcctatatttgacacgggtacttctattaagggctaattattatttcaatggtagacgacgtatctgtcgacagtgagatacttgtgatgacttcgtcaaacccaaaatataccgatccagtctttcagtggtgttcataagtgtgtaaggtgcagggtgtgcgtctgtgcgttcattacgaacaggggcggattcaacgtgggtgggtggggggggcttgagtccctcctacaaccaccagactcatggataccccccgagtcccccctcaattttttttgtcatggttggtaagatagaagttgttaaaggtctcttaatagcgttttagcacaatttaatactgagatgatgtgtttatactggtgtactagcatgttgagtatcctaatcttttgtttctgatccacccctgattacgaagagtgtacgtacgttatgaacggctgtgtttgtattttctaaagaaaaaaaagagctggccaataaaagcaagtgaccgtggcggctgtcagtgcacaaacatgtgcaatatgcaatgtgacgtactacgtggccgtgcttctaccagacaaacggagccgcaccgcacgaagaataggcaacggccgcgaaaacgcatgtggtttcctttcactgtccaagccctcccatgcatgcatgtgtccgtggcacattggtcagctgaaacataggcccacacgagaatgatggtgcctgcatattttagtaccagtggcctcattggttcccctaaagcgaaactatattaaaaatatcttaaaaccaacttcaaaaatatattttaaatttgaaattttggctttagcttatctttttttaagcatagccgatggggctattaagagtaacagggaatgcgtgatggtatttctctgaaattgtccgggagcatgcatggtgtggactctggagactggagtggatatctaagccatagctaggctttggcctttgcccgatcctagctagtggctgctggtgacgatcgatataggccattatctcctatcacgaattcaggataggcagtagtgctctagtactactccggtttactatctccatcctactagtgcgtaccaattggagccaagccagctattgctatctatcattaatactccttcacgtttgcgtccatctcgatcaccctacagaatataatgcatatacggagaattttctcgtgcttttcatttggcttcaccgtgagcaggacatgacacaaaaattaaccgtgcgcggtgtccagacctttggtccgccgcgcttgccgatcggtcggcgtgttacgggaaaacggacacggtgcgtgtgtgaatgagcgttgtggtggcttgcgcgcaaacgcacaaaaccgtggttccgaaggatattagttcatccgtgtcataaatatgtttatcagtatcaggatgttagttatatttagaacataatattataatatacaggtaagtagtttaattattggttattaaaaatcgtcggtgttgtatgacactgacacaaccactatggatgatccgaccgaaacaaggaggcgccgagcgacgcgcggcctttgtgcagccggatgcaatgcggcgcgcgtacgtcacacgaaccgccgagcgcaacggccggtgtctgggtggcggagcagagtgaatgagtgatgggtggaaagcaaagcgcgcggtgccacgccatgacgcggacggaatttcaggtttgggatgagatgggaaggacagtgagtggtgtgatgtggtgtggtgcggcgttggatatgtttcttttcttttccttttttatgtatcagctcgatctcttttcactgctaataatgcagatcaatcagcatgggtgtaagtgtgcaagggcgtagacgagcaatagtggcgacaggtcatgtgtaccgtcaagctcgctgctgccttttccgtctttttctcatgctgtgtttgtcaccgtgcgcgtccaccactttagtccgtgtggctctgttccgatgtgcatcagttcatgcatgagtgcacggatcacggatgcacctatcgatcccaggtatagccgccgtataccagttcctacttcctagtgcaaaatcatcataccggggtccatctcattctcatgcaccaatgcaatcagtctactattgcagtagtacgtgctcttcgtctgtctatagatatatattgctcccaaagttgcatgtcgctgttgatgccgtcggctgtcggggatccagccgagccgagccggcgccaagccccttggcgtcctcgccggacggcggggcgcgctctggtgattgggcgcaagcatggatggcgcgcggattgcgtcgggcagtgaagcgcgggagcggaggacgaggagatttcgaattaaatttttaaatatacattatttttctcaattttgtgtatacgtacatacatgcttctaaaaattttacagaaatatacgtcttccgctggttggggacgcggaaccgcgctgtcgacgcggctcgaagacgtgggatcgactggagggggcggttccgcagcttcaacacgtgtgaccgggacggtcccgcgccgagataatgcggcaccgctcaacccgcgactaggccgtgtggcaccaacgcggtaccgatgggagcggacgggagtgacggcggaatgcgtcagactaggtcacggtcccgcggaatggttaagcgggtccgccaaatgcaaacgatcaaacacataatcaaataaacttttgttcgtaatgctgctaatgcatgtgtaatgtgctatatatgctaatatgcatcactgtgctacactgatcaagcggcggtggcgctgactgatgacgcgggaacgcccgcggtgccgcatgcctgttctgcgccaccgccaagcggtggcaggcatgcacccgagcagcggccggtgcggcggccgatgcggtgccgcaccgccccggcgcgggaccgccccagtcacgcatgttggctggaggaggcggtgccgcatcaccagcctgcgggagacgtatatttatgtaattttttgacgtatatttatgtaattttttcaaacacatgtatatatatacaaaatcgaaaaaaaataatgtatattttaaaatttaattccgtggatttcgtggagagacaaccgtgcgcggtggaacgcgtccggcggcggcatctcgatctccgtacttcaatctcggaacaagctgggaggctgggacggaccagattggattttgtgggcctagttgttccgctggcacgaggccccgtgccgtaatactgggcttcgtcaaaagcccgttgtatttacggatggaataagttcactttgactccctttaaagtgatccgaatctaatgcatgaccctcgaccgcaaaaccagataggatgactccctgaacaatttgacagcggttttggacggcggttttattgacgtggtgatgttgacctagtattttttttgaatgacgaatggggcccacatagttttttattttaatgcctcctaagcgtgacgtcaacaccacagaccaagtcaacatcgccacgtcagtgccatgtcagcaaaaccgtcgtccaaaaccccaaaggaattcaaattgcactggtttgaatagttcggggggtcataccggttgtgcggttgagggtcacggattaaattcaggtcactttttaagggagttaaagtgggactggttcctttacggacacgggacataggcgagttttgggccatatagatggcccgcataggatctctatcggtaccaggctgacttctccagcccgtacggtcaagaagcggcccaagtaaccagggtcacgtaggcggcaggccagctggccattccagatagacaccgacggtgaaaagaacggcttgactcggttgcgttgcagcctgcgtttttccactttgaaccttcgtgctctcgcccgtcgcgtctgactggttactattactcgtatatacgtaatacctccgtattttaatatatgatgccgttgacttttcgactaaaccattcgttttattcaaaaattttatgtaaatataaaaatatttatgtcatgcttaaaaaatatttgatgacaaattaagtcataataaaataaatgataattacataaattttttaaataagacgaatagtcaaacgttagacaaaaaatcaacggcgtcatacattaaaattaaaatatggaggtatatacgtcatacgtatattgtacctgctggattggtcattggcaacgcgttactacatcttaccacatgattacttataccccgtgccgccgtgcgtacgtgcgtgccgttgaaccgttccggttaatcgatcagctgcttctcacaatcaaaattctccgcggtctagttgtctatagttataatcgccgtgtcgccggctcacacgtactatgcgcacaagtagcacaagtacaacgacacggtctttgcgacgagcgaattggctgcaggatgcagggggtatcctccgccgctcgtggcgttgacggcggctcgctcgcgggtgaggatttgttacctcttcccagaaatcgcctgacccacccgcaccgacaacacatggaacgtgcgtgatcagcaacccctttttttctgggaggaggtagagaacgtgaccagcaatcttgggagtgagaactggatgctgtgtactagtactaatctcggatacttggccttgtgaacaggctagctaattggtctcgattgcgctttggttagactggttaaaacggttgacacttacactaacccgtaaacatacaataatttcagaacattctaacggaattcaccatgagaagagaaacagagggaggcgggggtttgaattgaaaaaacacggtcgcatttgggagcgggcgttcgcgtcggctcggctcggccgcatccacggaatcaaatcaatccaacgagcgagcgagcgaacgaaccaaccccttcttcgcctcggcttcgcttccccgtcttttccttccgcctcaccaacctcgtctcgtctcgtctcgtctcgcctctcgatccttccaccccacgccgccctctgccatcatcgtcgtcatcccatccggattgccacccaaccaatcgccatttgcttctcgctttccctctcctcccccaaccactccatcatcattcgcaatccaatctcgctcttggttggcgtcgattttgacgcggtctggttcgtgaatccgacggagccgggtgatctgcggcgggacttgcagatccgagcgggcggggcggggcgggttcgctcgtcggatgtgtggatcctggtgaggtgaggcgatgccgggcgtcggcgtgaagatctacagcgtcttcttcaagttcctcctccgccacaagctccagtcgctcgccgcggcggctgcggcggcggcggcgggaggggaagaccacgcggcggcgttcggggtctcctgccgcgcggacgaggccacgg

SEQ ID NO: 66717 - DNA, 24187 bp, Oryza sativa
ggcggggctccggccgccggcgggcggctgggccgcgcccatcgttcatggcgaccggcggcggcattctttttttttaatttgtgatgattcactgagatgtatttgactgagaagttacaaatttgtgattcattgtttggatctgtgatgtatttgagtaatttcttaggatattgtgatgtatttgatttgtgagtataaataactttatgatttgtgatgtggatttggtgatgtgaatttgggatgttagttagatttggggattgatttggggatttgcctacttgattcgggagaaaatgaaaaggaaaaaagaaaaagaaaaagggaccatttgcactgccgctattgtctctttagtcccggttggtaacatcaaccgggactaaagatcccctctctttagtcccggttggtggtaccaacggggactaaaatacatctttagtcccggttatttcaaccggtccatctttagtcccggattcttactcccggttggagaaccgggattaaaggggttcccaaccgagagtaaagatggtttctccaccaatgctcattgcaacgcatggacatatcgaccctaaaaataggaaataaaaaaattctatttttcttccgtcctccgactccagtgcaagccatgagctttccgatgggaagtgcgcagccagtttcatcatccgccacgcctagctctaactcgatctgttttttctaagtacatagggaatataaatagaggctatataccctagatttttttctaaatcctgcactcctcccgcacctctcagctctctcccgcacttctcccctcccctcacctagctctcctcctctccccggtgctgacagcggcggagggcgtgcggcggctaccggtggaggaggcggcggcggctaccgggggccaccggcgctcccctttctcgctccttcccagatctggcctgaggggggcgggggtaggacggtggccacacgtgtggcggtggcggcggcggcggcgggaggttgccagcggagggccgcgactaccgacgggaggcggaggttggcggcgggtggtggcggaggagggcggcggccgctcccggaccctccctccctcccagatctggcccgaggggggcgtggggagggcagtggccggcggcgctcccctccctcgctccctcccagatctggcctaaggggggtggggggagggcggtggccacgtgtgcggcagcggcagcggcgggaggttggcggtggcaggaggaagggggccgtgcgcggcggcgtcagaggaggtggaaccaatggcctggtcggcatctcggcatgcgcaaggaggaggaagcggcggttctgggcaccaatcctctcccttccttcgccccagacgtcggtgccggcggcgcaaacagcaccggccgctcccttcccagatctggacggaagaggggagccggctagcagctacggcaaaggcggcgctcccctcgccctcggacagcagcgccggacggaggtggagagccgtcggccggagggggatgccgacgccggcgggtagcaccggatttttcttctgtttcctcgctttattttcgcagtcaggccgcggacccgtttggattttcgcaggcgttaggatagcggcggatgtctccctcacctacaaaaactgtttttggccgctgtaaaaactatttttctaagtagtgtacccatctcactggaagcacgagagtcgagtccgactccaacaaaaactagatcggatctccttgcgtcgggcacgcgagcaggagcacggatgccacgctagctccgacgccggccaggagtggtgctggggaggatttttttttattttttttaaatttttaatttttaaaaataaaccatttaaaaacttatttttcaagatctaaaccttttggccacgccagccggactgacatagcaaaacaacattatcacgtcggtctggttgacgtgacaatgctatttagcctcatgggtttggctggcgtggcaccgttatttgatctcatcattctcgttgcgtggcaggataaaattatcacgcccgttgtgtgaccaaaaggttcagattctaaaaataagttttagaatgatttatttttaagatgtaaaataaaaaaagttcaaaaatcgctggggaggcaggctaatgaggtgatgagggcggccaggttgatgaacccgatgagccggacgtactgggtgctatggcagtaacacgatggctcatcctccgggcagagagagagagagagagagagagatcagagagagtccaaggggattgatcggtcatcctctcctccgttctgcagctagcgtgagtagacgaccagacaaattaagttacgattgtgaattaatttgtgattaacgagaagcatcgatcgttcccaattgatccaacgcgttcaagatatattaattgccgccgtgacctaggccctttttgaaagattagcacagggctaatattgagagctaatgtttagtcataaattggtaggataaacattattctagggtggtatgtttggatccatgggctaattcaagactaaaaggtagagagagagagctgctttttgatagtccccacacaaaactagccccattagcaccctttggaggagctaatgttttgaggagggctaattcactttagcctcaaattagcccacctgtttgaatccttaagagctaattcagagctaaaaggtgaggactagtaattagcccatagaaccaaacaagatcctagcaacctatccacctcgccgccggctgccgtgaatacgatcgaggtgagagcagcagccaattgatcagcacaccacgttgtctacttgcctttggctaatttgcctgattggattcgtcaggttagcgtagagccttggaggctacgatgaatatcactgaatcgatcatgcaaccaccagcgcctagcgcgtattgccgaaagatttatattagtttcaattattattaatatgatactgttgtacttttataaccaattcataatttatatgaagttaaccattaacgtgttaatcttttcatttatcagttcatcccagataccatgtcatcaagtgatatgtacaagggtatacgatgaaacaacaaataatatatattaattattactttgatattaatgtctctgtcctaaaatatagttatttctaccacagtgccttgttctaaaataaagctattttttcacctacctcttctcaaccaatcacaaccattcttcttgacatgctttctcttttcactcaatcacacacttcctctaattttctcacatattttcttaatatccgtgtcaactttaaaaatagctatattttagaacggagggagtattaagtgtttccacttttagttttgtcctggccactcaaatctctggattgagactgaacggggctacacacgtgagaaaggaggacgagtagagaggtcgctgctactagacagggaggcgagctcgtcgtggtacggtgacagggtcatcgcggcccacgaagatggtgatggcaccagcaagttagcttgggctgatgaatttttattttattttttttgaacttttttaaatttttattttaaaaataaactcttctaaaacttatttttaaaatttaaaccttgtagccaagtcagcccatctggcgaggaaaaattactatcacgctacttgctgcgggtgtgataatttaatcctaccacggcaaccaggatggtgtggtagtattattttgtcacatcagttcaagtttcatatcttaagtattgaaaaggtttatttcaaaaataaaaaaaatatgggtgactagcagacggtcgagtgtggccatgaaaaaggaggtgaggacgacttgacgggttcctttttccttagatgcattttataagaacctttccgtgcaacatcgttcgaccatgtcagccatcatgactactacatcggcgcgaggcatacatcaaacactaataccaaaacgatttttgtttgcagttgaaagggattttcgcgtgcggatctcacgcccgtctacaacagggtgcctgtgaaaatatgaaacttttcgtgcgggtgacgcaccagcacacgaaaaatcagatttttcgtatgcgggtggcttatgtcgcccacacgcaacaaaaaaaaagacccccaaaaaaataaaataaaaaacataaccctagccgccgccctcctcgtggttgccgctgtcgtcgttgtcgtcgttgtcaccgttggtggcggtgccatcgccaccttccaccgctgcccaccgccggatctgggcgggagaggggcgccgcctctagacccggccgggcgggcgaggggcgccgctgccggtcacggccgcacgcaaggacgcgctagctgccgccgcccgccgccgctcccggccgtcgccagccgcctcgcgcctgttgccccgcgcctgtggagaaagagacgagagagagagataagaaataggataaggacaagtaggtggagaggataagatagaaatttttgaagtagttgagaggaaaaaatacctgaggagggaggggattttcgcgtgcggtactcttaagatgctcgggtcttcacgtaaaaattggcttattttttgcgtgcggacctcttaaggaatcttaaggatccgcacctaaaaataggaggacgatttttccaaactcggtcagttatggaccatccggaatctgacgaggagttcgtccaggaaaatcgtttttatatttgtgaaatgcagacttgtcttgtcggagcaacatctgcttattggactggagaatttaaggaagtaactttcgtcattgtcactatcaccttctcaaacgccgtaacttggttgagtttatgttttggatcaaagttgtcaaactgtagcacatcggagagaagaaaattcagcgaatgagttctgtggctaggcttctgcaattcaaatagataaggataacattgatgtaaactctagagtagaggtacaacatccgacatgaaggggtagcatcacataccttgcgcagagcaatttctaacctttttttttatttcccgttgcaacggacaactgtgtctcgcttacttggcctctgtttctaaataatatttgacgccgttgacttttttaaatatataattattaattttttttctatcatttgattcattgttaaatatacttatatgtatatatatagttttacatatattttacaaaagtttttaaataaggtgaacagttaaacatgtgttaaaaggtcaacggtgtcaaatactccgaccacgacatataaaaagttaaacggtgtcaaacacatgttaaaaagttaaacatgtgttaaacatgtgtcaaatacgtatttagaaacggagggagtagtacgtaggatcttatataactgtctctcttgctctcgtcgagaagggaaggatggtgtccgaccacgacgacggcaagctgccggcgcagtggaagaaggtgtgcgtcgtcggcggcgggatggcggggctggcggcggcgcgcgagctgcggcgagagggcctcgacgtgacggtgctcgagcagcgcggcggcgtcggcgggcagtggctgtacgacgcggcgaccgacgccggcgacccgctcggcatggccggcgtgcacagcagcgtgttcgcctcgctccgtctcaatagcccgagggagtccataggcttctccgacttcccgttccgccccaccaacgacgccggcggcgacgcgcggcggtaccccgtccacggcgagctcctcaggtacatcagggacttctgcgacgcgttcggcctcatggacgccgtcaggctcaacaccacggtcacgcgcgtcgccatggcaccgccgcggcgcgacgggtcgctgcggtgggcggtgaggagcaagcgccacggcgaggcggagacagaggaggtgttcgacgccgtcgtggtggccatcgggcactactcgcagccaaggctcccgaccgtcgacgggatggataggtggaggaggaaacagctccattcccactcgtaccgcgtcccggactccttcgccggcgaggtcgtcgtcatcgttgggtgcagcgtgagcggcgcagagctcgcgcttgagctccgccgcgtcgccaaggaggtccacctcagcaccaagtcgacggaggagaccatcacgtcggcgatgtccaaaagtgtcgccaggtacgaaaacctccacctgcgaccacaggtcgaacacctgcgcgaggacgggactgtggtgttcgacgacggctcgttcgtcgtcgccgacgctgtcatctactgcaccgggtacaactactcgttcccgttcctggacacgaacgggaaggtcaccgtcgacgacaaccgcgtcgggccgctgtacgagcacgtgttcccgccggagctggcgccgtcgctgtcgttcgtgggcatcccagccaaggtgcttctgccggtgttcatcgaggtgcaggcgaggtgggtggcgcaggtgctgtccgggcggaggacgctgccgtcgcaggaggagatgcagcgcgccgtcgaggagcacagccgcggcatggaggccgccggcttgccgaagcggtggacgcatgacatgttcttggacctggaacgctgcgacgactccggcgagcgcacctgcggcttcccgcggatggagcagtggaagaaggagatctttttctcgtccctctccgacatggtcgacgacatggagagcttccgcgacggctaccacgacagtgacctcgtccgcgacggcctgcgccggcacggctggactcccgtcgcgccgcggccgcaggaggaggacgacgacgcaaaagcaattggagtggcgaacatataacaaaaattaccgggtgcaatacgtactccctccttccctaaatatttaacgccattgactttttaaaacatgtttgactgttcgtcttattcaaaaacttttgtgaaatgtgtaaaactatatgtatacataaaagtatatttaacaataaatcaaatgataggaaaagaattaataattacttaaattttttaaataagacgaacggtcaaaacatgttttaaaaagtcaacggcgtcaaatattttggaatggagggagtagtaattactctctccgtttcgaaatgtttgacaccattgacattttagcacatgtttgaccgttcgttttatttaaaaattttgtgaaatatataaaattatttgcctacataaaaatgactttttagcacatgtttgaccgttcgtcttatttaaaaattttgtgaaatatataaaattatttgcctacataaaaatatatttaacaataaatcaaatgataggaaaagaattaataattacttaaattttttgaataagacgaatagtcaaacatgtactaaaaagtcaacggcgtcaaacatttcgaaacggagggattatctaattattagttagtatattaattaaaatggcacattttagttatgattggataaaatatctaggatcctgtgattgaacgtggaagcgccactgcttattagactccaataatttctgcttaagcctaaggaaacaaaataaatacacggtaattcgaaaagaagtgctggcctgtctgtatcaagaggattttttttttgacaccaggtaatacaccttcattaaccaggggctctaggcaaatcgccagaatccagctggtggaatacaagctcagggacttggttgacatgcactgtgagagttaacagaactcaccccatacttagctaggcagtcatccactttcttgcaagacctcggacaataccaaatgagacagctaacgaaatgagaggaaacaaagacttttatttggcgaaataagcatccatcttgatgacgatcaaagtccgccgatgtggcgatgtgagagcacgtacgctgcagttctgtggcatccgtctccagtatgattcttgtcatcccaagctgcacaactttctcgatactgtggagcgccgcggtagcctcagcctacaacggtgttcgtacgtactcacatcaaaagatgcatcagtgttgatcttatatgtataaatagcagtgggggtctgagcatactaggtagagttacagtccctcctcccatctgcatatggtaaaaaattttagtggggtcttcgtggggtctctcatagttttcacgtcagtagtgggggctcgaaactccgctgccccatgctggatccgccactgcggccggtggcgattcccatttttcattcatcatcatacgtggagctcgatccaactgcagtttttcaaggtccattgtatggtaaatgatggcatcacacacctctgaacccgtgagcttcttgtcatccgcattggccttattccctgcataccaccactcaagaggatttttcattgtactcaaaactgaacctttttagttttgttcagtttatccaattactgctagtagtttatttctccgagggggtgtaccataatgtaataatctgttcgatcattgaatgcaaactaattaagcatttacaaattagtataactaacttttttatgacataaacgatttacatctgttagtataactgaatatatatcatatttgtagtcgatcgtgtatatgaccatatatatatctaactaaaaaatacggaaggattcggtacttttttggtttgtctttttttcgttggtttctttttgcccgatcgcttccaggttttctgtccatctggtttttctcaaccgatccgttgcacgcacgcatagcgcgcctcccgtcatgggctcatggccacgtcaatatgtcttcacgtgtgttttctcctttaattgactacaaaaatcgattctcactttcccttatcattttcctcatgatttaccctaatagcgatcatagtgcttcactttatcgctaagctcctaccaactattgtatcactgaaaaaatatctttaactgttgcaacgcatgggtatttttttctagtgtatttaaaaggattgtatttgttctttctgaagtatttaaaatggatgatgtaatcttatcttcttcatgtagctggtgttgagtagtttctttgtcgagggataactatgtctagtcaattctaacatttatcttccccgcaaaaaaaaaattctaacatttatcttagcaatatgttattatgatttgtctgtgcagaactgcagatatgggttcatttgcactaaagaaaaattaaaccactcctgcatgacattaggtagcagcatcttcttgttggaagacgactgctaatacagtagtcaagatgcgagtattaagtttatgacctcagaaggtcaagatgcaaatgttactaaacaattaaagaaagcagttgagcaatgggatgttccaagattaaagaaaggtgattactactcctttgaagagcatcttatattaactttgtgttgtaaaaaaatgatgagcaggtaaggcatctctgactctacatgagagcacatactttggtcattaatggtgattataatgatatattctgtatttattgtttgctgcattcagtttgattggttgctttgttcagagctgtttctaccaaatccattcaagttgaaacatctccaaaaaaaaatcaattttaaacggactgggagctgtccatgctgacccatgttgctctgtacaagctttatttaaatgtgctgcaaatttgattgcaattccatcacgatggcatcctgcaagaaggtgtgcgtgatcggcgccggtgtgtctggcctcgccgccgcgcgcgagctgcggcgagagggcctcgacgtgacggtgctcgagcagcgcggcggcgtcggcgggcagtggctgtacgacacggcgaccgacgccggcgacccgctcggcgtggccggcgtgcacagcagcatgtacgcgtcgctccgcctcatcaccccgagggaggtgatgggcttctccgacttcccgttccgcccaggcaaggacggcgactccggcgccggcgaggtcgacgcgcggcggttccccggccacgccgagttcctcaggtacatcagggagttatgcgacgtgttcggcctcatggacgccgttcggctcaacacggcggtcacgcgcgtcgccatggcgccgccgcggcgcgacggctcgctgcggtgggcggtgaggagcaaacaccacggcgaggcggagacggaggaggtgttcgacgccgtcgtcgtggcgtccggccacttctgccagccaaggctcccgaccatcgacgggatggacaggtggaggaggaggcagctgcattcccattcctaccgcgtcccggacgccttccatggcgaggtggtggtgatcgtgggctgcggcatcagcagcaaggacatcgggctagagctccgccgcgtcgccaaggaggtgcacctgagcgcaaagtcgccggaggaggccatgacgccggcgatgtccaagattctcgccaggtacgacaaccttcacctccacccacagatcgaacacctgcgcgaggacgggacggtggtgttcgtcgacggcacatgcgtcgtcgccgacgccgtcgtctactgcaccggcaacacctactcgtacccgttcctggacacggacggcaaggtcaccgtcgacgacaaccgcgtcgggccgctgttcgaccacgtgttcccgccggcgctcgcgccgtcgctgtcgttcgtggggatcccggccatggtggtggtgccgctgttcaacgaggtgcaggcgaggtgggtggcgcaggtgctgtccgggcggagggcgctgccgtcgccggaggagatggcgcgcgccgcggaggagtacaaccgcggcagggaggccgccggcgtggcgaagcggcggacgcacgacatcctggacctggagtactgcgacgactacggcgagcgcaactgcggcttcccgcggctggaggcgtggaagaaggagctcatgtggtcttcctacctcaccatgtgcgacaacctcgagaccttccgcgacgactaccatgacagcgacctcgtcgccgacggcctgaggctgcacggctggatctcaccggcgacgacgctgacgcagcagggcgacgatgacaaacggccccatcttttatgagaaattccggcttattaccaacttaaaataatagtttgcgaataaaatttttatatatgtgtttttagctatttaaaaataaataatataaaataaactataatgaaaaaaaatcataaaatcaacttccacattaaatttgaaattcaaattttgacgtataagtataagcataaactaaatgatggggctcaaagatgttggctaaaagtgaacggaaatgagttgagctgggtgtacgtgagtgtgcgtgtgttatgagcgtctgcgttttttttttaaaaaaagcacaatatttagcaggaaaaggcactcgattctaatcagttcagcttagcattattgaaagaaaaaggagggaatgtataagtatattaaataatgcaacgcaacacataggaagtataagcataaactaaatgatggggctcaaagatgttggctaaaagtgaacggaaatgagttgagctgggtgtacgtgagtgtgcgtgtgttatgagcgtctgcgtttttttttttaaaaaaagcacaatatttagcaggaaaaggcactcgattctaatcagttcagcttagcattattgaaagaaaaaggagggaatgtataagtatattaaataatgcaacgcaacccataggatacagtctcaaaatgttgaaaggttatgtatgatcgatcttttcacaagatcaactttatctcgagatagaacaatacgaaaatttacgcatggttctactattactatatagtactaattcataaccggagtatatgtcagaaactgagacgatttaacaagattcaaatttcaaaatagatcaggttcagtgattcacacaccaacatcaacatacagtgcaaactctggctgcacatacgcacgatgtcgttgttttttatttgtttgttgttcttgtttgtgtactgtactgatgggctggccatctagagataggtctaatcacattggcaccataccaaacctgagctcacgtgctgacaaccagaggtgaaaaaggatcggattcgaatggatagtagtcatactatctcctgaaccattattttgtagtagatttggagcgggtgtggatggtatatggatgtggagagaatcatttcggatttctaaaacaatgcaaagccaatgtaggctcaactcataaatggattaaaatcatcggatatgacgtctatattcaatcaatgtaacattaagtcatcaattcaacaggcaacaatataataacaatatcctaagcatttaataataacatcacacaacatatcgatataggacagctggtatcacattttaggtgtcatggtggatgaacaagaaatcaaattctaacttactattgatatatttttctaaaatgaaatctcgatgtctaatcgctaaacttttaaatcctaaatccaagacttaaaaaaagatccaaatagagtggatgagctaaggaaattatcccaaaatttactgaatgggttgtctgatgtgaaatggaccaaatagagtggttacaagatatgggccaagaaaatcgcattgtttaccaaaccctccaccacataatctgcttagaatatcgaataatctgcatccatcgcatatcatcggtatcacatccggcttcgtatccgcatgctaccattcaaatccaactctatatgcaccaaatatctatgaactcttatcatatccttgcttcgggaggatttggagcgaataatatcgtctctgttttgacctttattgacaactaaaaatgggctctaacaaaatatcagggaaattgtagctacattagcatgatggcacacattcgtgtagaggcatagtttcaatgtccaatgatggcgcatgatatgattaaataatcatcatgtgctaagcttgcccccattaaatagtcacgtcgttccaaggatactttatatatatgcatgtttatttaaataatactatttcttagggcaaaatgagcttttgttagattaaagcaggatttgcaatatttgctttgtatccgcatgctaccattcacatccaactctatatccatcaaatatctatctatgaactcttatcatatccttggttcaggaggattcgtcagttttgacccttactaacaactaaaaatgggctctgacaaaatctcagagaaatggtagctacattagcctgatgacacacgttcgtgtagaggcatagtttcaatgtccaatgatggcgcatgatatgattaaataatcatcatgtgctaagcttgcccccattaaatagtcacgtcgttccaaggatactttatatatctgcatgtttatttaaataatactatttcttagggcaaaatgagcttttgttagattaaagcaggatttgcaatatttgcttcgtatccgcatgctaccattcacatccaactctatatccatcaaatatctatctatgaactcttatcatatccttggttcaggaggattcgtcagttttgacccttactaacaactaaaaatgggctctgacaaaatctcagagaaatggtagctacattagcctgatgacacacgttcgtgtagaggcatagtttcaatgttcaatgatggcgcatgatatgattaaataatcatcatgtgctaatcttgccccgattaaatagtcacgttccgagggtatatacgtgtgatcaggaataatagccagagtcacacccttttgacaatgatcttgcaacaatatatacatttttataatataatagaaataaattacatctccgatatttatcataagacacacggtcataagtttgttaaatatataagatttttttccggtccaacaaaaaatatctcacggtatcaaatcgtttccgattgatggatctaacactgctcatcctgcctagctagatctaacgattaaatacgatttagtaccgtgagggaccagtaactttgagatattttttactggaccgaagtaaatctctaaatatatacatagagatatatagctattctcggctcttttataatgtagagtaaagtataaaaggctattttttgtttacatctgcatgtaaattaggtgaaatatatttgtcacacaataatatattacccctctgctagaattaatatagagtacttttctttatcttatatttcttagggcaaaatgagcttttgttatattaaagcaggattgcaatctttgtgcaaaatctcagctaggtctgatgtgggcttcttgccacacgtacgcacttaataaaacccataatcgaagcagcgatacttgcttgtcacttgtatcatgagttgtcattacgatgatcgacttacgaagttacgttttgtttggcataatttcacattcggtttctgtagttgggtatttttaattgaagaaatccacgtatatggatatgttgataatatttggatggagcactttatttctatttaaggtaaaataaagaattttaagccgctttaatttaaattgcaaagctcaaattgaacgtgggatttgagattaaaaccgtgtcaactaggttgtaatatcaaagatataaaagggccccgttaattaagccccttaatctcagcaacaatggcagatctccgatcttaggccgcttgaggaagcccattagttaactgattatgtttgcggtggctcatgagattgttttcagcctaccacaaggtccacattcatctttcaaaaaaaaaaaaaaacaaggtccacattccacacagtttttgtggctgtcgcatttaaacacaaatctcagcatcaagcatctagaccaagttgttggattcagcttaataaggaagtgttccctcggtccaaaaatatgttttcttttcttttcttaaaacacaatacaaatacagacacccacaacgcacgcatactcaccctgtaacatgttcttttcacattccatacaaattttgtgactgcctcatctttatcacaaaactcaccataaagcgtctaaaccaagttatcggattcaatttagggagttagtactccctctctgtatctctaaatatagtaactttatttaaactagaaatgttgccatattttagaaataaggtagtccattagttagtgaaattaaggtgccatttttcaaaacatgaagaatagattcttctgtagcaccacagaatacgagatatatgcacagagccagtggcggatcttgtcttgtgatggcgttgggatttgggcattggacatttggacattgatttcagatgctaatcatgtgatcactacgttagttggccactaatttaaagatttttggtgagaagatttgttgatcgacctaattgtctaacactaaagcaaaggcacaatcggaccaaaaaaataatagaaataagagcaaacacatctatataatcattgttgcgaaaattatttcactgataaaaatattacatgacaaatttagtactattatagttctccattttatttagtgccatgcatagtaagtacaattgtagtatagtttgtgtatatataaaaaacaattcactaattgaaagtacgtttgtagtatagttttgtacaattcctttcactaattgaaagtacaatactcttcatcccagtaatatataaattcgtcatagctaaattttaatgttaagtctggcactgcacagagacagagctggcaaagttgtcttgacacgttctttccacattccagacaaatttaattaagcatcaaaactctccttaccttaaatatagcaacatttctagtgcaaattaaacatgaaagttaccgtattttggaacgaggacgtctagaccgtcaatgaaattaaggtgacatctttgaaaattgaaaatatgaagaactttgcagcaccacagaatatatgcacagagctgataaaagttgtagtaagaatatatgcacatattatctttttaagagacgatatagtataaatgcagacgcacactacttgaagttagtaccatgcacacgtgagacatgtgggcataatttggctgattgcttcaattactagaacattagcgtgctggttggcacgctttccttatagcccgatacattgttcagtgtgtgtttgaaacatgaaaattttataagatattttagcagttagttcaactttcatgttccattaaatattgtattctcttgcatatcattctgagcataatctcctgtaatgttaatttgggattgtgtgttctctacgtttccggtggacgattaattataaatgttgagtttctaataatttcttgatataattaaatactattaagtattaaaaaagtagaaagtaggtggagttaaatattagacggactctaaaaaaaatattagaagattaataagttttcttaaaaaaggactgattgtaggaaaaaaaaagttatgggaaaattgtaagcttacaaagcttgctctcgatgatctataatactcgatccaactcctaaatgctagaagcagaatttgaaattaagttttggcctatgggcggtctttgtgttcactccacccctcatttttctaggtcactacagtctgctcctttctctttttaagtaaaagcagcaaaaactttgttgggcttgagctacagaaaagctgaaaagccctgccaaattgatcagtacgtgtcgtaacactcacctcttatttaattttcttcatgtcttacttctaaccattctgtcattttccaaccatattttatttaataaggggtattgtagttttttcactccatacttgatctccctaagaaaaagggcaggaatattttatacttttggagaaagtacaattgattcgcaagatatgatgataacaggaaacagaaaaacggaggaattgaaatggtcgattggcttggtgctacacagtgatacggtagccgaggagcatgtagctctttttttttattttccttttttaataactctaagttttcttctatcggatatttgaatgcatctaggagtgatgttgctgcaaagggctataatctagatatataaatttggatctagatactttaactggacttattttaaattatgatttttatttgattggttctagaagtctctatgtttattgcaagtgatgtacagtttagaagctaatctggaagcttgcttaactttttttttctaccgcatttatctgaatatttagctgtgacaagtggaccaataggcacacatggaatgtagattaggcgtacatgggagcttagtactcctaggatttgctctggtccaacaaaaagtatctcgaagtatcggtatctcatgttatcaaatcgtttccgatcgttagatctagctaggttggacaatcagaaacgatttgatatcgtgaggtaccggtacgttgagttacttcctgttggacggaagcaaatctcttatataagctagctactccaactccaagctcattactgtgtctcgcttgctctcgtcgacaaggagaagatggtgtccaaccacgacgacggcaagccaccggcgaagtggaagaaggtgtgcgtcgtcggggcgggcatggccggccttgcggcggcgcgggagctgcgccgggagggccacgccgtgacggtgcttgagcaggccggcgacgtgggcgggcagtggctgtacgacccgcgcaccgacgacccgctcggcgcgtccccggcgccggtgcgcgtgcacagcagcatgtacgcgtcgctccgcctcatcagcccccgcgaggccatgggcttcaccgacttccccttcctccccgtcgacggcgccggcggcggcggccgcgacccgcgccgcttccccggccaccgcgaggtgctcctctacctcaaggacttctgcgacgcgttcggcctcatggacgccgtccgcctcagcctcaacaccagggtcctccgcgtcgccatggcgcctcctcaatgtcgcgcccccgccgtcgccggcggcgagcggaaatgggtggtcaggtccgtacgcgtcggcgagcgcgacgacacgggtgttcaggaagaggtgttcgacgccgtcgtggtcgccaccgggcactactcgcagcccagcgtgcccaccatcaaaggaatggaggcgtggaggcggcggcagctgcacagccactcgtaccggctgccggagccgttccgcgacgaggtgctcacggccacacatttctaatcacattggatgctcgctctgccgccaccaaccatgtcagtaatggtaaccttgtattgtcttgtgtgctccatgtctgcatctgcgtgaaggtggttgtcatggtgggctgcggcgacagcggcaaggacatcgcgctggacctcatcagcgtcgccaaggaggtgcacctcacggacaagtcgacggaggaggccacgacgccggcgatgtccaagctgctcgccaagtacgccaacctccacctgaggccacgggtcgaacacctgtgcgaggacgggacggtggtgttcgtcgacggctcgcgcgtcgtcgccgacaccgtcatgtactgcaccgggtacgtctactcgttcccgttcctggacacggacggggtggtcaccgtcgacgacaaccgcgtcgggccgctgttcgagcacgtgttcccgccggcgctggcgccgtcgctgtcgttcgtcggcgtcccgaggaaggtgccggcgccatggttcttcgaggcgcaggggaagtgggtggcgcaggtgctgtccgggaggaggacgctgccgccggtggaggagatgctgcgcgccgtcgacgagcactaccgcgccagggcggccgccggcgtgccggtcaagtacacgcacgagctcggcggcatcgagcctcaggtacacagaagctaatataaaacggatctcgaattgttcttgatcgatgattaatcttgtttaatttgttgaatgattgatttggcgcgccatggatgagcagaagtacatcgagttcggggagaagtattgcgggttcccgcgctacgaggattggaagagggagatgatcgtgtccaccatcagtaggagggatgacgacgacatggagacatttcgcgaccgcgtcgacgacgacagtgaccatgtccggctctgcctcaagagctggcactgctcatcacctgctcgacatcaagcctctcttgctgtttctgctgctgatggccatcctcctcctcctcgtcttgcacagacggccaaggccatcgctgctgatgctctgtagctctcaagtctaaacgattggggtgtatggttttaatcctaaggttctgtgttcaatcctcaacacgcttacaatttctttttaaaaactctccctctaaatctccttttttttaagtctaaactgaacatgttcaggttcaggttcaggttcaggccatggctgaatttgagtcacccagatgatataaaatatcaggccattaagttttcaggaagaacattggcagaggatatacaagaaattttggcatcccgtcagtcatcactgctgatgaacaaggcagcattgtaaggtttggtctcgcttcttcttaaaacggggcatcttcttcttatatacaaaacgtcggcaacggcctgaccgttcgaaaaaaatgctctctaaaggtaaacagctaaacagacgggaagttgagaaagtattttatgaacctagatgcatggcaagtttgcgttcagagtttcagcattttgctggctttttcatggctgctaatctggtgaaaacattagattaactttgtgcagaaagctcagtgaaaaacctgagcctccagcctatgtcacaaagcttttctgacccaacaaaaatctctaatatactaaaattatacttcattagacagtgtgtgcactgcagtataagacttagcttgtgcagatgtaagacatctggttctgatttccctcactgaacacaaagttggctgctaatataacccaggcacacgtacacaaagaaaataattggaactcaataatttaatccaccctaattatgtcttaaccatataaaaaactttcagaaaccaaaagtatttcttctccaatgcatcagattactcggaagaagaggtagacgacgtcgcgtccggctccggcgcggcgacgacatggacggcgaggcggaaggagaggtaggcgtcgacgcaggcgtactgcacctgctccttgctcagcctgcgcgcgtcccacctgctcgtcccgaccttcctcggcttcgtcgtcaccccgtcccacccgaggtgctcctccgccatgcgctgcatcgacgtgttccccatgccggccagcgaccgcagctccaccgtgcgcgccacctccagcccgtgctgttcctccagcttgcggcagtcggaccgcacgccgtagccgacgaacacgacgcgctcgtcggccaggaaccgccggagcgcggcggggacggcggcgtcggcgtgcgcgagctggaacaccaggcaccggtgccccgcgcacagctgcagcgtgcccggccggatcgtggcgcggcggaacggcggcgtccactgcacccccatgccgacggtggccacgccgtcggcgcggaggcgggggccgaggcgccaccgcgtggcgtgcacccaccggcgcgccgcccgcgtgcgcggtcaccgtggcgaccacctggcggccgccgacgcgcaccacgtactcgtcgtgcgtgcgggtggagcggtggaggcgagtggacacggcggtgaccatgatggcgcgtcgccggcgtgtcgagcagggagacggcagctttcaaagttgaaatcacacaccggattggatccaaaattccgggaaatttacggtttctgtgaaacgtctatataacttgaaatttgcaaagacaattatacattttctcggtgcgtgttaaggcacgattacaaccctatttaattgcgataaaattaaattaattgtgactaactgactatgattatgtgttggtgcaatgtacgaatgtgtaacaaagctaacacttggcactctattttctattttccatatataagacatacttatacatacgattgccttacaaaagtcagttacatactgacattagtactttatacatgacacatttctatgaacttattaaaaattagtaaaaatatggtacattatggtgttcacggactatcattaggatggctatatatgtaggggatatgtagagattgttgcctcaacatcaatactgttgtaccgtttgaaatgctgctttcttcccttaataaaaccggctggcgtttccttttgccgacatggcaaaaaaaattgctatatatttatcgataaattttcttctaaaaatttaaacacagtgtaattacattataatttgcaaataatacaatgtaatttatatgtaactttcacataattttaaaccattcgatttgctttaaaatttttgcaagggagatagaaaaaaaaatcacaacacacacatgtgaggggattcggtcctattacctctgtttcacgaaaataatgtcacctaggaattttaaaagttatatacaagttgcactatatttacatgcaagttacaaatataattgcatcacaattgtaatacatttacatatgtcaaattatttgttaaaatttgatgacaaatctatagctagtcctagaaaaaattacaatttcataataccaagtcattcacaattacatcacattattttcacttacgtttatccaccaatacgaagtgcaatgaattagcacgattaatagataatacaatatacaagcacactgcacaacacaagcgcagacacaaattctcaaacacaaattatcacaggttgggtgtacaaaaattcatctgcaccactgcatctaaataaaaacatcttttcttacatctatccaccaaaagacgcttgtattatagtactccgtacatagtttttaccgaaagcgatcgagtaaatttctcttgtagtaaaagtaaactgcccgtacgtacgtctcaccgtcgtcgccggcgtgggcttcagatgtcgccggcgtcgaggtggacgccgaggtggaaggagaggcatgcgtcgacgcaggcgtactccacctgccccttcgtcaacctccgcgcgtgccacctgctcgtcccgaccctccgcggcttccacaccccgaccaacccgaggtgctcctccgccatgcgcttcatcgacgcgttgcccatgccggccaccagccgccgcagctccaccccgcgcgccacctccagcccgtggtgctcctccagcttgcggcagtcgtggcggacgttgtgggcgacgaaggcggcgcgcgcgtcggccatgaaccgccggagcacggcggggacggcgccggcgcgcgcgagctagaacaccaggcaccggtgcccgacgcacagctgcagcgtgcacggccgccgcgccgccgccgccggcgcgcggaacggcggggtccactgcacgcccatgccgacggtgatcccgtcgccggagcggaggcggcgggcgtggcgccacagcgtggtgtgcacccaccggcgcgccacgcccgggtgcgcggtcacagtggcgagaaggcggcggcggcggcggcggtggctgccgacgcgcaccacgtactcgtcgtgcgcgcgcatgcagcggcggaggcgcgtggacacggtggtggtcttggcggcgaccatggcgcggcggcgccggtgtgcttcttggcttcttcttggggtttcttgggagacgacgtcgtttattttagcaatggaagcagaaaatctttacctttttataactattgattgattgacttgccacttccaattttcaaaacacaaacctaatacaacccaaaattccgtgaaattttttcaagttttctaagaaaggggaatatgaaaacctttcacagcacgcggccttgaatttgcagagtatatgtgttaagccgtgttagtgtgtactgtacgtgtagtattaggtttagccccgtttctcgagaagataagagacatccctatttcagtttatgcatgtactaccacactgttttactttgtgataacttttacttatcacaaaacggatacgatccaaaatcccagaaaaattttcaactttcctcatagaaggggagttttgcatcttttatagagttgtaaactaagtataaataggcttgaattttgcaaagagaataacaactcatcatggtagtatgtgttaaggcacgtatatgaatgcgtaaaacattgtttgcatatgttccagtttttaagtactccctgcatccttttgtttaggaagtttctgacagtgacatgtttgacaaaatgaaagaacatttgaaatgacttttggaaaatgattttcagtgtatataccaacgtcaaatattaaaatatttttttgagttgtatatcagcgtcatacaaaaatggaagaagggagacaatattccccgtgcaaaaggaaaaaaaaaaccttgtaagtatcaaaacacgattccagattatggtgacatcataaatttagaagctggtactctagttactttgatttttatatcaaacgtagttatatacaaataatggtcttactatgatctatcacattatacttaaatcacactccacatttatcaacttaacaattgttgaattttttttagataatgtagcaattggtgatacatgacacatctaaacattacaaatttacaataccaagtcaccaacaattacatcaaattattcttcacttacacttacacttattttaccactagagtaccaattattattattaactaaatcggcatag

SEQ ID NO: 66718 - DNA, 13162 bp, Oryza sativa
agacgatctttttcttctccctgaaggtttgagatcgatctgcgacgaggaggagcgaggaatcgccaactttcttttcgaggaaattgtaagatctcgcgcgacctgttcttcttggtgttctgtcttgtacttggtttacttggtttgttttgtgtttgatctatagtcttagatgatctgtgaagaatagttgttttcggtacagatggtaggaaaggtagaggaggacgatgctgcgatggccggcggtgcggaagcacggcggcatcccggtggagctgcacgtggcgcgggcgtcgacgggcgaggcgggagaggaggaggacggcggcggctgttggcaggcgagcacggtggaggcggctgctgttggcgccccgtcgccgcccaactccggcggcgcccgccccctgctcagcttcgtgccaccgcccgtctcggccccgtcggcgtcgcctacccgctgaagaagagaaaagagaagaaaagggaagaaataggagatgacgtagatagtatgacatgtgaggcccacgtgatcccacgctaactcagccgtcacatcgaataaaatcagggtcaaaaccaacaaagaacttcaagcgaacgcgaacggttttgatagttgaggaacgtctgtatctggttttgtggttgtgggatggttttgtaactcgatgacaagttgagggaccttcggtgtacttttttcatcctagaatatccacgtgactaggctgggccacatctataaagggccgtattagaggcccaacaaaacgaggcctaaaagggcttcacaactgaggaaataggacccatttctcattccggcccaatacattcacaagctaaccgacgcagggatcctacaactgtcggttggtaaccagtaacaaaaattacggctagtttaccattaattcaattgctggtactggtagagcagcagttgtttgatccctgtcactcaccgactacatcctcttaagcttaagcttggttaagtaaaccaaaattagtgtataacacaagctaaccaccattaattagagtaattaaactaggactaatcaataggagtagtaggtaggtaagtttacacaaggtgacagaagatgccaagcaaaatgagcagctgtgaagagagtgaagacatggagtggtggagaagcaaagtgtacaacctcttctttaactgtagcctgcacatggccacatcacatgctgcatcactcactcactcacccactctctcctcttcttttctttttcttttttttgctggcaccaacaatcacatgcacctcaaaataataaaaataaaaaaggggaaaattactcttgctgaactcgtgtgagcttaagaaattactgctccgatatagagggggggggggggggtaaaaaatgtactcttcttaattcacacttgctacctaatggtagatctttgcaacacaaacatctcaaaataattttcgatcgatctctaggagaaagaaaatccaaccggccggacaatgctagagaaatcaagaacaaatgaacttacaaattacaaaccgagcaagaaaggaggcgagcagaggtagatcagatcagatcagaatcagagcatcctgaggaagatgatggcgacggcgaggagggcggcgtaggaggggttggcgagagaggaggcggcggcggaagacttggacttggaagaggcggtgtcggacttggaggaggaggaggagtcgccggagccagaggaggaagaagatgcggagcccttcttggcggtgacggcgagcttcatgcctttgtagcagtagccatagctgcagatgaagtagtagtccttggcctccttgagctggaacgcgtagctgtgccccttgctgtagctgctaatggcgttcgccttgtcgcagttgtcgtacccgacctcgtccacctgcaccacgtccgacctcccgttctggtactcgaacactgcttcccacaccattgcgttgcgtcatcaatggcgatcgatcgagacagatcaagaagagagagatgaatcgatggaggtgcttacggagccagtcgcccttgtagaaggggcggtgcttcttgacccaggcggtgtagtccacgtcggggttccaccccttctcgtcgcccaccgtgtagttggtcgccaccgccgccgccggcagcagcgccaccgccaccaccagcaacggcagcatccggtggcacaccatctccagtggcagatcgatcgatctgagctctgagctgagcttgccttgaagacgaaggggaccttgcctcacctcactctgctctgtcactctggttgtctctgctctgtgtttgtctgcaatgatagcagctgtatgtatatatacctccatatctcttgatatctcatcctcagcttcagtaaaagacagtaaacttcactgtcaaaggttggatgcccagctgcagctggtagatttacagctttgttgttgttgtacattttgtacacatatgcaaacagccatactctgtctcaagaatataatgtgataaattcactgcctttttttctattagggggtaattaactgaagtttggtgatgatgtacagtgagacaaatgcactggctttattagggggctataaattatcttcagtttcatgatgctgctactcatttgtaactgtattagttactcattgctgactaaacttgcgcaattgaactatgcacctttacagtagtataagcagtgctagtgtgcaattgaactatactcaaatcatcattctatgattatcatatatggatactgaataattatgatatcaatggagctagccagggaaagtagtagctgcccagctgtattatttgaagtgatttagaagcaaaagccctttcttattcctcacaaacattcttagtctaccaaaaggattcatagttctccctataagaaaaggcaaaatgccagccgtggtggttgcgaaaatatatattgtcaacttatgcattcaagattgataatataggcaaaacgacaactgttagttgattgtgacaacacgatgatcatatgaaaatccaattcagtggaaagctttctgcaaagttggcctaataaatactatactagttttttttagaacaaatgctatactagtttaggtagctctaatcatacaataaacagaaatggtgaaaagctcaaacagctagctagctgcatataaacaatatgttcaaccattttctattgacaaaaatgaattctagaccttgtgctagcgtttcgtattttccagtacaaaacatgagtaaaaaactaagaacttcctcgcattccagattttactctaactgttgtactagtagccccatttggagaacaaagtttaactaaaaactgtatgaagcaattaaactctcacacaatcaaatcaagatagatatacaattgtaaaaaaaaacatatctttaacctggaagtgaggaggagatccaaggtcaatgaaagaagacaggtagggagggccatgtgaggagatgcctctccatttgcccctttatttccgacaatgccactcaagttgatcagtatcttcttcatggcaccagtagctgtgtactccatgagtgtaattaactttcttcttctctccaactgcttcagctaactttcttattaatgagcaccatttttctgctctcattatatcatgtggtttgcttctgttacctgctgacctgtgtttgtgtgtgatctactatctgcagactgcagctaccacttgggcttgctttgtcacatgcagttttacaccttttatttctccttaatacaaggtaagtgttggatcagtagcttgctcaatgctcactcatcctgccaaagagagactacagacttgttctgaactgtaaagtctgttgtttggatcctctgcatattgttcagtcttgtccttttgctttacagcccttttgcaaatgcaggaaccgtgtgataaaacagtagtagaagtttcatcaggctcatggttgaagtaacagtgaggatggagccagggcgaagccatgattcttcgagtgcatggctagaaaataataaaatgcatttttttcatttagatattcttagcttaaaatcgcttactctgcattggaaaattctgctgccacatgtagtgttactctgcattagccaaaaaaaaagaagcaaaagcaaaaattaacaggtgcctcaagatttgtgttaagtgatatcacagtaatgttaacctatccaatgtagtattagttagtcatattctaactggatgattggattgattatggacagatttaaatttgctcgtatggatgaataaagcaagggacgtgtgaaaattgtacaaaattttgatgggcctgatctgggccactttgggccttgacactctaggcggactagtgcaacatatgccccggcccatttacaccgccccgcgataaaaactgggtgagggcgaccaagaaccctaggctgtcgcggatccatcccatcccatctcttcctcgtctcccactcctccggtgagccttgcctccctttttcctcgattcagttcatcagatctttcggtaaatccaatcgagttgatagggtttgatgtcctaatctatctatctctctctgtgctgctgctgttgttgggggtggcaggattctttctgttcttggttgattgccggagatgtcggattcggaggagcatcacttcgagtccaaggccgacgccggcgcctccaagacctacccacagcaggccggcaccatccggaagaacggatatattgtcattaagaaccgcccctgcaaggttatacacctctgaatcttgttattgggataagacttttcaggacttgcatctaactgtactgtagtgtatggcgacttacatttgtgtatggcgacttacatttactgtattgtattgtattgtatggttgtgttgagtgtatggcgacttacatctaactgtattgtatggttgcgttgggttaatggaatttgtcatggtttatgtctgccgttagcaattaataattgtagatttggatgtgttaaaggtattagatccactactcatagcaaatggactctctgttgtagatgtggatagaacaatagatgtacaataatcttttctttttttttatgagaccccatttgctcacatatttctcctatgcccataaaagttgtcgttggttggtgatgtatgccgttctttagctgatgaaaaaccatctgaatggtctcctgtctcgcgatatgctgcacaattaacttaagaattgttttcaataaatctttctgaggcatagtcctgcatattttttttattgaaaatgcaatgcagagataactctgtatgtttggaaagaattctatttttccttaggctttttaatcgtaaaaattatcatatctatggttcttgttataagttaatgattcactgatacattagtgttgctaagtttgagctatgcccatgtagtagtgccaggttatataccagccaagtgatctctttcactttataacctctgcctttactctgtcttttagacgttttatgcagttttgtcgatgtactgatttattcttgttatgtaccagaatttgaatacgctggtatggttttgcttgtaattttctgacttgattgattacgtgttgcctactgagttaaggtttatttaatttcgaattggacagatgatggcaagaatgatattttcccttatttgtacatcttatggacaaataaactgtcactttttgacccatcattttttgacccatcattccctgcgcttttctgccataagagagccattcgtagtataacatgtattatggtgataagtttggtttaatctatattatatataggtggttgaggtctctacttccaagactgggaagcatggtcacgccaaatgccactttgttggtattgacattttcaatggaaagaagcttgaagatattgtcccctcatcccacaactgtgacgtaacatacatacagatcatgctctacagatcatcccctaatcccacaactgcttgctttaactattttgttatccatgtatcatgcaggttcctcatgttgatcgtactgattaccagctgattgacatttcggaagatggatttgtatgtttgctttcaacctttcccttgctttatttgtttttatgaaaagcctgtacagtttctaacatggtaataaattaaatgaattttacaggtgagccttttgactgagagcggcaacactaaggatgacttgaggcttcccactgatgatactctgactaaccaggtcaatgatttagctaaaactctttatcatcaatgtgtgttatctcttcaactaccatactctgactaaccaggtcaatgatttagctaaaactctttatcatcaatgtgtgttatctcttcaacttccattatatcttagtcgctttcatgtctgaatctcagatcaagaacaatgtgtgttatctcttcaacttccattatatcttagtcgctttcatgtctgaatctcagatcaagaacgggtttggtgaagaaggcaaggatatgatcttgactgtgatgtccgccatgggtgaagaacagatctgtgccgtcaaggagattggggccaaaaactaagcggctttgctcgattgcctgcctgcctacgatactttgctatcttagtgttgagagctgagacacataaatagaagttttttttatgctacctgtggatgaaatgacgatcaaaaccttcatcgattttatgttacactggatggtcatgagatacttgttaatgcttttcattatcagtttcaagtatcctttgaatcgagtggcagctgtaattcgtatagtaaaagtgggaaatccattctgctatgagatgtgccatgggagcagccgtccaagctcaattcatcaaattttatgttacactgaagattaaactgcagcaggtggggcagcccaagctcctaaggaaacattcttgctatcatattctggttttcttctcatagagaattctagctttgatctaccatcagcaagtgtgtattaagaagagtacatagagataaaaagaaaggcaacaacatagatgtgaaataagaacatgaggagagtacataacaggggaaaacaatataccatcctgaaaatactatgcatctatacaatcctacggtgaacaactagccactaaataaaaggtgttgacagcaaaaaaaaaaaaaaaaccataatccagatgctaaaattactccagctgcgttcatcactgttaaagagccactgattttgattctaaaacaaagttaattacgcctgcttgaaagcgtgtgcgttggatatgacttcttaagagagaatttcctgcacataatttcatgcaacattacgcctgtttgaaagcgtgtgagttggatatgacttcttaagagagaatttcctgcacataatttcaaggtttaatccgatgaatgattaggtagaaaaagaaagcaacattagtaaactcctgtaccctgtcttctccatcaaaggtgacgaccctgaacgggttccatcctgaattactgatttcagctttcccgtttgatcagagaagtgcagaaacaacgtcatcttcttcagatagtgtttggttgcaggcattggcgaatgctttgggatcaagctctcccatcctcttgatgccaatgctggctcgatcacttgttaactaactccttcaaaagcctgcacttacaatagatattgatgttgatcatcagacaaagaaatcaagaaaggaaattcgatgaattgagttacatgtacgagttgtttccggacggcctgcaacttgtaattgcttgttcgttcattgatgagcaattgagcagagcttggtttgagcgactccattgctcacacatcaagtgattgatactccttagatagcaaagctcaagataattgactttcttttcctccggacgcgtaaaagtagcacatcaatatattaggataattgactttcttcatgcttaactaaatctatttcttcacgattgtgtgagttcgcaagatatgtatttttttcttcatggtcctgtatcgagtctatgttttatgtctatcaaacatatgtgaccaagtagatttatagttgtaaatctattttagaacggagctagtactcgaggagtataggcagagtcctcatcagttgttagatggtgatcgatctccccatgaaaaaaaaaaactacaactaattagactccaaacccgtgtactccatgctgatgggagtataacttaataataataataataattacgaattttcaaaatatcaaatcatgaaaatatctcataataatgtttttccttaagtatcaaacgatactgtaagcaacaaattgcagcacacacacacgtccatgggagctcaacgcttcctcgtgtgtcctccactgcttaacgacgaactggatggcttcctccaatgtcgccttgcgcttctccttgtagttccacagctccgggaccgggcatcgttcactgggattgtactccttcatctcacgcagtgccgttgctaccaacctgtaaacttcttcaccgtgttcttctttcaactccctgagcttgccatcatccccacagagaatttcctacattggaggatgcagatcacatacacaaccgttaatcctaatctacacaatgaaattggtactgtatgtgctggttcgttaaaaaaaagaaggtaattttaccatccttgaaaagatacttagaggtaccacactttatagactaaaatttgatacctccaggtaaggttggaaatttcggtcattttggacccctccaatacgatattatttcagccgaaatttttcaatttttttattttttttcatgaattttggtaatatttgttcaaattcaactaaattttgttcaaaatttcggacccaaatcggctaaaccaaaaagtttaaccttgcctccaggtactaagtacctcgagttacaaaaaaaaattaatataaaatttaagtattttgagatacttttataaggaccataaaatttctcttgaaaaaaaacatacacaatcgttggtactatgagcttgctgccattctcagagagaatttcctacattgaaggatgcagatcacatacacaactattggtactacattttcatcatccatttgtcatcaagatatggcatgaatcaaactgattgatcatcgtctatatgaatactgactcctgtttgctgcgctcacagcgtttcgggggtggcgtgctcgcttccggcgctatccacgtcgacgcggagcgttagagcggctggttttgctgcgtctctgttcgcctctttctagccgttggatcgtggatggacggcgcctatttgatgtggcgtttggcccttccttttaaccatgttgatgggcttgcaaacaggagatcgacacgttagtctacgcacctatgcgtgcctatgcgtgtgttcgtttctttctggccgttggatcgcggatgggccgtgcttatttgatgtggcgtttgggccttggtttaaccgtgttgaggcgtttgcgaacaggagatcgacacgttggtctacgtgcctatgcgtgtgttcatgcgtggacatctcctatggtccataactctatgccaatgtggctctaactgaatgggtccagtgcactcggtgctggctgttttggccaatcggtgttgtgtgtcagggcggacatgcatgcgaggttggagcagtggagtgtcagggcagacatgcatgcgaggttggagcagtggaccagtagagatggcttttgtgagcatggtgcacatgatctgtgtcaatggcaggcgggccctcaccacagttctttgtgggccgccatcgtgcgctcttcctgccgtaatggtagtggagatacgggatcctagggtaaaacttgtgtatgggatgtgtccatggaccagtgtgcttgctacgggcactgggatgtggggcttggccaatgtgtctgtggtgcgccgggagttttctcgagccgcgtgtgctcctgctatgtacgacggaacgtggcacggtcagtgtgtggtttgttgcgtgcactcgggtgcactcggttcacggatattggctcgctgctgggtgggccatacagctggttggatagcgcttgtggtgtgggcagggtttacacagatacgggtcgaggtacaggctgaactgttcatgtttcacgccggtgaaagaggaacactttccctatgcttgctgcaaggttttctgctccctcgccttctgctcctcggcattcgctgttcctcttctccttcggtgtgttcgtcgatgtgctttgctgagcgataatggcgaacgcgaggtttgtacggatgaattacttaccgatggtttgcttgggtgttgccatagatcctgagcgaattgcatgtattttgtaggtgatttgagaagggctttgctgctgtgattggttgttcttggtttacttcaccctgttgcttcggtggactttctggtgatctaatctagtataatagatctggcaaaagagaggtatttgctgtcgctagcattttgcaggaacttattttccttttttggggttgcctcttgcagttcatctagctgtttggtcttgctggtggtggtgggtgagtgttgggtgcgcaggctctggggtaagaaaagtttctctttgcattttatctgtttggtcattttctttgcatgtggtttggttttcttgtgttggctgttgttgtgtgtgtgctgtcgttttcttacgtggagtcacgtgactgggccgtgccacttttttttattttggcttggtatgcactttgtttggtggctgtatactactacactgtattatattatcctgagtatttattcatatagataccctacggtagtgtgtctgtccatcgttggacacataagagcagagtggtaggtcgagtgtcttctttccttgaatgcttggctctggcctttccccttattaaaatcttctagccgttgaacttgggatgtgcttttctgtagtctcttctctggacaaactgttctcctccacttgcctatcttatcctctcttattttttttccttctcccattggcagtggtgtagccgcgatgttcgccgtgggagtatctcatgtctcgctgctgaatgccgctgctcagcattgcatgatacctagcattgcgtacctgtgggagtttagctccgatggtacgttgttggctggtattgaagtcagtctcccgtcgattggttgtgccagtcatctggacactatgttcttttgggagacggccttagctccacttcagagcgcacatgaaatggttgctgcaagagcactgaggtgtctccaacatcgttatggttttgtagtgcatgactacaattttaactctatgctagcttacagacggctggcacgtgatgctgtgcaggctgcattgtctgcttctggttgtgtggcacatttcagatcttcttatggtgcatttgttccttggtgtgatgatgttcttaggacatgtagctcactgtattttagttttttcgtagaagacatggaacaaatgggttcttttgaaatataggtgtttagaagttcctatctggttttagactgtgtttgtattgctcttggctattcggaattggcagtttgtattgtcagcttttcatgtattgtcagtaaaatgatgtttgtgttgctgatctgtgctgattgtataggcatgttatactgatgttgaaaaggccatgcgatagagtatccagagcacgtgcgagccgtgaaaggcataaagcgcgtgctttgacataggaaatatgcatgaggagcgccctggctttgccaggtgggaccaaaagagctcgctctcttatggattttagccctgcattggcagcttctaatagacaacgacgccgtctgcttcgaataggaaattcttcctttctttcgggtgagggatggcacaaatcgtatattaatctatgtcacactaggtgccttgcttaaaactaatatctgattcactgcagctaatgttgagcttgatagaggtagttcttcacgctctcacaaggatcatgttgaggctttaaagggtttgtgtttatttagatcccctataattgcgacggctggtttagcaatgttatgttagaagtttattgattgatgatcttgcagcatcgtacccggggaggtcgtactatggtgcaccgacgtacgagtgtttgtactgtggtgctgtgttttggttctaggagagggttaaaagtctttctgctatttcaaaacgaaaaatagtttacaatttgtgctgcaaaagtggtaaaatagagttgccgaaactacgtgaacctccagaacctcttaaaccattgttgaaatttaatggagatgcacgttcaaagagatttcttaggcaggtgcgatcttacaactctatgtttgctttcacctctatgggtgcaactgtcgatagaacgataaacaatggaagtgcaccttatgtttttaaaattaatggtgttgttcatcacaaaataggtagcctgctaccagcgcaagggagaaggcctcaatttgcacagctctacatctacgatccagaaaatgagatacaaaatcgaataaatatatttgaaaatgatggcagcaatagtgacaaggctgatcctgctatagttgatgctctgtgcactatgttagattcgcataacactcttgtgcagaaatttcgttatgctagagaatgcttgaacgagcatgggaatcagcatttgacgttacggctgatggggtgcaatgcaaaatctgatgtgcaatataatttaccaactagcggtgaactagcagcgattatagtgggcgattactcagtagctgagtatagttatgatatacttgtccaggaaaaagatgatggtttgcgacgtgtgtcctctttgcacccatggtatatgg

SEQ ID NO: 66719 - DNA, 3999 bp, Oryza sativa
  unsure (1)..(3999): unsure at all n locations
ctgtcccttganaaccatcttgtgcncgcacgccngcaggtcgactctagaggatcccctttccgtgcgcactttgcatgttgggaacagctgattccaaacacagccttgattcgtttttaagatagaaaagaactaccacagagttgtagtgtgtcaagaaccggtttcctttgggtatatcatgcgtgagtttctctagttttgttgaaacatcaagcttattatccattttattggcagtaaactatcgacttgctatgttagaaaaaacttctcatagaaacgagagtgtcagcaagaacaacctccgcgtgtaggagcattccataagtaagacatgtcataattttaactttggaagaattgtacatctatatctatactaatataaaaaggatgagttgagcctagcaatgcttcaggccaaatcatcgtncctaatccctaccatccatccgcatctgcatcgcatcatcaccctaatccctaccgtccacccacatcgcatcacaaatccgcactaatccactgcaatttcaccctcccacagcgacctcatcctctctccaccgaattttttggcctgcgggctttcccccggccccaacccggnnggaagggaaatggaaacctttccttttttgggggggggttcgccctagcgcacggtgtatcgggccatcgcgcttgcgcgccatcctaaacactccccgcaaacgtcgccctccacccacccctctagattaagcccacccttcctccaagctcccaatccaccctttctcaagcctcccagggccagccgtgatcccctccaccgggccactaccgacggtaccccccccccactccctgacgcagccagtcctcctcgccgggtgcacccatcttcgtcgttgtccactctttcggcggcatcaccacccaggtgcgccacccggtcgtcattccttctaccaccgcttgaaggtgcagactctggtcacaatgcacagcttcaccgtgccccggtcactatttctctcagtcgcgtgccttccttccttcaaggcttcaactgacgtcgccgtgctctcttcttgctcgcgttgcttgaatgggcaaaggctgcttcgatccacgcagtattcacccgtcagattactttttgtatgggctcaaaccctgaacctcttttctttgaatcttggtatcaatcttaattaaggttcctcaacctccctccatctgctttggatctttccttcttaatttccagtgaataatcggtgaaaagaagaccagctctggcgcctaccaatgcacagcttgagcagagcagcgatgaggaccagatacattcgacaggcggagaacaatgcacaacggctatggcagatgcggctgagaggatgagacctcattcccgatctagctgcaagctgcatgtggctgatgcaatctcctccgcatccgtttgctgcgtctccggccctccgcagcccgcccatgcaactttggcgcatggtactctggcagccacaacaattaatttgcgtcgctcagtggtgatgactgacgaggtacacatccgcttgattttgtttatatatgttactgaatcttagctcgaatgattttttttcttttactgagcgcagtaagattgagatagatcagatcaatttctttttgctcttccaaaggccttaataagacattcaagaagctagatcatgatgtcaaatattccggacttctttggctcagagtaaatttctgccagcttatgctataacatggaataaaaatatacaataacacaaatgtctattgcaaagaaagattctcactctgcaattcttttgaatctattgtatatttgcaggggtcagattgtcaaggtacttatcaacaattcaataacgatataacaacttgttaaatctcttaattcctgcttcatgtctctgatattcagatgttaatcagtcaattgtttggaaggaattgtcaagtcaccttggggctttgcaatgttaagggtagatgtccaaaggtgtcttaggtatatagctcagttaagttgtggcacaaattatctactctaattggataaaactgcaataattatgtaaatatttatattcattgatgaactcaatagtggcttggtggcatatgatcttaaaagggccccttattcagacagatcacattgatgccaaaaatcatggtagattctcatagataatagggagaaaattaaagggaattaatggacatgtataacaatgttgcatgttattcttcaattattggagcggtccagagaaggttgagaatatattggccataataaaagagtgatggagcaatctctcaaagaatctctgaataacatcagaattcataaggtatacattatttgttgcttgattcactacataatatctagagtgttaatgccaagccatgtagtgctctactcacactatgtagtacatatactatttactcataataatttcattttgaaacttgtataggagaactttgcaaagaagcatatgactacaatgtgctgctgctcaggtaataagtttcagcatcaaatttcaatatgtgcaatgctggttttaggttcagatatctgactaacctttaccaaatttagttccaatatgaataggtgacacagacacttcttcatggttccatagcagcggcggtgcggagggtcaacaacctatgatgctatcggaagaccccagcttgctccatctaatgtgagataaagctagatgatgaatgcataancttcaggagatgccatgaacttaacacaagcctggcaagctctcatgaacttaacacaagaaagtctgctcctgatgtagggacattgggtgcagatcttcctaggctacttcagcatgagcaagcagtcaatcaacaacgccggcaacaagcgcaagctggatattgtgactgtcttaatctaattaaatcaaaattagttatttctctgccatttatttggtgttaacataaatagttctgatgtatgtccttttgtatgcttgtaaagaagagatgccatgttatcaggagatgctaatcagaactcatctcagaaggggtgtgcggctgtgctatatcaattgaaaattgctttttttttcaaaacaaatgaatgacagttaaacaataagtcgtaaacttgaaaaatcagaaaaatactacgtatgtttcttattaatgaatatttgaaattgatgttcgcaaaatactaaggaagttccatgtatgttaaatggagttcaacttcgagaagagtttttttttcgatctgaaggcccgtagtatataatcaactcaaagaaatcttaatggatgatccaacttcaatttggaaatatatggaataacaacatctttataataatacattcttattagtttcaaaacccattactctctttcaaatttgacttgactatataaaaactttaattccttctctgtttcagtgatttatttttttaccaacatagatttcatgcgctattgtattccgatcgtatgcaacaatgagctctctttttttttttgcattttttagcttgaatggggattaacatgaagcttggtttatttattttatcaccacattgaaataaatcgtcttatatacatattgcgacagcaaaatattacgttgatgccatatgtaatatgaaaaacgtgccttgcacgtgcatgattactagtttttttaaagtcactctttcatgactgaataaactaagaaacatcataaatccttctttctagtttccaaccctcgtggttctgctacactttttgcttctatactaaattagntacgtctagggtatgcttctatgatacaaagtgagcgaggctcaactaaagaatgccttgtacactacatctttgtcaggaaggatggacaccaagatggctttcatttgaaacttatatgcatatatg

SEQ ID NO: 66720 - DNA, 7314 bp, Oryza sativa
  unsure (1)..(7314): unsure at all n locations
cgagacgcccaacagttgccttcttgtttattaaccgccgaccgggggagtttaattcttgagggtgcaaaatctcccgggactctttggggttaccaaattagggggccatgttgaggccggatatgccttggacacaaaaggggggccacaaaaaagaaaaaatggtccccaaaatttatctcatcattcggtcaacaagggaatagggagccggccttttggggcgggaattccacagcaccttggggcggcgggttaaaagaatttaggttttttacccccaaccggcaatggcgtatcgttccccagtttgtggaaaaagaattgtctttcataagcggggtctcgcaggtatgaatcccaccctaaagagtgttattttaccaggcccccacatccatgcctatgggaacaacctcggataagagaggttgtgataaggaaagcacccgatgtctatttgaaccgaaaggcctgctcgattgtaccaaattggttccatattccacttgccaagggacccttatgggtataatccaagacccctagaggaaaggggaccgaccactcattcacaccaccccaatcaacatacacgaacaatagaagccacaacatcaaaccaacatacccaagacaagccgcgggatatcgccttaggaataagcacggctagtcccttacggtgtctctggatactgtcaggagagacgaaagtgctatctctgacctcacggggcatgacttcgagagggaagactaccctgttgtcgattacgagtcagacctacagcccgccatgtcgacaccagttagataggctcccccaaatattgaccgggtgtgattatggtgaataagagcaatacgggcttcggccaacagaatgtagggttattccttgacaattcaggggcccgaacctgtataaaaatcctcgcttctgtctcttttacctcattctcacgtatgtcctagtaccgacgatccccatattatgcaaataccggaatcgcgacttcaaacgtcgactgaaatcatatcttgatgtcgcttgaaacaacatatttgcatgaagtgacacgtttggtcgacaagcgcatgtcatattcacaatgatcatgcatatgcggcctttcatatgcgcttattttagtagtggatgaagaatcaatgtgcattgctacatctttacgtgcgttttatggtctatgattttgttgtagtggatttagtatttgccatatgtgcttcgtgtttgttcttattggaattaaaggatggacatcttttatacactccatttatatcttaaagacaaagtagcttcggatcgaatgtaagcacacagtaaaattgtagagtaccaatgatggtaattagttacgatgatgtactacgatatatcaccctgagtttcacatgtcaaatatgatgatatctgagtttatttttaacttccgaaccactgtaatgttaaaactcagtacaatacaccgccaagggtggtaatgctactaggtgcactatagtacctagggtagataccatatctagatggcaagttcaaagccaacagagcttgagcttgagcttgacccagattccgatcaaagtagagatcatcaaactgctggagttgtagctgctgcgctatggcctgaacaatgttaatatcttgatagtgagactgttgcgccaccagcctgagctgttgccaaacttggttgtttttcagctgaaacgcagctgattgcaataaggggcttgctgctatgccatactgctgccttacgaactcattatatgggctaagcacatgttgctgtagcaggagaggtgactgcagctgatattgcctataactttgacctaaaacatcaaactgcgcagaggcgctgcatgcagcaatagcaagaagagcaaagatgaaaatgatcttcattgcgacaggacactagatctttcttttttactgtataatgcttgaactgtgtgaacgatggggagggttttcattgtctatttatagatgcgatggcacttattttctttcaattcctcattggttgctttggagtgctagttttgctttcatgtcctattaggatccaagtgagtcatgtcatttggacatatgttctattaggtgcctcaacaaatcccctttgatttcatcacgaaagtaacttttgtgtccatcaaatatactccctccgtcccataaggagaaacccacttctagggatgaacctagacaatcatttgtccagattcatccctaaaccctaaaccttgtctaggttcatccctagaagttgtcattttttgggatcggaaggtgtacatgttggttagcaggctagaaaaataatgatatgacacatcgctcactttatacgttagtttggtaaggattgcaaccgttatctagctatattcgttatgttttgtgagctattatttcactaatgcatgacacgttgaacattaaggtcgtgtggcctcatgcattttatattacaaaatttcaacaagagtgacaaaaattatggtacaccaagtgctttttattgttccgttgttgtggtaccgaacatttgattttacagcaagaattaggtttgcactgaattcttaaatcaccattcgagagatttacgagaaatcaccattttgctatacctgtagtgcaggattgacgtaattcgtattcttgtaaaccaacttgttacgtgttttcttgtctaaactttttggatagacttgggctgtgttcggaatccagggttcccaacccatctccatcgtattccgcgcgcacgcttttcaaactgctaaacggtgtgtttttttgcaaaaagtttctatacaaaagttgcttaaaaaatcatattaatccattttttgaaaaaaaagctaatacttaactaatcaagctctaatggaccgccctgttttccgtgcgcactttgcatgttgggaacagctgattccaaacacagccttgattcgttttcgagatagaaaagaactaccacagatttgtagtgtgtcaagaaccggtttcctttgggtacatcatgcgtgagttcctctagttttgttgaaacatcatgtttattatccattttgtttgcagtaaactatcgacttgctatgttagaatgaacttctcatagaatagctagtcccaagaaagggactagctagtgtgctgtcgacangtttttaggtccagaactgtcaaatttttcaaccataggatttgtcatcaacgattacaggaaaacagtctgcactagtacaaaccacgagtcttagtgcccaaattgataataactttcaattcaaaagtaatatgcatatatatgtccctgaaaaaaattacaaatcctaattttataccatgtaattaccctgtaactactctagttggtgtaagtgctatgtaactaactagagtatgtaactagagtataagtgttatgtacctagggtgtaagtgatatataactacaaatgctattaataatcagaaagtgcccgtacctcagcgtaacgtgtggcaagtttgatggatagatcctagctcgttcaatgcttgtctagcccacacgagattttttttattctacccatatggccgtatatgttgcacgaatcctggagtgcatctaatggctagaaaatcgaaagttttctaaagaaaaaactgtcgccagttttttagcaaaaccgttgtttcttttttcttttagttacataaagagacaaaaaggagatccaacgtcccacattgtttcaatccccgggacttagtatattttgcactacttgacgagctctatacatccatggttcctgatcgcctattcgaacaacggtttaaaaaaattgaacttttgcgcatttgttctaatattccccgaaatatactaattcgaaactcggggcattacacaaccttagtgtgtaggagcattccataagtaagacatctcataattttcactttggaagaagtgtacatttatttaaagtcactctttcgtgactgaataaactaagaagcatcataaatccttctttctagttttcacccttattgttgctgctgcacattttgcttctatactgaattagttatgtctaggttatacttctgtgatgcaaagtgagcgaggctcaactaaagaatgccttgtacactacatcttgtcaagaatgatggacaactgtcacgcccagaaattcacgaaccagaatttctaagctgaatgtgcattaaacccatgtccagaaccagccagggtatacaaacgacaattgttgaaatacagatccacgttttacaaaaatataaaagattacaaatgcagcggaaaagatgaaagccagctaagcctgaagacttgactccacatgcatctttgacggcagcgacgaaaccaatttcttcgagacatctccaactaagaagaacttcaactctggtgtggggaagagagagcaagactaagtacttcccactgtactcaacaagtcataccggaagaggaggtatgatgcaagatataaccaaaggaggctagcggttcatttgcataatgcttgcatttaaaagcagtagttgaaagcagtaaaaacagttgtagtatttaatcaatattaaccaatcactgctcaacactacaccacattgagacaagcccaaaccaccacctgaactaactagttacattagctaactaggggtgagaataattgtcggtgatatgggcctgaggatatgagaagtatggggaagtctcaatcccgtccagccacgcggccatacagcctggccctccccccacatctcggacgacgcagaggcagccagggggcctcggggtgccacgtcacgcccctttgaccctcaggctgcctcgccccgaggccctcgcccggccgccacgtggcggggggagtgagtggggcggtggccgaatctgagccgccatcaatgaatagcaccccaaccgtcccacaccgcatttaatgcggtgagggcggacgtgcggcgctgcccgattgacccgcgtcaatcgggcgtgaccggtctgtggccgatcacatccaatcggacgggcggcggtgcccccacgttccgccctgtgctcggcggagtgggggcaggtatgccccgtcccatcaatgcatcgtctagagccccctccacgtgaggtgaaccgccaaaagtctccattcacttaaaggggaatgacaagggcgtcccccgtgtcaggcaggggacggcgctgggccccactcgaggacggacggctgcttagcttccggtgaaggcacgaatggtggtccgctccaagcggcgtgggccccctcccttgaaggagtaggtagaggcggtgcatgtggtatccccttgaactataaaaggaggaccttgcccactgaaaaggggggatgactctcacttagcctaagccccagaggaagaagagtaagagttctccctggagtttagaaacctttgtaacactcaaccctaaatcccacgcacaggagtagggtattacgctccctagcggcccgaacctgtacaatcccagctctcacacgcggtctcgaaagactctaggcagatatacgttcttgatcagtgcgccctttcccccggccgaactcacaaaagggggtccctcaatcacccgcaagagaggatcattcctcgacagctggcgcgccaggtagggggaattcgcgcgtttgaaagagaaatcgtttccttccaccacaagtttccctccatcctcaacgatcatggtcgaggtcctagaggaagaagtggtggcgcacacccctactccctccgggagtgacgatgctagcgggagccgcggcccccaccaccgtcgcaacaactctcccactcctgcccaccgcgacccccccacagagggaggaacctctccccgccgccgcgcggggagaaaccgcgcagtgtcggggcacggggccgcctgacatacggcaacggcggctcatcccgaggcgcactttaggcggcgggagcccttctacggcatccccccataaattcggagccggagacccctgtccagcgatggttggacaacatgaccaacctggtcaccactgcccagcggtagcaggctgcgggtggccgacccgccgcctctggtacctcgcgtaacccaccgctctttcctcgtcagcaagaaggagggcccgtcggtcggccctgacttcgaggtggtcgacggccccaacgtcatcgaggatctcgggaagccggggacgtcatggtggcctctacgaggagggacgctcgaatcaacattgagcaacacagggacgagcactgggcggcccgcatggggagggcgccttctcatccggagtgccccgcttcttcacgcgaggcggcccgcccctcacatttaccccttggagggaccagttgcagggcctttcaagcgagtcttcaaaagtccgttggcccccgaagtttccccccaacctcacggagaaatatgatggcagcacgatcatcatgatgcggggggcgacgactaggtcatggcgaatacttccccatggctcttaaaggtcaggtgcgcggctggcttatgactcagccccccgactccatccactcctgggaggacctgtgccagcagttcattacgaactttcaaggcacgtatccccgcccaggagaggaggcagacctgcacgctatacaacggaaggacgacgagtccctccgctcatacatacagcgcttctgccaggtccgcaacactattccctgcataccggcccacgcgggcgtttatgtgttctagaacggcgtgcgacacaactgcatgctagagaagattgcctccaaggagcccaagaccatcgccgagcacttcgagctggcggacaaggtggctcgaaaggaggaagcgtgggcctggaactctcccggcaccggcgcggcggctgcagctgcccccgagcccgttttcccccccccccaagggggaagaggaagccggcccactctgatgacgagggccacgttctttgcggccgatgggccttttgggccccgtgcaaagaaagagccacccgcaacaagccgagctttttccaaattaaacccccccccccccctttcccctctggggggggtaaaaaaaaaggggggggcggtttgcggataaggggggtcgatgcacaccacctattgggacaaaatgggaacaaccttaccgaatggagctgggcaggaaa

SEQ ID NO: 66721 - DNA, 8949 bp, Oryza sativa
cttgggtattacgtttccttttatattatggagcggcctaaagtcctgatttgataatattgtaaaatagatttaggaaaccgatatcgtattggttaaggtttctatcttgtaatcctgccccccatcctatataaggtgggcaggaggccctctagggggcatgagacaacctgatcgtcagatttatactatactcggcggattcaaatccccaaacaggagtagggtattacctctcattgagagggcctgaacctgtctaaatcctttgtctctgcatccatccacttttaggtctcttgcgctacccccttttattattgccgaattcatgtttcgacagtcggcgcgctaggtaggggttgcgtcgaattacccatctataagtgtgatggaatcaacttcagaacaaatgctcagatcaatctgatcaagttcgatggcttgaatcttcaatcccggtttgtctgttctaatctgatttgttgttattagattgattaatcgcagattaaactctgggtatcttttgtgtttaccttatgcatgattgttgaaatcaaccgtcatcgccggctcaccttcatgtcgtgtccgcgtgatcttctattaatgagatccgccggcttcctccgatgacggcgttgtgctgatggaccattaagctagccatcggctacagggccagatactcagatttggtgatggttaatttttttttaattaatcaccgctggcaagccggccgacgccgacttcttctgcaaatcgatgaaaaagcagacagcatgcaccttaattatatccagatcattaattttctattgctaattggattgatttctgattacaaattaattaatgcttttttggctatttcgttggcatgtattcatgtactccgtatcaaacaaggaccatggtgggcagcttgttcggcttcatgacatcatctccgcccagcagatcagatggatccgcctgatgcgccccacggcagcctccacgctgcaactggtgctgctgcctcggcgtcctccctgcgattttcctggagtgaatacatgcatgagttgatccatcgatcaacgtgcactatttacttatataatcacgcgtatatttgcatggatttcttttgagctgaccgcatggcaaatatcgtcacggccacaactagaaccatcaattcatcgggttctttccttttaacttattattctatattattagattgatttttaatctcagattaatctcttgctattttttttgttgttgttcacatataaaattacgcggcactattgaggcgattgatgctggtcatggactcgaggcgtctcagctttccggtcaatcggccgcgagtccactccgccggattgtcctcgccaccgccattgctgatagcaacaacgacttcaccgccggcttgcctccgtcgccgccgactggtgtctccgcctacacggctggcctgttatgctgccgtcattgggcgtttacgacttcaccgccggctcgcctccgtcgccgccgactggtgtcaccgcctgcacggctggcctgttatgccgccgtcgttgggcgtctatgacttcaccgtcggcttgcctccgtcgccgccgactggtgtcaccgcttgcacggctggcctattgtgccgctgttgttgggcgtctacgacttcactgccggcctgtctccgtcatcgccgactggtgtcctcgcctatacggttggcggactccgcctccgttgatgggcctcgtcatctacactggcttgccttcatcgccgctgcctagtgttttcgttgctactgatggacgactttgtttccacattggccacctctatcgtcaccgagggaaatatcaaaaagctaagtcatcactaattttcttttttatatgatattttccttttcctctgcctcactacgtcaactggttcgtcgttgcctagtgagtcgggggctacagatgttatatcaatattttttcaacaattttcttaatatttatcttgattgctcgcgacataacctgagtacaaaagtgccaatcgagttatggagtttcatcttcctatgctttccgtttggtttgctaatggatagttgcctttgggctgattcctagcacccgggggctcgttggatggaccgaataacgcaaggtgctaagtattaatcggaataaatcaaaagcatatagataagataatttattttctgctctttacagttacaaaagtacccgagtagtaaattctgattcgtgaaactttgttccattaatgacgaactcatgtcactcatatgcatgtttgggaagtgcctaggccgactcccggtgcttgggggctatgactactcggacagagcgtttaaacgtaatgagtgatctgctcggggaaatcaaaattgacaggaggagaaatacatatttataaacattttaaaatacttttatttttctcgagtattatatttacatcagatactactcatcctatatgtttgttctgcaggatccagatccagatatgcacaaaagggattcatggctttaagcttatctcttacgctcctgtaagggatcagtcagaacatcaccaacggcttgccgtcatcgccgccgactgttgtcttcgcctatacggttgtttggtcacaccaccgttgttgggcgtctacgtcttcaccgaccggcttgccttcgccgccgccgactgttgtctccgcttgcacgactggcctattatgccgccgttgttgggcatctacgtcttcatcgaccggccgcctcgtccgccgccgactggtgtgtccgcctgcacggctggcctattatgccgtcgttgttgggcgtctacgtcttcaccaaccggcttgccttcgccgccgccgactggtgtctccgcctacacggctggcctattatgccgccgttgttgggcgtctacgtcttcaccgaccggccgcctcgtccaccgccgactagtgtttccgcctgcacagctggcctgttatgacgccaactgatgctatcttcttcacggctggctacgtcgccgtcaccgctaatagtttattcacttccatggctgcatgattctgccagtgttgattggccttatcttcatgaccgctggtcatctcgtctgctgttgactagtgccctcgcctctacatctgtttataccgctaccactactgatggacatcatcgtcttccgtcactgactggttatgccgtcgccgactggtgcttttatcttcacaactgcgcgtcttcactaccggtttgcttctgttgccgccgactcgtgttcacttcatcacggcaatgcaactttgtcatcatggtagagcgacttcatctttattatcttcggcaccggcaaactctattgccgatacttcgcaagttttgctacttcatcaaccacgacgtctttgtgaacctcgacatctcggcatgcgatgccgtgttattttactacaacaagtggctctccaatattcaggatttttacttggacatcttcaacacatatcttcaatcaagcaatgactactcgacgataagaagctataattctcgattctatgttcagttgtttcccaactaaacaaatagtcgggggctacacaaatatatggctcaaaattcgacaagctttatgtcaagatgaagcaatcaattaatcagccaacgagtcaactctgggagtcatcaattttgtcttcgcttcaaagcagttggttaaaattaaatttacatgtctgggagtttggagtcatcaactaatcaactcatatcagattcaatgagttgaacaacagcatatacttttctctaagtgaagcatctgcaacagctatagcaccaagttctactgccatctttataaatcaagaggtgttgcatcaatcttcatcacacacatgccaacattaagaaaatacttgagcttcgatatcttctcaacaatttaatggattattgtcactgacatcatcaccagcacctctgcttcatcggctctgacattccgccgttgctaatggatgactaagacttcgccaacttgctatttcgccttcacggttgacctactatgcaaacgctgatgagcgtcttcgtcattatcatcggctactacaccgctattgactggatcaccgacatcgtcatcttcatcaacatcctgtcaagcctcttcatcatagcttactctactgctattgatggggaacttcatcatcatatttgatcatctctgttgatgcttatcatcattactgtcggttacgtttgtcgtcgccgactattttcttcatcttcatgattggtggatttcgtcatcgcctttgatctgcctcgtctgtcaccgactgattatttcgctgccatggctacacaactttatcgctgggcaccttcatcttcattgatggctgacctgactgctgccgactggtttcttcgcctccacggctgtgcaacttcatcacttttgattggtatcactatcttcactaccactaatatttttgccacctctgctaggcaatattatctctatatcggtcgtcttatctctatgccaactgcgtcagctaccatcaatgaacaattgtgactacgtgctcaggggcttactagctcaaacacaagtattataccttcaatttggacttgctctggatacatgcaatatgaattcgtgatcatgggtctattttctatgctcaaagactggactatttattattccccataagggttacaaacgaatacttgcgccagtcgggattcaattattatatctattttggagtattccataagggataatcactcagatcagaagctattgatatgagctacacttggtctatatcacccggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttatatcgcagttactcaactttttaggagttggtacaatgcatcttaaaaggtgtcaaacagtaaagctttatatagctgccccgctgacttttttatatagtcaaggcactatttgggtttatcaagcaattgattggatacaatatcgttgctttttgccacgtaagtgtgcatttttattgaccaatattatggcttaagctgattatacattgtggtcattttctaggcggttggtaaatcctttatgagtttatttacttggattttacaccacatatgccatatatttccaggtgtggtgaaaccatgtgtcttttagggactaaagcacgtctgttaaagcagtgtgcgcatggcgtatgcccaatactttggaaatttctttattcgcagcattcaagtttctttatagctgttttgctatgtgaattttctatgatgtagttaactttaggttgctcacatcaatttttacaaagcagtcggtatatcactcggttcatgttatttagggattcacaccgcatatgctacatattaatatcaagtcgcttggttgaccataattattgaaaccacttggttggttggataatttattccttgactatatgcttggtttgttcaattaaccacatagtcgggggctacacctatgaggtgcatctagtcgacgcacctgactttatttttcagccctccacagtcttcatatttggtaaaagtactcgggagatcatggcgaagatgattgaagcactcggctttggagtaatctagtttgagaaaagattatcttttcgactgtgaaggtctcaggggctactgtggagattatgggtaccccatacccacacggcatggttatccgactagtcataggggatagcttatatctatggaatatgtaacagatcatgacttgggtattacgtttccttttatattatggagcggcctaaagtcctgatttgataatattgtaaaatagatttaggaaaccgatatcgtattggttaaggtttctatcttataatcctgccccccatcctatataaggtggataggaggccctctagggggcatgagacaacctgatcgtcagatctatactatactcggcggattcaaatctccaaacaggagtacggtattacctctcattgagagggcctgaacctgtctaaatcctttgtctctgcatccatccacttttaggtctcgtgcgctacccccttttattattgccgaattcatgtttcgacactctcgctgtcgtcgtcgtcgtcgtcccagcgcggcttgtccacgcagtcccgcaacgctgtcaggaggtgcagcttgcacccgccggcctccatgtgcttgcaggttgcggcgacgtcggcgatgtaggagacggctagagcagcatcccacgagactgggccggagcttccctgtcccatggccgccttgattcacaggcttaatgcagacgggttagctagggtttgtcggcgttgtcgatctctatggagatctgaaatattttgttttgtcggcgtggagacgaatagtgtaatatatatatgtaggaccctgcagggaaattgtattgttgcaggaaacctttggtaattccctaccgtgcacggacgacatgacgtcaagctacctgtaaccgatctgcatatccatgtgctgattaattcggactctactacgaagctggcacacataaacattatgttatgtaaccactggaacggatatcctcatctcaatcgggcggtaagccccatctcaatcggacacagcgtccgtcacaggctagaagtcactgatgtgaagagttatctcaatcgggcaaacggccgtcacggatgaacatatctcaatcgggccctaagtaaagctcgtcaccgatagctttgacccagacgaccagtcaaactatagcccgtcacaaatgacctatcttaatcggaccacaattagcgcccgtcacagatgactactaacctttatcaggcctaaactagagcccgtcacagatgactgctgacctcaatcgggcctaaactagagcccgtcacagatgactactgacctcaattgggcctaaactagagcatttagttatggcccatcccagatgactataatccacaaaaaaaaaaaattttgttttttggctagtctcaggcctttgctagccatgcccgctgcagaaatgacagaaacaaacacagatatccaatatccccagctccccagcatcacccattcatatacatatgcattcacatacacagacatcaatatatttcacacaaccacacattcacagccatcacatatttcacatccattcacatatttcaaatccattcaaatatttatcatatttcacctgcaaaacggagttaattggatcaaatatttatttagcaagtcttaacataaacatatgaaatatatacataaatataagcatcacagttacatcatcacagttgcataataagtgttcacaattgcctaaacataaaagttcaacattattcattattttagtttaagcctaaacattcctttggggttaattatttcgcggaggatgaagctggctatctcctcgcgaacctcctcaaagctggtaggcagagacttggttattgtgccctacattgtcataatttcagattagttgatcgatcatatataaggactaaaatgtagttagtctatcacaagagaccaccgacctcaaactcagccaaagtcttcaacttttctctttacagaaggtgcatgttgtggcacacatggaatccgcactggtcacctatttgtggatgagggtgtcatgtcctgtcttctgaggcttcctctttacacgtattgggcccacgcttcatctatcgctagttgaattggggtccaatcatagtttaggtagtgatatgtactccacttaggtgttatgaccagaaggatccaatgggcactgcggcattaatatagtgaaagttaattaagtactgaaggaatgtgtcatgctattgtgtatatttagataacacacttactattgattataggcgcacataatgtacttcttgtctcggcgggaccacaaggtgtcgtagatgtagttgaccattccttgacggtcattctggagatttgtgacagtgaccacttgtggatcaaggaaggcaacttccggtgcattcttctgacaccattgccaacttaacctacacacaggataaacgatcttataagcgagttaatccgattgttattaccagattgagttgggcgacaatacttacaaggagtagcacttaaggaggcttgtgtccaccgctcggagactgtagaggtcgaatagatccttgaacgttagccaagcaatgtccttctctgcggccggcacgagcttgatgtcatcttgcataatactaaatttctgcctccctatgaccctgcagatagacctaaatcggctcaatattttctttggagatgtcggcaaccctacggcgtccgccgatgttatgcggaaccgttccttagggattttgttccctgtcctaggagtacgtgccctagaggacccactagttgtcgtcgacattggttcgccttgctgagacatcgtctactttttttcaaaacaacaaaaatacacaattcagtgctacaatctattacaatgaattgaatgtcacttataaataaatgaagcgtataaataaactaaattgcacatctcacagtaatagaatgaattgaatgtcacatataaataaattaaacagggctgcaggaa

SEQ ID NO: 66722 - DNA, 5577 bp, Oryza sativa
aacagattcataagtaaagtagctatacatccactgtctaccttcaactttgatctatagctaaaaacgaacagatattaatcttttaaagtcaataaatcataggtgaaatgcaaaacgaacaagaaaagatagagcacgcacaaaggtactccctccatttcatactataagtcgttttaacttttttcctagttaaactttttaaaatttgatcaagtttatagaaaaatatatcaacattttcaacacaaaataaacatattatcaaaatatgctcaatgttacatttaatgaaacaaatttggtgttaaagatgttgctaattttttctataaatttaatcaaacctaaagaagttgactacgaaaaaagtctaaccgacttataatatgaaacagaggtagtacatcggatgaagaaaagatacaatgacaagggacatctatagagctgcgtgatcatagcatcattcagagaagggaatcgtctaccatgcactggacaaatcttgttgcttcaaggcctattctttcacctttctgtgtgaatgcctttatgacacgatacacatcttcacgctgcctggacaccttgcacgaaaaaacaaggtacttatactagagtctcaacaggaatttattagatcggaaaggtcaataacagggaattcaggttattgttttatttgaaacaggggcccttgttttattaaggaaagggaattcagattctattaagaatgtgttttcttaaccatatcacttcatttaaccatatcaacaatggaaaggaatgaatactggaatgatgttatgtgttacgaatgctcactgaattggttatataataatacaagtatcgtggattcttaagataccaagataccaacctatgtgcatggtttcacattatttatcaacagtgattgcaactctgtctggtagatgtataactaccagcagttacaccgtgtagatagaaaaggaaataagtaacaagttgcacctgcactgctggaagtgagaatccaatcgtttctctgcttctgcactggcccttcgtacatcatcagacggtgagaccattctaggaagcacacaggcttgaaccagtgggaactgctgagcatctaattccgccagaggtgcaatgacattagagaagctgacctgcaacagaacatatcatgtaccaaaatatgaaacccgtgccactctttggctttatgcaggcaaatagacagtataggatgaatatatcctgccagtgttgaggcatttaaaaagaacccacacatttattcatgtcacattatcaacttaatgaaattaagaaacaacatactgtaaagcgtacgtgtttctgctgctataccacaaaaagcatttcaacgtaatggtgggatgcaaatgaaataatgcagcatatacacattccaaaacaatgcctaagatttgattgaaaaggtatattccataaaaaatgcagaggcagcagagtgttggatacatactttatctaggggaaccgcagccacagcgtcgtatgtttccttcgacttagaaacgacgcgatcagctaatctcttgatgtcagcagctgagaggttgacttgcgcagtaaaccctgggagctctgcaaccatccaacacattcaaacattcaatcacgcgaaaactacgccactaaatcttcataactccatgccccaagagttaaattcctgcaatatttattgcgatcaaacacatatttctacatctcacgcgtggatttgcggacagaagggcaacattatgggggccatttttccactcttcacgccccccccccccccaaaaaaaaaaaaaaaatcaacagcggatgctacattgctacacaattgagcagaagcaggagaggcgtgcacagcttgaggaaaaagtagagcgacatgaggggagcatcgtaaccaaaactccgggggggtttcgggcggcgcgtacctcgccgcttcctgcggcggtgggcggcgacggcggaaaaggcgaggttgaggccgacggcgacgagcgccgccgcgccggccgcggcgatgacccggcgctcccgcctccggagagacatcggggcgggaggaagcttctggaaggttctggaaggcgcgccgcgggcggcgaagaggagagagaggggaaaaaaaacggaagagcagctggagcagcgggcggctgagagctagagctaagcgagcggaggtgacgatgatatgcgagatctggccgttggtatccgcgtggacggctggatttaagggagatttttgcacgcctctatagctgtatacagaaaattgatttgtacagtactttctactttgtttatgctggttgatagcggattaccagctacaggatcagcattaggattaatgctaaagagatggaaagcttgtccatcaggtttttttttcaagccaaaagtcactgttgagctatagagctaaagataagatcttctggatttgttcaaatagagtttcgttattaaaaaaatagagttttgtccctatctttaaacattggcgtagtgaattttaatcttggttttaaggatgtgtttgagatgagaggaaatgagacgattgagatgatacacgaaatgaggtgagccgttaccatatgatttttttataggaagctgttaacatatgattaattgagtattaattatttcaaacttgtaaaaatggattaatatgatttttaaagtaactttgctatagatattcttttaaacgaaaagacgtaccgtttagtagttcaagaagtgtgcgcgtaaaaaaaagatagacttttttctcttgatccaataccatttaacatagacttaattaagcaatgtaatatgattagcttatagcttaagagctcatttagaacacatgatttagaaaataaaggaatagaaaaaatatagagataggatgacatggatgttgaatctaaaaatggtccacatgagtttgtaacaaatgtcttttggcaaaaccaaagaaaaaaatatagtaacttcatgactctagaaagagagagcattaggttagttttcctctgaaaattttatgaattgattattccaaaggaattttaaagaattttgtggaaatccagtcctttgttccaaaggatcaattttcatataattctaattctctaaatttcttccatttttccttcgttccaagggtgtattctgtaccctctcaacttctatttttttttgtcacacgcatacttctcaaactgctaaacggtgtttgtttaaaaaaatttatatagaaaagttgtttagaaaaaccatattactaccatattttaagtttatttttactaatattcaattaatcatatactaatgtgtcttttcatgatcgcagcctaaagaggctcgtttgtgcagtgcccatcggaccatctctaaatacaagcccatgcctcggcccacaggcccatgtgcatgcatccgggccatccggcgcgttgtgaaggttcagatcatgagcgagtttaatgcctgtgtgcgtacggaatcaagttgcacattgccagtcatgacaaaaaaaaaaaggtgtacaatgtagactcgtatactagccgtcgattcatcctctcaaacatgccctgatcccgaaaaggttgtccaacacactgaaattcctgtgtataattatccatgttcttgttgaaattgaacgtgcgttacacgcaccatgcatgtcaagttgatttttttttaacacgggaaatggaagactgggttgatggtaagatatatagaaagaaatttaagcaagcggtaatcggtgaaataactagctctaggatgatatcttatatttcaagacacattttgaatgtttaagcttcatatatttggggacgaagatactaatagataacaccgctccatgatggtgtgtctgtttatacctctgtggttaatatagttagagaaaatatagtgcaaatcacatatctagtggaaaactagaaactactcctagattgaaaaatgaacatataggattttttacgttataataagagtaaaacttttattcaacaatagtttttttattttcagtgcacttgtttttcatatagataatccatccgtggtgtttgaatatcctacgcaaaatgaggtgataataacgtgtgattaattaagttttaatttttacaaacttaaaaaatggattaatataatattttagaacaactttcatatagaaagttttcatacaatacataccgtttagcagtttaaaaagcgtgccaggaatatttataacttaatccactttttttaagtggaaacgaactgagcaagaaatgttggtcctgcggcttagctgttcgtggcccgcgtgccatcaacccgtactctctctgtagaaaaagcaaatcatgggttttcgtgtccaattttgattgtttgtcttatataaaatttttttataattcatagttttattattattagataataaaacatgattaatattttatgcgtgacttatcattttaatttttttcataatttttttaaaataagacggatgcttaaacgttgggcacagattttttttttatttttttttttttacggagggagtacgtcgtggtgcctgactggcgactgcatcttcatggtggacacgctgggtccgtacgcgcgtgaaaccgactgctcacgcgcccaaagtacagggcaagctaagctatagctgtactaggctactggctagctagtgctaccgtggtccgtggatgtgtacgagcgctgcaggcaatggcagggggcagcgtcatattcacgtggcagacgaggatgcatggaccgccgcccgccattcgctcgccggagacatgcatagcatacgtctttctctcgccggccgccacactattatgtcgacacgctgtgcacacacgcacgggtacatacgtccaaatgtaggcgtttgcctttaatttgcgagctgaccaatccgagagaaacacgttcaaaattgggtgggtataccatactccctccgttgcgtaaaaaaaaacattcttcctccgtttctaaatatacaccattgatttttagcacatattttaccgttcgtcatattcaaatacttttgtaaaatatgtaaaattatatgtatatatatataagtatatttaacaataaagcacatgataggaaaagaattaataattacttaataagaaaaacggttaaacatattttaaaaaatcaacagcgtcgaatattttgaaacggatggagtattttttcaagtataaaaatgctatatataggcatatatatatatatatatatatatatatatatatatatatatatatacacacacacacgtacatatacgagtgatgttgcgtgcgtctgtctccatggcggtcttcatacgtcttcttggctgaagcattcggacgcggctggtcactagttaaaaggctatgtagatgagaagcagactaaatattaaatattaatggtatacactatattttt

SEQ ID NO: 66723 - DNA, 4464 bp, Oryza sativa
agatgttatatgagagaaacaagtgggccatatattaatggtaaatagctatctattatatatgtaggctaagagaaggctgcaacaaattttatagccaacaaatcagctgtattagccttgctcgggttaattactttaagcacgtatttgcgtgttgccgtctacgaagtctctggattgtcatgcatgcatacaggtaggcatgggcatgattaaagtcactcgcaatcttccactggtatcttcacgaaggttcaaattcctgaatgtttttagaaactcatcagatgtgaaaaacaaaatctcagattcttacgggagtgaattggttcctgcccagaaactccgatataaatcaatgaatccaaacaaagggcttattcactttgataccattttcagccataccattttttaaaaaattaattaaaaaatctacgtttagtttgttgtcaaatttagtaaatacataagaaatcatataaaaaatttgacaatattgccatcttgttaaaattttagcaataccaaaatttggtaatgtttattttggctacaatctaaacagacaaaaaaaaaaagtcctgattgtttcaaggaagaatgagcaagagcgataattaccggagaaatcaagtcttttacaaggaaacactaccataataatttagttggaacagtaacagagtgagatcagtaatttagttggaacagcaacagcgtgagatcagtaatttagttggaacagtaacagagctgtagccagtaagcgaaagggcatgtagccatggttaccagtgcctcagtagcaactgagatcctgggttcgactccccatggaagtgaattttccagaatttaacggcgctgtgctttcagtggtaggcaatgtacccgtcgacagcgagacgcatgtggtgacttcgtcaatttatccaggatttgccggcccagtcttcgaagatgctcataagggtagggtttacgtgcgtgtgtttataagggtgagtgcgcgtgcgttgtgagtgtctgcgttgtattgtgtaattcttaaaaaaaaaaagagctgtagccagtagcctgtaaaggctcccagcacgagaaagattcacagctgcaggaaaatgacaagatttggcaatctgatgatctgatcagaacggcgccgcgccggcatgtgcagataaaagagcatcgggattcacgggcactgagtaaaagcagcgtcgggcccttttctagcacgaatctggatgctacaggtataccaacagcaaaacgactgaaaaaaattgggtccaaacaatatgcactaccacatatggtgccatggtcctattctccgctctttccttgccaaaaaaggggcatcgatcgcgacatgcaaccaaggctcaagtcgtgattaaaaaaaacatatagtcattccagatcattaatctaaacaagaactactgcttgacgggaggaagtaaaataaatatcaagcatgagacacatttccggctgcaacatcgaacaaataaaagaagggaaagaaaagatgctattgcatgtgttcagtaaggcacgaaaataaaatagaacaaaccgtagtcctctcttggtcaatggcaatattgatcgtaccgtgcttcctgaatccttctcccgaccgttttcatggtcacatgcacctgaaaaagagaaactaaatagagaataaagtgataattatcatcaaatcaacatgacacgacagtaccatccatccatacagaccacacacacaaaaaagaagacattaccacttgctaatacaattgagatgtgcttctatgctcctcagaaaaaaaaaagcacgaatgttaaagatggtgaatggtctaaattaaaaggtgattaacaggctaaacgttattaggaagggcaatttcgtccttgaggtagttacccatatcccaaacgttcaatcctgatgcagcgccgccccgactgccgccacattcgatcgcaagtacaagaaaaaaaaataaggcattccatgattccaaaacagcgaatcctcctctgttccggctacacatgtgcagcacctcaatccaccatttgattggcatccatgttcttgcaaaatcaaaaaatgagatgggggtagagataagaagcatgacaagaaaaatcagaaatgggtgaaggcagggagcacgccgcggtagaccaacgggacaggtggtgtggtgagaggaggaagaagggggtggcgcagcaaaagtatacgggcgatgcacggtggaggaagcgagcacgatcgctgagagtcatcgatttgtaactcctcatcggctgatcgagtatgtgataacttcacaggacaaaattgcccctccctaatgacttttactctgttaagcaacttttaatctaaatcattcatgagctttaatatccgtgcaggtttttttagtgagaagcatagaagcacatcccaatacaatttcttttaagttcacctgctactaaaacatgttctgcgacgtggataatgaacagaagataagataaaaccacgaagtatgaaagttaagcactcattttcccattctttcttcccaagtacatcacttatataaagtagcggatccagaaaaaaatagcaggtatcctatacctattaatagtttacttatcaagtaataatattgtaattaacatggccaaaaacaaacatcctaccaggtgtcgtgtgccccaggctctaggttctaccttctcttccacaaccacaaggtcctaaccaaccaaattggacgcatgtatgtgtctttcgctcaccttctactcacatgccgtcctcttttgcattggccacctcggtagttcaatgatcatgcactcgatcgtacagccgaaggactcgatgcaagtgcacgcatggtggacacatgcatgtctgcacagcacactgttggcagtttccactgccaccgagatgccgctccaaagttgccgatccggcgtcaggatgccgtagcgagatttgatctctgtgggcaacttggattggtgtcccggtttgccatactttctgtctgcatctcataacatgttgcagatatagccattgcgtttggataaacacttcagctgtagttactacattttctttatgctgcagctcaaggtaccttggaggcccggacatggaaatggaatctcaaaaatcatggatatgtctttttaaagatcagagcacttcttgtcgtgaacgagttgattgcaggtccgattaaaaagaggagatcccaagtccagatcctataagtcatatgcaatcaggttctccttttggtctgctcttatcggctctgcactcctcactttgtttgctggctctctttcaagtttgccttagccctagactcttgccttgctccaatgtaacagtgcagttcctgtcatcttggtgttctgtttctctctgccataagcccattatccgtctggtgatttcggcattggatggagaccttagcagtattggattatgtccgcatagcatcgttcgctatcttgctggtttggatccttgcagagcttgccaggctgaacaagagacatcgccgagaaggacatggcgacatggtttcatcacaaagaaaaggggaagtcctgctaccagcttatataattgtactttgcaatgcttcaatctccttgatgcatatttgtttttctgttcttgtgttctggaagcgccaaactgtctccctggatttgatcttcaaatcagtctcatggcttctagtgactctcttcttgctctactgcaaacatgaaggtgcaggagttgtatccaactggccttcagttcttctctcgtggtggttcttcagcttcttatccgaatcacttctcacttcgttgcatttgcttcacctcttcaactctgcaactgttgtcgatttcacttctcttcccttgtgcacattcatctgcctcgtggcagtaactatgagaccttccaaagcaaaccagcaagaccagaaccaaccgctgcttgtgagagaagacagtgatgacagtagcacagacaggttctccaactccgggtggtggagctgcctcacattccagtggttaaacccaatctttgagaagggacacaaggtgcgtcttgagctcgaccatatcccatctgttccacagtctgacacggcaaaccaatcttatgcattgcttcaagagacacttcacaagcagaaacctgagccaatgcctatgcggagagccattatttgtgctgtctggacacctttgatcgccaatggagtctttgcaggttagtgagccattggaagaacaaaagtggagctaccctttgacctttatattatactaacatgatgctttgcatttattaccagggcttaacactattgcttcctatatggggccattcttgatcacctacttagtgga

SEQ ID NO: 66724 - DNA, 1926 bp, Oryza sativa
tgcaggtagcagagggcggcgcgatggaggactcgcctgaggtcggccgggggggctcggtggtggcggcgctgggctcggtggagggcgtcgccggtcggtggaggagacgccgggctcggtggcggcggcggcaggctcggcgaaggaggagtttgcggcggtggcgccgggctcggtggagggcgtcgccggtcagtgtagacgccggtcggggaggtcggcgtcgggcgggcagcgtcgggcgtcggtgaggagtaggcgacgacgatgaggaaggacgtcgccgggcttggtgggggcagctgttcgcgtcggggaagaggcaggcgacgacgacgaggaaggtcgacgccggtcgatatagaggctcggtggcggcagcggcgggctcggtcgaggcggcggcctcggcggcagcgacggcgggctcggtggcagcggtggctcgctcggtggcggtggcggcgagggaggacgacggcggcgaaggaggagttggcggcggcgctagggttctaaggaggcgggaaattgtagcgggacttagaaaaattttcgatccgatctgagaaaccctagttataggagagtaatgagtcatctcaatcgggctttgccatagggcccgtcacagatgactcatcggtgacgggctccatactaatgcccgattgagatgatattcaggcccgtcacagatgactcatctgtgacgggccctaagataatgcccgatagagatagattaatctctatcgggctttaactaaggcccgtcaccgatgactatttttccatttttccgaacaagtctttatatttgtgcgtacaaaatatatagctgttgtataataattcattttattagtcataatatattttaggatactaaatgatttcaaatcgaaatatggttaacaaccaagttgtagatcctttcaagatctacaacttttattttggtcatttgtctatataactttgttcccaacagcttgaaattgattttgataaaattttaaatctaaacagcatttgtaaatactaaatgatttcaaatggaaatatggtcaacaacaaagttggtcctctcatcaagatctacaacttttcttttggtcaattcttcatccgacaaagtgatagttatattattcacaaaaatcacatttctctcatctggtttgtaaacatcaacacatatatgtcaattatgtaaacattagtactatcactttatcggatgaagaagtgaccaaaataaaagttgtagatcttgataagttgtacaactttgttgtttatggcttttccatttgaaatcatttagtatttacaaatgctgtttagatttgtcatattgtcgaaatcaatttcaagctgctggaaacaaagttatatagacaaatgaccaaaataaaagttgtaaatcttgatgagaggatcaactttgttgctgaccatatttccatttgaaatcatttagtatttacaaatgctgtttagatttgaaattttatcaaaatcaatttcaagctattgggaacaaagttatatagacaagtgaccaaaataaaagctgtagatcttgataacctctacaactttgttgttgaccatatttcgatttgaaatcatttagtatccgaaaatgtattatgactaataaaataaattattatacagcagctatatattttgtacgcacaaatataaagacttgtttggaaaaatggaaaaatagtcatcggtgacgggccttgacttcagcagtggggcgactccactccacaggcattccttgacggcagcgacgaaaccaacttcaacgaggcaactccaactaggaagatcttcagctctagtgtgggggaaaagagagcaagactgtatactacccactgtactcagcaaatcatacca

SEQ ID NO: 66725 - DNA, 1263 bp, Oryza sativa
ctgtgtgtttgcgtgtgtgtgtgagagagagagagagagagggttttgattactggtgatggcgctcagctcacaggggcgctcagatacggaggcgtcgttttgggagtaaataattcgatgcgtcagcacacttggggcctctcctcctcgggagtgtccacactccacagcttcattccgggtcagggggctcatcagaatgctactagtggtaacggctcccctcttttacctttcggaatttggcccccctcccttcagtcgcatgcagcgagatttaccgcgagttactgcctctacgcgatggtaaaaatcaccagcgtaaactgtcaaggattgtgctttactagttgcaacttgcatgatgccgagaacggatttaccggaaagtgacggtggttttagtggtagctttcttggtgtgttttttttttggggtaggagaacaagaaacgcaatggaatcctctgccagggtgaggaaaatggcaggtggcgagccgtccaaatctagattcagaggagtatctcttcgcactccgatgaaccaacacgcacgcgcgcacgttgagggagtcaaacacccgaaagcggagtagaaagaataaaagtagcgccacttgcccaacagaatcccaaaactacccacccattttgatcgagtacgtccgtctatatttagatgctcatgcgctcacatgacatcaaaaaattagaaataaaaatgcgcagtgcagcgaccacgcatgctgggctactggccggcttactgcaccactcattcgctctactcctcagagaggaaaaaaaaaaggaaaggaaaatgaggaaaagaaatggaaaaaagatactattctctttacacaaagttccttaagtcctagagagagagcttcatcgcatttgctcgccccctccatgaatcgatcgatcgatcgagtaccctctcattggtactcgtgccagcagacgagcatcgtgacgcagcggcgcatgatgtagaacctcgcgcgctgctccttgacgagccgcacgcaccggcaggtgaaggacggcctgctcttgccggcgccgccgtcgccgccgctgcgcacgcacatcgccaccttgccgccgccgccgctgctgctcctcttcttgtacagcctgcacggcttcaccacggcgtagagctccatgggcactgtggcgaggggtgaagaagggttacccagtcagtcgccgagacgatgggaaggagaagatagctaaagcagagggg

SEQ ID NO: 66726 - DNA, 5491 bp, Oryza sativa
cacaccttctttccaaagaatctccagatcgtcgataacaggctccaggaatacatcgatatcattgccgggttgcctcagaccttggattaacaagcacaacataatatatttccgtttaaagcataaccatggtgggaggttatagttcgcaataagaactggccaagtgctgtgagtactactcatgttaccgaaaggattcatgccatccgtacacagacatatcctcatgtttctagggtcggcagcaaagtctttgtgttttcgatcgatattcctccattcaatcgaatctgctgggtgtctaagcataccgtcattccttctctccgtggtgtgccaatgtactaacttcgcttcgttcgggttggcaaagattctcttgaaacgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgtttggacaagcgtgaattctacggacctctaaccccagtggaccgagaacctgctttgcttcgtatgtcgtctcgggcaatgtgttctcaataggaagtatagccttcaaaattcctaaaagatctgtgaaactcttgtctgtccatccactacttgccttcagcttcattaggtccaaggtaactgacaacttagtgtgttttgctttgcatccagcgtacagaggcgtctcggaatcactgaccaacctgctgaacttcattccatctctctcattctgggctgggtccttaatgtcacataacatgtcttgcagcagatcgtgatccacatcaaccatttcaccgcccaatggagaaggtataaacatgtcatgctcatcttcatctttctgattatgcgcaccacttctgtctgctgctgctccacttcctgattcttgctctccatacttcacccaacatgtatagcccttcatgaatcctcgttgtatcagatgaccgtgtacgtcctctccgctatcaaacatattctcattcttgcaatatgcacatggacaacacatgtaatcattgtttcttctattccgatcctcctccgcgacgttcataaaatttattacgccctttctgtactccgtagaatgatgtttcaaattttttgcatacatccaacttcgatcaattgctacaaaataaaaaaaacaaattacatgcacatcttataagatcagtattgcaaaagtaagatatgatgaaattgctcaattaatgattaattgtacttaattgattgatccattttgatcacttttgggaattttctgttttccttggaaaaaagacaaaaaatcgccccctacagcctcccaccaaaatagttaacagtgggatacagttacactaggtggttgggggtatttatactgtgcaacaaatatctgtaacggttctaaaataatcaatcgtgacgggcatacaagtaatctctatcgggccttaataaaagcccgtaaaaaaagagtgccatctgtaacaggcattaaacttatctcaatcgggcctctagttggagcccgtcacagattaccctcttctgtgacgggcttcttttagggcccgattgagatatggaaccctcatctcaatcgggcctcaactatggcccgtcacatataagtgtcatccgtgacatgctttagttttatgccgatataccatggttgtgcgaccatatctcaatcgggctgaagtttcagcccgatcgagattacttccttgtgacggcccgcaaattccagtcttgttaagagtcgtcacagatggaaggatctgtactagtgaacagaggaaaaaatatatatcaaaggtgttgtacgtcacatttatcacatccaattcaatttttttagtattcaaaatttgttccagaaatcttgtcacgttagaatacactttgtcacatttatcacctcaatttctattgtttctcaatcctgcacctaattaactacagcctgataccctatatcatttattaattgggggcattgtgttcatttcttactgaacattagtctttgttaaataaataacagctataacgatagcaattgtgggactattagatgcttcattgattgtttgttaaaacttatttcacggtagtcaaaacactcaagaatcagtatttacgtacacgcagtcttgaaaaactccatccaatccctttccaagcctatgcatttgaagcgcacgggagaaaaaaaaaagatccaatgcattggctcgattctagtcgatgtaccaagttgctcctagttgccccaaatccaaatcaaaatccccaaatcacaactcacatctcacaatcctcattagacaaaaagttcatccaaatccaaatctccaattctccaaatcacactcacatgagacggacgtcaagggcgccgcggcggacgatgacgagcggcacctctgctggtggatctccaaccataagtccacatgccagtcctgtgtgcgcaagcagtggtgcctcgacgagctctgcgcgtgccaagtgcttattagtggttttgtggcataatttgtcttataatagttatgggtgtacctattaggggttttatagtattgtgggtaacatatgaggcctagtgttggtatttctgatgccctcacaaactacacccttaagcacacaaaattcaagcaggtgcaatttgcaaatgtttttacatgtgaatgtgcttcacgtcaaatattcttgttgtttttcatatatatgaacaagcggaatcttcgtagagggtaatctcaccacctatatagcatatggtgagtgtatgcttaggcaaaaaaattagccaaacactgcctaaccctcatgtccactcaggcatgttcttaattagggcatcaaccaaacaccaccctgaatttgtgtcatgactgcacagagaaattttgtaagcaagattaagcaaccctcaggcatggaaaatactccagcaggtttctcgggatagcaaccaaacataccctattgatatctttgacaaaaagctaagtgacggcatcattgaaaaaaaaacaatatttacagatatcatctccaaaaaaaaattggtttgtaattgagtatgtatatcatgctattcgctgttattgtaaaatcaaagtgtgttttaattataattctctgatgaacaattggcatctaagattattggttttgatatctggagatttttggcgaagtggttttggagatgattggatttgcaggtgttaaacaggtgctgttgatttgtcgggttcggtcagatcgggcaggtgctgctagtcagaccggccagcccgcggtctgaccggccgactctgtgttggttttggtttcgggttgtttgtttggatatccgtgattgttttgtgtttatgacttctagatggaaactatgcatatgtaatactgttgtttgctactaatgagtcaagttggaggtagcttcgtctcgaaatatagtttctttgtttgcttcatgtgtatgtgacttgatgcctcgggagagtattgccagtgattgatcgggagtcagcatggggataaggcgatgtccgtgacggtcagatatcatgcgagatacttaggctagttcaatgcacgtggttggtgaagatttcatatggcatacgatggaggtattgtgtgcgtatgggatgcagagtcgaatttggaaggagtccaaatttggtatgattggagtttgtaaagtttgtttcttgtacgggaaggtttcctagatagattagaacttctagtacgggtttggttcgtagctttaggctttcctttatcgcttttgagagcattgagttgatagtttagttagtgtttcgagtttagtcgagatattcgtgaggagtgttcttgttgcactttgtaacacagagagaagtaataaagtggtcatctactttgagagttcttcgatttgcgttttctcgagtttggcggtctaaccggtgaaacaccggcggtcagaccggtggcattgcggcggtcagaccggcggagtacctgcggtcagaccagcgacggcgtcaggcaacttcaggcacagctgctgatcttggcggttcgaccgtacgttctacttcggtcagaccgacgatattcgagcggttcgaccggttcgactacttcggtcggactgcgatcagtcaaatttgagggtaatctttaattccgcaaagagtttgggtttttgggtataccaacaattaacccctctctggttggattagttcttatatttcgatcctacaagtggtatcagatccttgttttcttctttggattttaaccgatctagagtttttgccatggctaataagtttacaactaagccccatattttcgatggaacggattttccttattggtgtaataagatgcaatcttacattatggctgaggatcttgatatttggagaaaagtttataatccttatgtgattcttgatcaaattaatattgttgctttaaaaactgaatttgaaaataattgcaaagctcgcaatattcttttgagtgggatttctcgtttggattttgatcgtgtttcacatcttgaaactgctaatgagatttggaacgatttgaaaaactttcatcaaggaacttcaaacattaaagaacttcatcgggatctttttaaaaaggaatacataaaatttgagatgaaacctggaggctttggatgactatcttactaggtttaacaaaattttaagtgatctttgatctgttgcttcttcttatgatataaattacacacaatctgaggtttctagttactttttgaatggtcttgtcatgtttatttgggagatgaaaattatatcaattcaggagtctgttgatatatctacttttactttgaattcgctttacacaaaactcaaaacacatgagatgaatattctttctcgtaaaattgactctaagtctagtgccttgatttcttcctcaacttttttgaatattggtgcttcttcatcgaattctactattcttgctttaattaataccatatccgatgagcaactcgaacagttcgaggaggaggacttggctttggttactaataagttttctcgagctatgaataatgttagatactggaaaagagatggtcagatatcatgcgggatacgtaggctagagttcaatgcacgtcggtggtgaagattccatatggcatacgatggaggtattgtgtgagtatgggatgcggagtcgaatttaaaaggagcccaaatttggtataattggagtttgtaaagtttgtttcttgaacgggaaggtttcctaggtggattaggacttctagtatgagtttggtttgtggctttaggctgcctacctcatgtata

SEQ ID NO: 66727 - DNA, 3822 bp, Oryza sativa
tagtatccagattttttttttgaaagaacaaaatcaaaaaaaaaagaccaagttgtcagtcaaagtaaaaactgtcctgaaactaactatacaaagaaggggtataatagaagaatattacatggatttgcttagctagctagttgaggcagtattccatttccacctagttggtgctcaattagtggacctagcatgtttgtatataaacttgcaatgctagtcatagatgcttatttaactgttaataaagggttcagctttaatttcttcgcacacactctatatgcatacctaacttaacagttcacaagttgttacataaaagaacagttggcatctccccttctagatatcaaataaaaatgataaggtcacttgccacagaatcacagaagctgccagttgacataataattctccaattgtggatggaacctaacaaacatattaaatgtgtgatactctaccttacaatttgcagctagagtgacagggaaatggtgttacggattacataatattttccaaaatattcttaggcacattccttggtcactgtatcgatttttcagtgttagttttatccatccacctgttcttaaaaagaaattatgatcgtaaaaaatatcttagaaccacatgttataccatagcataaattactctagttcctagaaaaagaattgccttcggtcataaatattagacgttgagaacaagattttatcaaactctttaaacattgatcatcaataatttcttaaaattatttgtttaaaagaaaaaaagttgtatgtcaatttgccttgaagggttatacatttatactacctccattctaaaatatatagtaacctattattggacatgacagggatctagtactaggttgttatatattttatggcagagataatatatcataatttcatagaacctaataaaattttatatacttattttaatacgagactgattgttaaagttttaaaaatttaattaaataattatttaatcacgagccagagatgagggaagataaatagacttcgcctgagaaatccttggcccaacctactggcccaacttggcctgcgaacaaaagtgacggacgcgaaagcaaagcaccggctccgcctccaggctatgccgcgtaagccgggggctatgtattggcggcccatctggctcggaccccgcaccgatcaatccgggctcgtgccaccgcatccatcgccgagcgcgaggagagctgggtttttcccgtgagcgagagcgagtgatggcggcggggaaagggaaggggaaggagggagagtgcgacatggcggcggcggcggcggaggcggagaagaagggagagggctcgacggtgtcgcgcggagcggcgggggagcgggtggtggaggacagcggcggcggcaggaggacgatccacctcaagagcaaggatggcaagcagcatgatgtgacggaggcgtcggcgaggctgtccaagaccatcgccgggatgattctcgccggcggcggcggcggcggcgccgaccagtgcatcccgacccccgacatcgaccacgataccctccgcgtggtgatgcagtactgcgacaagcacgccgccgacgacgccgacgaggaggatctcaaggagtgggacgaagacttcgtcgacgagctggaccaggacgccctcttcgatgtcatcgcggccgccaactacctcgacatcgatggcctcctcgacctcacctgcaagagggtcgccgacacgatcaagggcaagacccccgaggagatccgcaaggagttcaacatcgtcaacgacctcagtaaggaggaggaggaggagatccgccgggagaacccctgggccttcgagcagtagtactcactttctttctcttaacccgtagtgtttctcgtcgtgtgatggcggttgtctcgtagttgtgtgtgttgtgtctctctcgtagattcagatcgaatcggggagttcgtgcattgcatcctgtccaagaagaacagagtcgatcggctgtgtcgttgaatgctttgaactgctggatcgcgatcgcttgcatgaagtgaatatttcgccccgcaaattgtttgctgcgtgcctctctccgcttggttttcatgcagtttgaattctgttgtgaattgaatatgaatagagaagggaaaaactgtctgaaattctgaatgctgcatttcgtttcagatgcatggactgatccatcagttctgacgccttagtatttcagtatgttgtttggctaactaaagtactaaaccaactacctgcatgtctgaattcttctacacctgaagcatttcgttcgagtctttgaaatatgcatgtggactgatacccaccagtatgttgcattcttcagcatctgaagaatttcatttcagatatgtgtggacttactgaattggtgggttaagttaaactcaattcttccttgcatgtgttctgctttcttccgcatcatgtagcggatttatagctagttgtgtttgctcactcaactagttgtctagtgcatcgtgtttgtaacttgcaatgctaggtgtttttagtttttactggttaatttggaatgcatgattttatatggtttttgtacgtgtgaattgattagtttcagttaccataaatatcctgtaagatttctgcatttcataaggggactaactactaaagattcttttggggggactatcaacaaattaattaagatcagttgccaactgaagataataatatttcctagaaagaaaattggttaagctcgggaaaaacatggtctgacatgatcacaattcacaaactcttgcggctttgcatactcttggtgcatatgacaagctctagctacagtctactggttttcatggcttctcagcgttttctgttgctggttatttatcgattccttgtaataatgtaatctcctgaacagtgcgttgtttttttctgctttctcatatatcaataaaatggcagagctcctgccccttcactcgatgaaaaaaatatggtgtcacagaatatttactaaaatatccttattactcctagtaattaggcaagttccttggttgccccagtgattccagtgtgttagttttatcaacctattcttagaaggaaattaagacggtgaaaattctcctaattatgaaccacttgttagttgttacatcgtcaattattagtccattcaatttgccggagccggagttgatttaaatcttataagtggtgatacgatcctcaacgaacatggaagagaaaaatatatactgtagtataaataaattagtagtttttagtatgagaaaaaaaaattcaaaacatgtaaacatgaagagatttaacaaccgacaaatacttctcccaggggaaaaaagggaagaaaataggacattgtcctcacaaatgggcctaatcccttacaaatcctcagcccataagccacaaccttctggcccaacacagcctgaaaaagagaaaactctcgtccatgcctagctggctcagcctcccggcgacgccgctgacccgaacccgtacgccggcggttatatataccggcgactccgacgtcgcaccaatcaatccggctcgtgccaaaccatccacgcggcgagcgctagctaggtagtcggtgcaaggagagctagggctctgtgaggagcgagagcgagtgatggcggcggggaacggcggagaggccgcggtggtgggggagggagagggcgcgacggcgtcggaggtggtggagaagatggtgtcgcaggcggttg

SEQ ID NO: 66728 - DNA, 9594 bp, Oryza sativa
ttgttgtgaacgatttggggatgaactattgtgtgaatgatttgggatgaactatattgctatgagtgatgaatgtttgatctgagatgatttgggcaaatagcaaaagaacagttaaaaagaaaaagagaaaagaaaaaaaatgaaaaaaaaaccctatagtcgggaccacatttttagaacaccaaccgggactaaagtcccggattcgccgtcccggttgcataaccgggacaaatagatggttgccaaccggcggcaaaatcggttgtgcagcagtgaaaggcttcaacccaagcgatacaacttcagcttcacaggacaactccatcttgacccaacagaactcagtcttgctgatgacagtgcagtgctgtagacgtcagttcttccgcacattgttccagtttgatttgatcctcctggctttgtaaacctgaccaatataagagggaaacaaacagatgaaacacaccatatcaggagacttgatcttctttatccttcaaaacatattacgggccggcttcctagagggcccaacacatggcggccaatcccgcaatgtgattttttttttccatttggtatataaactatgccctgatcaaaaaattgctcgaaagagtgggacggacatttgagctccaaacaccataagccattaaccataaggctccaaatatatttggccaactcacagtaaaaaaaaaaaacaggtcgttgacagtctccttttccttgcaaaaggcacaagtttcattaccattccagtttcgtcttacgagattatcttttattaatattgcattgtgtacggctaactaaatttttttttatctttaatggtagtttagctttcaatgcaatttatatgatgtggccatatacagctgtgttgtcacatcctgattttttttcaggatttataaattatttaataaattattattagaatttatattaaatgttctttaatttacaagtgaagttaaatgtgggaaataaaatttcctaaatataaagcatggatggatttaatttttattaaattctccatgattaattacactctctgaaattttctcggatttttcagagctcaattcctaaatgatacaaagaacagttcagtaattatttgatcattaatgatctaattataattgttaggagcttttcttgtttaaaaatccttaaattataaattgttgtttaaaaggaattattagaaatgatcttaaaagcctaaaagagaagatctaattttaattaataaattccaatataaaatagggccagataaaatttcattaaatactttacttgattctaaagttcctagatttttctgggatttatttgagccaaggaagtatttttaatcaatggaatatcatttcatgaataatttaaattgaaaaaggtttttaaaagtctcttttggctttgggccgaaagccggcctaaaacctctctctttctctctccctccccggcccagtcggcccaaaaccgctctctctctcctccccggcccaagccggcccgcatccgagccgctgctctcctctctctctcccgctgacaggtgggccccacctgtcaggcctgtcttcctcctcgcgccggccgccgctcgaaccctagcgccgcgccgccgtcgtctccttccaaatccgaccgtctttttcccaatccggtgaaatcaatagaggggaaatgatcttctcaatctcctctaccttttctcttttggaatcgtcggctaatttcgtttggaaatccgtggattcgagtttgattcggatcgacttctctcctccgaaccctagctttccttctcgccgccggtcgccgtgggcctccgtcgccgctcgctagcccctttataagcacccccgagctctcctctatccgccgccacctttgccttagcccgccgtcgcgtctagcgccgcctccgcgcagccctagccgtcgccgtcgttgccgtcggttcagccgcgccgcgtcgccgttgcagccgccgtcgtcggtcgtcgtcgccaccatcgggatcgtgaggtcgtcgtcgtccccgtccaccgcttcgccgccgccgaagaccgccggagcaccgccatcaccgtcgacccgaagaccgtcgccgcttcttcctcgtcgccggcgccgtctgttgctcttccgccgttgttttggtcaccggtgagttcgccgcgtcgccctctacccgttggtgtcctccgtttgcgtcgtcgcgccgtcgttcgccggtgagcatgcgccgcccgagccgtcgccggtgatgacgtcatcgctgacgtcatcgttgccgttcgccatagaccggtcgtagaccgtttagatctcggccgttcgttgtggatagggtagatctcggccgttcgtttccatgagccgccgccgtgcacccggtccaccgtgaacccgagcccgctgacgcaataatcctcttttccttttcaaaaataattcattattgcgtcataattcaattaaaatctatataagtgttttaatccgatttaatctttgaaaattcataactaattctttgtaactcagtttaatgtggttcaagttgcaaaagttgtgtaaaataaagatctacgtattaaaattatccataaatagaattaaatttatttaattctttttaaatgggctttaattagatttaatcttgtaaaattcataataaattcatatgaagtcagaatgaggccgttcaagtctcataattcatctaaaattatgatctacatgtttgagtactttatatgtactgtttatttggtttttattagtctttttcttcgttttgcgtgttagcttgtcgtttccgtcgttgcgaaggttcgcgagtgcgccggaagtattcaagaagactaattgaagaccgattattgcaaggcaagtcacacagatcctaaacacaatcctttgagcatgttgatcctatatttaaattctctatttatttcaactatgcatttattttcgaatgtcactgggtggtgtgaatctattcctttgttatggcctgtttgcattgattactttattccttgataccttgggttattataacttgactatttgagctttatatattggttcagctagatattagatatgattgcttagccatgcttagaaacattagcacactattgggataacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtataacatgattcattgcggagcaccagactgagaagtggcggagataagcccacgggggtcgctggggagtccatgccttgttttataaggggatgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgctataactggtaataatttgtttagctcctggtttggagttagatctgtacggccgggtatggttgttcagaatggttgggcctgtgcagcatgggtgtgttgttcagtgttgattaaaatttctgattaattactccactgttttacttctcttaaatgttttgctaaatgctgcttttgcaaatgagcctatattatgccatcctttggtatctttgtgcacttgcatatttgctgtgtggcttgttgagtatgtcatatgctcattcttgcaataatcaatcaacctcagttgaagaaaaaggatccagaaggataagacgtttggcttataccccagttgagctgcctgtgggagtggagctgaagccatcgctagaccgttattccgctgctggtttcttttcttttgtaagtgtgtaacgttattattatgatggatttatatattaaattgtcagtttgtgtacctcggctgattcctggacgaggattttatgcacaaataagttcggaaattactagtgaatttccgggcgtgacatgtgtgaagatggttgtacgttgactttacagaaaactaaactggccactggggctcctgtcacgcccagaaatttgacttccgtcaaccagaagtcacacttgctgaacttggcgtatagctggtgctccttcaacttttcaagtaccagacggagatgttgctcatgttcttcctcggattttgagtagataagtatgtcgtcgatgaacaccacaacaaacttgtccagaaattccatgaacactttgttcatcagattcatgaagaatgcgggtgcgttggtaagtccgaaggacataaccgtgcactcatatagcccgtaccgagtggtgaaggccgtcttcggaatatcctcttcccggattctcaactggtggtagcctgatcgcaggtctatcttagaaaacactttagctccattcagttgatcaaataaatcgtcgattcgcggtaaaggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccattctgtacggtctcttatagattggagcagttcccggtgccaagtcaatccggaattcaatctctctcttgggtggcatggtagtgaggtcttcggggaacacttctggatactcgcagactatgggtatatcttccaattttctcaagttcttctctacggtgtccactgggatttccgtctcaatctaattcaacgagacccctttctttggcgagactagagatttgtacaccacggtttctcccttctcgttggtcaaggtgactgtgcgactcgcacaatcgatgactcccttaaacttggtcagccaatccatcccaagaatgacatttaggtctttggattcgagaagaatgaggttggctagaaatggtgacctttgaatttctattgttatagaagggctgaattgaaccgaagtggagctattccctggggtatgaacccgcatcggtgtgctaagttcctctcttattaacccatgcatcccgacaaatttctttgagatgaaagaatgcgttgcactagaatcaaaaagtactgttgcagggattgagttaacagggaacgtacccagtacgacctccggtgctgcttgtgcctcctctgcagatgcgtggttgacacgagcctggataaaccttggcccggcacgcctgggcttcgggcatttgtcagcgaagtggccaagctcgtcacagttgaagcaggaccctggttttgctcccgtctccttcttggcttgcgcgggctggcctgactgtgccggtgccactgatgggcgtggagctgcaccgcggttgggctgacctccatggtggttctgactgccactggtgccctggtggaagttgctagggttgaacgggcggtgctggcggacgatcatggtggtaggtccaccctgctgtccgggagtgaagcgcggcctctggtgacttccctgatgtgccctgaactgagcggccttcctcttcctgtccatcttgttgcgttggtcctcctgacggattgccttgtcaaccagcctctcaaagtcggcgtagtccccagatatcagttggttggtcagctcgtcatccagacccgccatgaacttctcctgcttctcggcgtcggtgcggacatcctctggtgcatatcgcgcgaggcgattgaactcatggaggtactctgtcacagtccaagctgacgcgggaccctgaagctggtgtgtggcaaaagcgaccttctcctgatcattacactgcaggagattcagcttcttctctattgcatggagccagtcgttcgcctccatagggttggtggtgctggagaaggtgggtggcctgacgcgtagaaactctggcaacttggactgagggggagggggaccaaactgttgatgctgctgttcggcgtgctgcatcatcctctggtgcatctgctggtgctgctgctgcatctgctgcatcatggctgccatcatctgagtctgatgtgccataacttgggcaagcgtcggattctcgggaagtggtggcggaccattgccagaatcactgttggggtgcacaccatcagcgcgttcttcgccgttgctgccctcgcctgttgcgcggctaccagtcctggtgtagaccatctggagggaaaagcagacggggaaaaagaagaaaaacagatgctcaagaactaagctttattacaaaggaattaaaactgcaattgttctgatctgaattaaaacacttaaaaagcaagcaaaaatccttattaagacagccatatcataggcacatgatatcgaccgtcaactgaccccaaacaagcaacctaaacacgcaaactaacaaccagaagctagaccatcgataaactaattggaaaacgagactaatgctcggaacggctcctgcggtcggtggagtcgaaggcgtcctcctgctcgtcacccggtccctctgagcgactcctggagcctgacagatcagtctcgccgctgccactgggagtagcagacaaccaacctccggtgccactggctggacccctggcggctgatgctggagcgaaggagagagtgaacgcgggagctggaactggagctgcaggaactgcgggcggaactggaggtgctgcgggagctgttctataggctcgtaccgttgcatcctttaccaataaggaggcaagcactcaagtctcagtaaatcaagaaaaatgtgtagaatccattaaaaatggttttgttctctgtttcagtagtcttatagcctgtttgcaatgtttgctttgtatgccgctagattccgatccctccgacgctccggtgtacttcgagatagtcgccgaggttcccccagcagcagagcaaggcaagtcatgcttgtcacttgaacatgttgatcctatattgcaaatgctcaattgtttcctttcaaatattgcattgttttataatattactatgggatggttacctattgttacagccatgctttttggataccatgctcctttgttagcttgggttataacatgattagagtttggactaggaattgcttagccttgcttagttcaactagatcacaatggggaaaatcatattaatgtttagactgttagttctaatggtaatgttggtttaataccaccgctctggtgttggttaaataaaatgaaccacatggtgggctgtgggtgcatggttttgctggtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgccggcgcacggaaacgtgtcgtggggctgtgtcttgtgggtacagttgtacacctctgatcagagtaaaactattcgaatagccgcgcccgcggttatgggcggtcaaccagattcaccgtgattagaatcacattagtttagtctaatgaatttggatggtataggtggttggttgggcctgttgcaacgtggtgtagcgttggacagtggatgattaatactgcttaatttttacaactgtttaaatctttcaatctctgtttataaatgctcgctttatgcaaatgaaccactttagctcttctttgatgattccctgcatcatacctctattccggtatgacttgctgagtacagtgggtagtactcagtcttgctctatttttcccaaccccagagttcgagttcgggtcagatgaaggtttctctgaggagtaggcttcgtccgtgccgtcgaggatgcctgtggagtggtgttcccgctgcagtttagtcaaggattagctccagtttcttctgttttccgctgcatttatgtaagactttacgatgtttgtaagacgtggatctgtatgtcaacattgtcgtttgtgtaccccggctggtcctggacggggattttaatgcacattctgcttggaattctattcgggaatttctgggcgtgacagctcccaactccattttgcttcccaactacagcaagaagccccaaggcttgtcatcaactaactcacaacagtgcatagtgatccttgagtactactctaccattgcattgtatcctcattatcaatcatattctcctaaattaagtacactaccttggtaagttgtaatataatctcagtagtttggtcacacagaccatcctaattcctaaaccaaggaatattattatgatccgaccttagatccttatattgtgttttcacacccatattgtgctacattttgctaggaatgagctcaccatttattggatgtggatttgctgccaatatattggcaaaagcaagcttcggtaaaccaacatctactccaaatgtaacagtgcggtgcaacaaaattcacctgagctttgttttccaaccatgcacggcctgcagcctgagttttgttttcaactcatacagcacaaataaggtatatataaatttccccagatatcacagcaaattacctgtaggcttaagatgtttggagatcccagtggaaaggaagcaacgcataaaaccaaggtgactcatgctatgaagtttctccagttcttcgagaacacgtgccctcatgttaagagtgaataccatcttggctgctccccttgtggtggggagtggtatacctttttcttccaaattcgatgcaaatagttgtgaaaaaatctgaaaaaaaaattgacaatgtagagtataatgatacctactagtccaccaaaattcatgttcaaattcgatctacacatcgagaaacaaaaaagacaaatttagatataaacagtactctactattcatacgctgaatttgtcttttttatatctcgacgtgtgagttgagtttggacttaagattttgtgaagttgtatatatgtgttgtatgaatgt

SEQ ID NO: 66729 - DNA, 1179 bp, Oryza sativa
aatggtgacgagcagggacagtgcaggaggaggcatcttcaccagaagagctccggccgttgccacggctaaagagagcaaggtaaagaaggcagcaacactacggcggtgcaccttgaaggagctctcctcctcctcggtcaagaaggttgggggagccatgttcttggccgtcgtctccttgccaatgtgctgcaggtgctcggcgtaggcgtacccgagcaagccggccgtccagcctgtggcgaggtgcatgacggcgaacccggcgtcggggccagcgaacgtgtcggcggcgacggccacaaggacgccgtaggagacgcggaagaagactgtggagggacgcattgtgcgtgagaggctggagatcaagaagaagaggtgggtgcacatgaggagggcgatcgtccacaggagggccagcgggtcaccggagtggcggcgcagcagcggcggagagcatacgaggaaaaggaacgggactgagatcaagattatgcgagctcgaatacgattggagccttcattgtagacagtggtgactctgcggcctcggcccgatcgactcgccggggagatcgtcgccgagcccgagtggtcgccgtccgagtcgcgcgacggcggccgaatgtcggagggattgtcgtcgggggaggatgagtcactcgccacatgggtggtgtcgtcgatggcgtctccccgcaagaagtcctctgtcttggcgccggtgacgatcgacggggtcttttcaccggtgatggtcgacggggtcttggcgtcgacctcggcgtctgcttcgccatccgcggcgatggccatctcagtggtagggtactagggttgtggacttatggggttgtaaccgcgagcggggtggcgggttttataatggaggaggagctgcccgtagcgggtagcggggcggaaggagaggattcggattacccaaaaaggaaaaaggaaaggcgtgcaaaggaacaggaaagaggaaaaaggaaagtaaaggaaaaaaaatacggtaacgctaattcgctgcgcgttaggattaatcgagtgtggattctaatccctcgaggggatatccccttgtatatctttttcttccaaatttgatgcaaatagttgtgaaaaattctgaaaaaaattgataatgtagagtataatgatacggggatc

SEQ ID NO: 66730 - DNA, 614 bp, Oryza sativa
gacggactgcggaggcacgcgcatcagcggtcgggtttgcagcggcttgggcagtagcagcagcaggcgactgcaacttgggcctaggtaggcgctgaggcggtcaattatggaggtagctacaaataaaaacgacgatggcggaggcgggtgttgcggcggtcgaatatgcagtctattgcggctgagaagccgcaggcgcagcagctaactatggtgatagcagatgagcagcatggactacatcaacaacaacaacaacaacaacaacaacaacaacaacaacaacaacaacaacaacaacatgaggatggctgttaatcttgcaaagttgtggcagctgttactgtggcttttataattttcataaaaccaagatttctaatgatgtttgttcaatctgtcaatccgatggcagatagtctaggttcatactgtattttaatggcaatgcaatcacatttttcttaatggcagattcccaataacaattcaaaccaataacaaatatgcaattggcccataaaaaacgaacctagtaccgaatgtaacacatcatagtacttgtccatagtactaggatgtgtcacatccagtactattggttttttatg

SEQ ID NO: 66731 - DNA, 1651 bp, Oryza sativa
aaaagaagaaaggattttcctgggattaaaaattgcactttggtgatttttaattggtaaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacagttcaatcaagaggaatcaacaacagaacaactaatcaaacgtattatgaagggggttaagatgctgatacatagcaagaatattacttcaaccccgatttgtaacggtatttttatttgattaatcaccggaggggagagattcctcacctgaatctttcattgccaaagaaagatagttctgagttacagagattgggctataccagcggcaagccattacagattaaacagaaaaaggggaggagatataaagaatacaaaagagaggccaccaccttcccaaagagacaacaattgatgttaggcacctgcaaaaaccccaaccaaaaaccagagcaacctaaagctatcacctaagctcatcaacaaacattttcttatgcagacttggaaacgccagtactcctcactgaagggcctttctgccacaaggtcagcttggtttaacagcgaccaaaagactgtggaagtcaaaaaccacccgcatcagccatcaagaattcaacttaaacttgttgctgcttggatcagtgcttgctgacgcaatttgtgggaaggaagccccagaagagggagggccactgaaggttgcggccataggccgcccgtatcgagtcttcttcaatccgactataacaattgcttgcaagttccatgacctccaaggtcctttcagggaaggaagcctcaaaggaggaagggccgctgaacaatgtggttgaggacatgccaaggtaaagagaggagacgaacagggagctagacaagagagaagtggcagatggggggaccctacggatggaattccaacaactgcgacagcagggaagtgcttaagatcagatgctaagccagccaaaagagagccatcagttctaacaacaaagacctaagccatcaagcaaggagcatgcctaaaagagatccagagagaggtgaggcacgagcaacacctagatgatggatgaaagcctagctggtcagggcaaggagcagcgcaaggatcggtgactagagagacatcacagttgtcggtgacatgggaccgggagtatcatgactagaggcttgaggcagacacaatcgcccacgtggcctggcaccctcggggggtgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggctttaacttcacttcacaggcaaaaactaactggggtctgagcctgggtctctaacttcgt

SEQ ID NO: 66732 - DNA, 3657 bp, Oryza sativa
cgcttttgagagcattgagttgacagtttagttagggtttcgagtttagtcgagatttttgtgaggagtgttgttgttgcactttgtaaacacagagagaagtaataaagttgtcatctactttgagagttcttcgatttgtgttttctcgacttcggcagtctaacccgcgaaacaccagcggcattgcggcggtcagaccggcggagtacctgcggtcataccggcgacggtgtaaggcgacttcaggcatagctgctgatctcggcggttcgaccggacgttgtacttcggtcagaccgacaatattcatacggtcagaccggttcgactacttcggtcagactgcgatcaatcgaatttgagggtaatctttaattccacaaaagtttgggtttttgggtataccaaccactcacccccctggttggcttagttcctgtgttttgatcctacaattattactagtacaatgtcgacactttgttccacaatataaagtgcacaaaattatgataaaagttgaaatgaatgaatcagtgaatcaccatcagcactgtatggtgggttacataagtgttcactttgtctcgtgggttctcgactatagtttcttatctattttgtgataaaatttgtcataaatatttctccagaatatttcaggttttttcatgaatcgtgtgcacatccattagtatgctccctgctaactaatgaaataaatgcaaataggtaagttaacttataaaataaaatataaataactctagtatttgtataagcaaaagataaagtacttggcaggtgacagagtgttatgctagtattaaaatgtctaggattttacaaaatttgcggagaaaaaaatattcagcaagtttcatttattgtcatcgcactgttggtagaattggatttacgaccatattcatgataaatagtgggtgcgttctcttctccatgtcatagttctttatttctagaagggccaaatggacgattatggaaatgacaagtttcatagtctgtatggtgagaaatgcaataggacatggaggcactaggaatttctattgtagtagctgtgacagaccttgatcatactaacagttgctggagacaggaaaatagattgacagcaaagcttctgaatgcatttgcacggcattgtttgcaagtttctccatcgcatggtacttcaactccttgctacgcctccaatcgtagcaacgtggcatccggtggctctcagctaaccaaagaaaccaaggactctggtactcacaggatccatacgggatcgaggcacatgcttattgctagtggccaagagttgctgaagtcaccgctgagttcaagagttgctcgatgaagtacctactagaatataactgttctgcagattcggctgtacacgatcagaaggtattgctagcattgctagctgcttgattcttagcatatgccaaacttcagctgtatcaaagtcaagccagcaagatggccactcgcaggcagggtttacgattccgatatgcctttccttttcgggcactggcggaattcgaaatttcacgaaatccggtgggaaaccggtaaattctgaacaaatttcataaactaaaatttgaatacaaattccttgagtttgctgacaagttctcgaaaaccgatcggttttagcgaaattccgatcgatatcatcgaaatttcgatcagtaatttataatagaggtaatttgctgaaattcttttctttcctcatgtaagtttcagtaaatatacacaatatatttttttttcgaaaatttatatcccaatagattccatgaatatcatagtatttataagattttatttgattttttttctttttttatcaattcaaatttgaatttggatgaaacttctcgaaatctcagacggtttctactttcgagcctcatcgaaacgtcgaaatttcgcgaaatccaaccggatttcgtcggaatcgtaaaccctgctcgcaggagcaggatcgtctccactctccactcaacacggaagaaactcctctaacgtactctcttcgttccaaaaaaaaattaattctagatttaaatttgagcatagtgtatgtccatattcaaactcagcattattattattattttttttacggagggaatagtgtctactggcagagctacaggggatggcgagcagcggccaggccacctccaatgaaaaaaatcctctcattaaaactaattaatcacaaaggagttggttaattggcctcatttaattaatactccagcaggcagccgtttgggcctttttaattttgattgctgccgtgcagtcatgatggtcttggcttaggcaaatggtgctacctgctgactttaggatacactacatgtatataaatccaattttattgctttaaatataaaatcgctagttgcttgcttgcaaatcgtcaatcacccgaattattaatctcatttggttacttcatattattagtgattactacttaagaatattacagctcataaacaaattggtactccattttgcaaacattattttttatgctttttagtttatgtggactttagattctcttacaatcttgaggaggaaataacatccttccaacatatagtgcattttcatacgttacccaggaaagcataacctatccatacaacgagggaaattagtactaataacttatggcgataattaacccttagcaaaaaaacattagtttagttagggcaagtaaaattgccacgtaggattagataatgaggtgaaggacagaagttaggagagagaatgaaccacctctcatgcatggggtaaccttcacacaattttcaagaaaagtgaaaaatgatgtgagtaaactagtgttggggtttgtgtattagatgtgatatgttgtatttgttgcctcttaattaattagaagatgacatgttttaaattagatgtggcattcacctctatcataatacttgtccttacacgatcacgtccatatatacgctgtagttgcagctatttcgtttctttgactaagtgcgatggtaaaggagatccagtaccatttgtgccaaaattgtttgtgacggataagatggctgtgttttcaaataatcgatacaattaattcattcacgcagacagtagttgtgttctatatcccttttcccagcgcgtattcccttatttttcgtacgcacctttccctaactgctaaacaatatttttctaaaaaaaatctataggaaaattattttacaaaatcatataaatttatgtttttaagttttattagctaaaacttaatttattctgcgctgatccaccattctgtttcgcgctttgtgttctggcttaggggttctctggtgctcactataagaagaaaaactgagtgaccacttggagaatttgtcacaaccttcgactctgcagcatatatacaaaacagtttcttcaatatcttagataatgaaatattacaaatgtttgctgtatttgttcacttatgttgtggctgatctgatcatataacgtatcaattcttcgagtactcattcataaagtagtactccctccatttcaaaatgtttgacaccgttgactttttagcac

SEQ ID NO: 66733 - DNA, 19844 bp, Oryza sativa
ccgacggcgagccggtcgaggtgacagaggcggcggcgaggatctccaaggtcatcggggacaagatcgacgccggccgcggcggcgaggccatcccgctcccacacgtcgacaaaaagaccctcaagaaggtgatcgagtactgcgacgagcacgccaacgagaactccgacaccgacgagcagaaagaggaactcaagaactgggacaaggccttcatcgacgagctggacgaggacgacggctccttcctcttcttggtcctcctggcctccagctacctcaaaatcgatgggctcctcgacctcacctaccagagggtcgccgacaatagcaaggccaagaccaccgaggagatccgcaagaccttcagtaccatcgagatcgaactcagcgacaaggaggaggaggagcagcagcaggaggaggagatccgcccggagaacgtctgaatcttgaagtatagtactcacttcgatctcttaacccgcagtgtttctcgtcgtgtgatggcgccatggcggctgtctcgtagttgtgtgtgttgtggctctggtagatttagatcgaattggggagttcgtgcatcctgtccaagaagaacagagtcgatcggttgtgtcgttgaatgagttgaactgctggatcgcttgcatgaagtgaatattttgaccccaaattgtttgctacgtgcctctatccgattggttttcatgcagtttggattctggtgtgagttgaatttgaatatagaagggagaactttctctgaaattctgaatgctgcgtttcgtttctgatgcatggactgatccgtcagtactgatgccttagtctgttgtttggttaactaaaccaactacctgcatgtctgaattcttctgcatccgaagcattttcgtttcagatatgcatgtggactgatacccagtatattgcattcttcagcatctgaagaatttcatttcagagatgtatggacttactgatttggtagatgaagaagaagacggccacggcgatgatgatcgtgacgccccggccgaccgtgacgactgtgcccgtggcaggagaagaggtcgccgggggcacaacaacgaccaccccagggctaatcaaaactggcgatgcagggattgagacgacgacgattggaatgaacggggacgagactttgggcgtggccgcggcgaacaacgtgcgattgatcaagactaccgccgtgaacgcacacgctccccgcgccagcgcgacaggggagggcacagtcaccatggcggccggcgtcatcacgctggtgccaccgacgtggacaacgtcaccgatcctgtctaccccgagccacacctggcagagatctctctgccttcccgccagcaggagcttcacaccgaggtttgcatatttcgattgctgcatgctttgcacacttccccgttcaagatgcaggaaatcccggcgtgatcagctgcttcgcctcgcgcttgtcgctgataaggccatggctgcgccacctccgacggcgatggaggacctggccatccggtcttccactgggactgaagcctggttcagcggcacggcatggaagccagtgcctgttgcgcgtgtctttggccgtatcagggaggccttgccggccacgccagcggtcgaaacgccgacaacctaccagcaaattgaggaggcgctgatgcgccttgagctcgctgccgctgcagctcgcaccccaggcgatgacactctcctaccacagcccatgtcaccggcacctctcgcagcgtccccgcctcgccgcttggaagatctggccagcgacgctgtggccgacaagattctgccggctccgctccccggggcgctgcttccccaagagatgacccatatgccagccaccccgcccctgtggcgctggagcggggctcgctgccggaacgcgcatcctcgccatgcgccatcgcgggactgttcacttggcctccgccggctatcattgcgtcgccgctgcgctcgacgcttccatgtctgcggccggtcgtcctcacaaggaaggtgaagctccggccgaggcagcatagccaggcaatccggcggagtgagcacctcgccaagcaacctgcaagaccgatgatggagaggtgccagcgcatcctattcaggaggttgggcatcctccatgacgaagaagatgcctccgtggagcgcgttctcagccagtacatggccatgtttgatgggcccctgccgccgcacgccatcgccgccttgacggcgatcttcggcctcgacgacgatgatgagtgcgccatggatgcctctctgctcccccttgtgggcgaagggatcactgatgtggccgatgaagtggaagaaacgctcgcttgagcagcgcctgcgcccgcggattcggagctgtcgtcgctccatgtatcatcggattcggagctgtcatcgctccatgtatcgtcgccgtcttttcttttgcagctggcgtgccgccggtggcctgcgtgccgcctccctagcatttctatggaacctcagctcttggagcacatgtcggtcagaacttcgtttggcttcaccctgcctgctgtcttttttcctgcttgcgccgcgcctcgtccgccgccggcgtctgtgtgtatgtgcgccgctgtgacgaaggcagaaatgatgacgacgacgctagcggctccccagccacgggccatacctctcgctgggccttgcttgggccttcgcgctctcgctcgggcctcaacgcgccttctaaggccgtcctccatcttgggcctcgttgggttgcgcgtgcaacgacattcgaggccgacgccattatggccacatgggatcttctcggctcaagtccccttcccctccctcgcgccaagcaggccgtgctccaaccccggctgggcctactcccccaatcaagagtccacctttgatttgcagatgtcgcacagtctagatttcattagttggaatgtgagggggctcaattcgccagcacactgcaacacggtccacgagatgatgttggatacgaagtgcaacctagcatgcctccaagagacgaaacttcagaacatctacgacggcctcgcccgcttcctgggtggctacaaattggatagctttgccttcaaaccggccacgggcacgagagggggaattctcatcctttggaacagtgctgtcctcgtcctacaagatattcgaatcggccgcttttcgatctcagcacaagtgacggtcccactcacaggggctaccttccttatgaccggggtgtacgggcccacgagacaccggcttaaggatggcttccttaggcacataaggcggctaaagcccaatgctggcgaagggtggctcctattcggggatttcaacatgatctaccgagcaagggacaaaaacaatggcaaccttaatctagctcgcatgaggcgctttcgagcgacaatcgatcgatgtgaactccgcgagatccccttgcaaaacaggagattcacctggagtaatgagcgtcaaaggcccactctagtgaagcttgatcgttgtttctgcaatgagaactgggatctcgccttccatcaccatgtcctgcatgccctcccaacagggccgtcagaccactgccctctcgttctttcaaatcccgctgccccgcgcaagccgcgcccctttagatttgagaacttttggacacgcattccgggtttcaaggacatggtcaaggctagttggacccaaccatccccgcacacagagccgatgcaccgcctaaattacaagctacagcgcacagcttcttgcattaaaacctgggctaaaagtctattcacggaggtgaaaattcagtttcacatggcactcgatgtcattcagcggcttgatgtggcccaggaacacagagatctctctggcccggaattgcggctgagagctgccctaaagcgcaaaactctgactctcgccacgatagagagggcaaggaaaagacatgcttccaggttgactcatatccgtgaaggggaggcaaacataaagttttttcacctcagggtgaatgcgcgtaggaggaagaatagcattcaaagacccagcaaagaaaatggctgggcagtcactcacgatgagaaagaaatgaccattcttgaccacttcgcccatttaatgggtcggccggggccgaggccgaatgagctcaactgggaagctctagacatccagcctttcgacctctctaccttggaagagcctttcttggagcaggagatccaccaggctatcaaagagatgccagttgacaaagcgccagggccgaatggttacactggtatcttctttaaaatttgttgggatatcgtcaaggaggatgtttcccttgtcttcaattccatcttcaacctccgctacgccagcttgggcctccttaactcagcgaatattgtgttgatcccgaagaaggaaggggcggagagtgtttcggactacaggccgattaatctaatccatagcatagccaaaatcttctccaagctgctggcgttgtggctgaggccccacatgcactccttggtctccatcaaccaaagcgccttcatcaagggaagaagcattcatgacaacttcctctttgtgaggaacatggccagaagatttcaccgtacgaatcggccgatgctcctcttcaagctcgacatcacgaaagcatttgattctattcgttgggactacttgatggcccttttgcaacgcctaggcttccctgtaaaatggagagactggctaggtgatggctaggtgacctcctatacacatctacctcgcaagttcttctcaacggcatcctggtcaaagaatcacgcatgggagaggacttcggcagggagacccgctgtctccgctcctttttgtcctagcaatcgaccctctccaacgtctccttacaaaggcaacagacctgggttcgctctctaagcttcgaggcagaatgcctcgcctaagaacatctatgtatgcagatgacgctgccattttcgtcaatcccacaagaggggatgtccaagcgctcacggaaatcctgcaacgtttcggtacggccactggactcgttaccaacttccaaaaatctcaagtcgcggccatcaaatgcaataacattgatttggacgacgtcctagagggagtcccagcagtgagagcatgcttctcgatcaaacctgggactccccctgatcctcgggcggatgcgaaaggcggacatgcagcacatctctgataagatcacagggcgtataataggatggagaggcaaaaacatgggacttgccgggaggtccacacttttaaaatcagtgcttacggcgcagccaatctacttactgaccgctctgaaaacttcaaaggaagccttggagtgcctagacaagcagcggcgacgttttctctaggctggcacgggggacatcacgggtggaaaatgcaaagtcaattggacaaagacgtgtctgccaattaggcaaggaggcctcgaggtcctgaacctagaaagattcatgagagccctgcgtctacgctggctgtggcatgaatggaaggacccaaacaagccatgggttggtctcgagatcccctgcgacgaagtagacaagagcttgtttgccgcatccactaagataaccattggtgatgggaatatagcgcgattctgggacactgcgtggattgatgggagaagaccaaaggacctcatgcccctagtatatgcaatttctaagaagaggaaaaagaacctgcgccaaggaaaggagaatgatgcctgggtaggtgatttggcactggagacaaacccagtaattacagtggcccttgtggagcagctggttgccctatggactgcagtctgcaacgtgcagttagaagaagaagagtcagaccaaatcgcctggaagttcactcctcatgggcactactcggcttcatcggcctacaaagcgcagtgtgttggcgcgcctgacacaacttttgactccttgatctggaaggtctgggcgcccggaaaatgcaaactccacgcttggcttatcatacaaaatagggtttggacctctgaccggcttgcgactaggggttgacaaaataatggcaagtgccctctctgcagaagagaatatgaaacggctttgcacctcgtcgccgagtgcaggtatacgagacggatttggaacctcgttgcgacatgggtagggttccaccagctagaaccccgacgctggggggtggcgcaatcggtcaaagattggtgggaaatgctggcctctgtgtctggcgtccccaagaagggactccgcactctgattctactcatcgtatgggaagtctggaaggagcgaaataggaggatatttgatcataaggaagccacaacctcgtatctcctttcaaagataaaagaagaggctggcatgtgggccttggcaggtgccaagcgtcttggagagatcatctcgcagtttgtatagtgtacagctttccttgtttttttgctttttctttacccctaggggttgtatttttctcctgctatattcaatgaataagcacattcttgtgctggttcctttaaaaaaaaaactgatttggtgggacaagtttaacccaattcttccctgcatgtgttcttctttcttccgcatcatgtagccatttagctaattggcgcagtagttgtgtttgctcactcaactagtagtggtctaatgcatcatgtttgtgaatgctaagtgtttttaccggttcatttggaatgcatgactttatatggttttgtatatatgaattaattacttcatttaccataaaaatcctgtaagatttcttcatttcagaaggtggctaactacaaaaaattctttgagggaactatcaacaaattaattaacctcagttgccaattgaatataatagtgtttcctttaaagaaattgattaagctcagttgagtttcttcgcacaaactctgaacaccttcttaaaagttagcaatttattttacaaaaggaaaaagtacgaattacccccccgaactatcgtggtcgaccgaattaccccccgaaccacaaaactggacattcttcaccccccaactatgcaaaccggacgaattacccccctggacccaatccacggttgttttagtctacgtggcgtacgcgtggcagtccagtcagcattctatttattaaaaaatgtgggacccacctgtcatacactcatactctctcttctctttctcactcttcctctctctcttctctttcactctctctctctcacagaggaggggcggctgggcgccggtgtccggtgggatggagggtgggcgggaggcagcagccgcgaaggagctggccggcggtggaggtgggggcgccgtcggagcggcgaggcgaagggggcctcgagccgtctcccatctggtcgtcctcctctgccaccagcgccgaccacgccggctcctcccctggcccgatggggatctcgacgtgcgtgaatcgcgtggccggaggggcggctagcgggcgtcggatcacatcctgctgctgcttcttctatgtgtcggaaaggagcatgacgatggcgacggggttgcggtcacggtggtcctcgagcaccttggtggccttgcgcagcgcgtcgcagacgcagacggcctaccctggccctgggcggcggcgcagtcgacgaggcggtcgacgatctggcaggcgggcggagcgctggccctggcgcgtcatccaacgcagcggcaggaggcgccggaaaaggcgacaatggcgaggcggtcggattgcatcctgctctgagctctgtccgagatggaggggggaagcagcgccgagctccgtccgcccgcacgcgcgcgagctacgtccgcctgcacgccgccgagagggaggggggaagccgcgcgcgagctacgtccgcctgcacgccgccgagagggagggggggaagccgcgccaagcggccgcctctctcttcgtcagttagcgggcagtggcgtgcaggccggcggccggcacgcatggcgtgggtgcgcggggaagggaggtgggcggagccacgcgtgcccgcggaggcggcgatgacgcgcgtgcccggcagaggcggcggagccgcccgtggccaccataccccacggagttcacgccttgcatgcttctgctcaaggaccgtgtacgagcgcgagcaggaccatgcatgctgctgggtgctgatgaagtgatgccttcatgcatacgaaagctgcctattcctcgaagctctcggagcgaggtagccctttgccggccgcggaggcagccatgagctcgggacgaccaccattttttgtgcatcgtccgccagaggcggccgtggaggcgtccatccgccgcacggggacgaccggccatggtgctgctagtgcgcccgtctcgccactgcgggagggactgcgatgcagtcgtgaggctgcggcggcgcagtcgcggaggcaacacgagggttggtcacttggtcgtggcggcatcacgcgaagttgttgggaatagtcccacattgctaatctagggggagttaaaccaacttaaaagtggggggagcccctcacctcttgagctagcttttggggtgtagcaaggctttctcccggttgggccaacgtctcccggtttggggccaacaagtggtatcagagccaaacccacaatctctagtgtttgtgcacactcagggtagtgtaagcccaaagcccagtggaccgcgggtgtgaggcccgtatgtgcctgtgtgtggggccggtcagggctaaggggcaccaatgtgtgacgaggaagattgttgggaatatagcttttggggtgtagtaaggctttctcctggttgggccaacgtctcccagttttgggccaacaggagtgtgtagtaaggctttctcctggttgggccaacgtctcccagttttgggccaacaggagttggggccgcacgcggccagcaccatagcggagccgcgtgcgcgcccaccgccggcccgcccctacgccgccgcccatcgcccttccccgctccgtgccatgcgtgccgctgcccgttgaatgacgaagatagaggaagagagaaagaggggatgatatgtgggatcctaccattaaaaaaataaaatgctgactgaactgtcacgcgtacagggtgaaaaatgtccggttttgtggttcaggggggtaattcgatcgaccgtgatagttcagaggagtaattcgtattttttcctttacaaaaaggaatactctagttggtactatctccttttctagagatcaaagatgagtgatgtggcatcagtcgcctaatgatgaagagcagtactcatatcttgcagtttgcaggtcaagtaaaaggaaaaacatggcgtgacatgatcacaattcacaaactctttcggcttgcacactctttatcttggtgcatatggctgcagaggaacaatagaattttcagtggcagctacgaagttagcagatgtagtgcacatgatcacaaacctgtgcaaggcctgagaggaagctttagctacaatgtactagttttcatggcttctctgcgtttcgttgttgttttttctgctttctcgtatcaatgaaatggcagagctcctgcccctacactcgatgaaaaaaaaatatggtgtcacagaatatttgctaaaatatccatattactcctagtaatcaggcatgttccttggttgctccggtgacttcttagaaggaaattaagatggtgaaaattctcctaactatgaaccacttgttaattgttactagcatcagttactgtaatccatcattatgccggagtccgagttgatttaataaatcttaagcggtgatacgatccccaacgatcaaatcaaagagacaaatatatacagtaggagtcttcagagaaaaattcaaaatatgtaaacgtgaggaaatttttaccaaccgacaaaagaggagaaaaatgggagcaatgtactgtatgacaacatggtcctcataaatgggccgaatctattacaattgccacagcctctggcccaacgtggcccgcaaaacgcagccgctctcgtccagctggcgtgccaggtaaggcttgcattgcagtagaaaaaaaaaacgtaacggacacgaaagcgagcacgcctcctgacccgaacccgctcgccggcggctatatataccggcgactccgacctctcagtctctcaccgatcaatccatctcgtgtgccacaccatccacggcaagaagagttagggctcagcaagagaaagcgatcgagcgatggcggaggagaaggggaaggcggtgatgccgatggaggtggatcaggtggaggacgagagagaggccgagacggtggtggaggcggtgcagaaggcggtgtacgatgctttggagaaggtggagatgatggaggaggagggagaggccgcggtggcggaggcggcggataagttgctagaggaggcggtggagaaggcggtgacggaggcgttggaggaggcggggtgggacgcggcggagaaggcgttgtccgatgatttggagaaggtctcgctggaggcggagagcgctaggatgatcaccctcgagagctccgacggcgaggtggtcaaggtgaaggaggcgtcggcgaggctgtccaagaccatcgggaacatcatcgatgacggccgcggcgacgaggccatcccgctcccggacgtcagctacaagaccctcaagaaggtggtcgagtactgcgacaagcacgccgacgagaagtccgacaccgacgagcagaaagaggagctcaagaactgggacaaggccttcatcgacgagctggccgaggacgacgactccctcgtcaaggtcatcatggcctccaactacctcaaaatcgatggactccacaacctcgcctcccagtgcaagaccacccgcgagcagatcggcaaggcctgaaacatcgagatcgagctcggcgacaaggaggaggaggaggaggagacccgcccggagaacgtctgagtcttgaagtaatactcactaatctcttaacccgtagtgtcctcgtcgtgtaatggtggttctctcgtagttgtgtgttgtgcctctggtagattcagatcggatcggggagttcgtgcatcttgtccaagaagaacagagtcggctgtgtcgttgagtactttgtactgctggatcgcttgcatgaagtgaatattttgccccgaaattgtttgctgtgtctgcttggctttcatgcagttagtcttcttgttaaatatttgctctatttctagctatctactcgttcgcatctggttcgatgttgggattccaatccaggagattcggttgcagatttgcaacatttctcagtggtcagtgctcgatcgatcaggggatgtgtttcctgctcttgagtttgtattgggtgcaagtttggtgttgcattttgcttggattgtggttcggattaatttgagaaggggaaaaaacatcgttgcatttttatctggaattctgaatgctgctttcgcttcagagatacagactgatctgttcgaaatgatccatgcgtgtctgaattttcttctgcatctgaagcgtttcgtttcagatatgcatatggactccctagtatgttctgtgttgcattcttgtgcatctgaagcatttgtttcagaaatttggattgatcctccctaagtatgttatgggtttccggatctgaagcatttttcgtttcattgatgcatggacagatctagcagaagaatgttcttggtcgtttggttaagttaacccacttcatttccctgcatgtggtctgctttctcaagcattattaggatggtgtcctactgtgttgtttggttcataaaatttctgtacgtgttctgaattcctgagctctgctccagattagttagcaacaatccaatgcctgaacttttgccttttgttttgagacattatgagagctacagctacagcacctttgcttccttcttgtgtgtgttccatgtaaatttgctgtacaattgtaaatctgcttgagttggcgttgtctctgaacttgtgaacaggggattgcacagtttcagtcgacatgtacatttcttaaaatctggaacttaattttagagagaaaactgaagataactaattaccgtgtgattcaatgtaatccgagtttaatgctgtgtcagcagaactccaggtcactaggccttatttgggtgcctggaaggattcccagggccagatatctgtttgaatttcattaaaggtagaggacatgttcaattttgctttgattctagtgcaaaatgtactaagtggaaaaaatgcatcgtcgcagttttgtctgaatgctgcatttcgtttcagatatactcagtacgtgcgctttcaccaggagagtatggaggatgatgcagggatggattggaatcaatttcctcttgcctacagagaacgaaccagccctggcagattggtggatgaaggcgaggatggcttttcggacgggctacaggagcatcttcgacagtgttttcgcgctaacatgttggctgctgtggaaagaacgcaatgcgcgtgtctttgaacagaaatttcgaagcatagaacagcttgtgcaagatatcaaggaagaggccattgtctggaagatggcaggagtgttcaaaaaaaaaaactagaatattagggaaggacctaatatcaaataattaggaggggtgaggctttgaacccaggttgtctagcccaccaccttgtggagctagccagaagacccctgggcatttctcaatggcaggagtgttcacaacgtgcaatagcgagatcacgtaatatgcattgtaatttgtagaagttttctagcttacgggtcagggattttgccccaatctgttttcgacagcttactgtcgttgtaagctctttaattgtaatgtacccttcctttcttaatgaaattggtcgaccgaacctttcggccgacctggcaaaaaaaagatatactcagtacgttgtccgttgtttggttaattaacccaactccatgcgtatgcctgaattttcttctgcatctgaagcattttgtttcagatagcacttctgtatctgaagaatttcgtttctgagatgagattcatggacttatctcacagtatgttctgagttgtttggtcaggttaacccaatccctgcatgtgctgtgcttctagttgaggcaggattccacgtagttgttttgctcaacttgtgcatcatgtttgcaagttgcaatgctaattgtgtttatgggctcctttggaatgctgaatgcatgaattttataaataatcacttcagttcagctcagttgccaattgaaatcagttgccaatcaaagacgagtgatgtaataagttcagtgctaagttgccgaatgaaataatagtactgcagttttttgtggaaccaagcagcatgtgttatactctaccttgcaatttgtaggttaagtaacaggaaaatggcgttacataatatttggtaaaatactcttgttaattagagccgaactagaaaaacccgtgtatgaacaagctgaaattaggcacattccttggttgctgtgatttcagtgttagttttacccatccacctactctaaaaagaaaattaagacggaaaaatttctatggagtcctaataacggaccacttgtcagtagttcataaatatgccggagacttccacttaaataataattggcgatacacgatcgtcaacgatcattgaaaagaaaaatatatatatactccaatatacagcaggagtttttcagtacgagaaaaaaaaaactccacaaaacatataaacgtgaggagacttgacaaccgtacaaaaaactttgtacagtggtcagtggtgtggccctcataaatgggccgattccattacaaattctcagcccatatacaacaaatcccccttgttccagtcggcccagcagccagcccaatctagcagcccaacacggcctggacaaaacagtagtccgtccagctggcgagccagctaggcttggagaagaggcttgaagcgaaagcgagcacgcctccaccgccggcgaggctatatatatcggcgaccccttctgcctccgacctcgcaccgatcaatccggctcgcgccaccgcatcgcattcgcatccacggcgagcgcttaggtagtcactagtcagtgcaaggagagctagggctcgatctttgtgagcgagtgatggcggaggagaaggggaaggggaaggaggagggagagggctccgcgatggcgtcgaaggcggcggggattctggtggtgccgggtgcggtgggggtggggaatgcgttgttggaggcgttcgcgaaggtggcggtggagaagaaggacgaggtcgcgacggtgtcggagctggtgcggaagctggtgtcggagggggtggcggaggaggtggcggtgaccgaggcgttggagcatccggtgtttgattcgccggagaaggtggtgcccgaggtggcggaggaggaggagagcggcggcaggatgatcaccctcaagagcttggacggcaagacggtcaaggtgaaggaggcgtcggcgaggctgtccgagaccatcgggaacctcatcgacgacggccgccgccgcggcgacgagaccatcccgcgcctgttcgtcagctacaaggccctcatgaaggtgatcgagtactgcgacgagcacgccaacaacaaggccgacaccgacgagcggaaagaggaactcaagaactgggacaaggccttcatcgacaagctggacgaggacaacatcctcttcgtcgaagtcctcgcggcctccaactacctcaaaatcactggactctccaaactcaccgaccaaaggttcgtcgacccgtttaacaccagcaacaagacccccgacgccgaggagacccgcgtcaacctcatcccggcgaacacctcagccacagcctcgacctcaaggccatcaacatcgacctcaagcccatcaacatcgacctcagcctcacactctgcgactaggagggggagggggaggaggagacactgagacactaccggagaacgtctgagtcttgaagtaacactcactttctctcttaacccgtcgtgtaatggtggttctctcgtcgttgcgtgttgtgtctctgctagattcagatcgaatcggggagttcgtgcatcctgtccaagaagaacagagtcggctgtgtcgttgagtactttgtactgctggatcgcttgcatgaagtgaatatttcgccccaaattgtttgctgtgtcttgttggctttcatgcagtcagtcttcttgttaaatgcttgctctgtttctaactctgtctactcgtgatgcttgggattccaaaccaagcgaattggtttcagatttgcagcatttctcagtactcggggatgttttcctgctcacaatttttattgggtgcaagtttgtgttgcgttttacttggattcaggtgcgaattgagttcaggagggtgaaaacatcgttgtgattttcatctgaatgctgcatttcgtttcagagatgcatgtactggtctgttcgaactgtaaaattttgccccaaattgtttgctgtctctgctcggttttcatggtgctagactactcggtctacttgttggcatgtggttcaattcgtttgtgggattccaatccaagggtttggatgcagattagcaaacatttctccgtgctcaaactgaccggggatgttttcctgttcatgaatttgtgtggcttgcgttttgcctgaattctggtgtgaactggacagataagggaaagtatctgctgcaaatttcgtttcatagatgtatttattgattagtaccgatgactaacggatcatcagttgtttagttcagttcttaacagtaactgatccttctttgttgcaaactgatccaactccctgcatgttttctaacttatcagataaagtttcagagatgttgcaaactggtctttctgtttgtctgtctgtatctgaattcttctggatatttcagagatgtttcagagatgtatctgaattcttctggatatgaaacaattcgtttcagatatggatgtggattcttctgcatgtcacaatgtgttgcatttttctgcatctatagcattccgtttcagagatgaatgggcttatctgaagaatcatgcttgtaacttgcagggctaattgtgttcacgggcttgaatacatgacttttatatatagctttcgtgtgaactaattacttcagttaccataaatatcctgcaagatttctttatttcagaaggggactaactactcagaactcttttaggggattatcaacaaataaattaagttcagttgtcaattgaaaacaacaaaattcctagaaagaaaattcacacactctgtacgcctaatttgaaagttcacatgttttacaaaaataatactggctggtacaatactccctttcgagagatcatagacgagtgatatggggaaaaaaagtaagatgccgaatcaaatgaaccaaacaacatgagtgatatacctttcaattagcaggccaagtaacagggaaatggcgtgacatttttcttcttttgattgttgtgccgtttggctgaacctgtactggtatgatcatttctagtaaaagaaatgggggcctttgcccttgctaaaaaaaaaacaatatgctggagactactttatcctcgatttaagcattgaatcgccatcgttgaagagaaaaagaatatattaatacagtatccactacgagttttcagtatgagaagaaaacaacatatacttcgtataaatctaaggatatctaacaaaccgtacaaatctagcccacgaccttctcctctgggccgtacccagcccaacctactggcccagcaaggcctgcaaatcacagtactctcctactcttggagaagaggaaatgcaacggccgccgcgaaggcgaaggcgaacacgtctccgtctccgggctgcgcctttaaccagaacacgtgagccggcggctatatatcggcgaccccatctgcttccggcgatcgctaaggtaatcagtttccgagagcgagcgagagagagagagagagagagagttagggtttcgcaagtgatggcgacggggaacggagaggccgcggtggtggagaaggagggagagggcacgatggtgccggaggcgctggagaagaaggtggtgttggatgcggcggagaaggaggaggaggagaaggatagcgaggcggaggcggaggcggaggcgaggatctccaagctcgtcggcgacatgatcgacaacgtctgcgccgatcacgggatcccgctccccaaggtcgacataaagaccgtcaggaagatggccgagtacatgaacaagcacttcgccatcaccaacaaggaggaactcaagatctgggacgagggcttcatcaacgagcttgacggcgacgaggacaagtactccctcttcaagatcatccgggcctccgagcgcgtcggcttctatggactcctcgacctcgccagcgacatggtcgcccgcaagatcaaggcgggcaaggccatcgacgagatccgcaagttcctcggcgtcgagaaggacttcaccaaggaggaggaggagaagatccgccgggagaacgcctgggccttcgaggagtagacacctggctgttcttcgtcgtgattgttgttgtttcgtaggtgtgtgttgcgtacttgcatctctggtagattcagatcgaatcggggagttcgtgcatcccgtcccgtgcaagaagaacagagtcgattggctgtgttgttgaatgctttgaactgctggatcgcttgcatgatcgtgaataattttgcttccatcaatgctgtttcctgtgtttgcttggcttcgatgcagttagcctccttattaattgttcgctgtctcctctgtctgctcgttggtttggttcaattgcgttgatgtgattccaatccaagagactggattgcagatttgctgcttgatcgatctgggatgtttccctggtcatgaatttgtattgggaagatttttgttgcgttttggattctggtgtgaattgaattgagaagggaaaacatcgttgcaacatttttcagaattctgcatttttgtttcagagatgcattggactgatcctttagtactctgtctgttgtttggtttatgaaccgaacaggctgcatgtctgaattcttctgcgtctgaaggactttttttttttaacgactcgcacgagacggtgcgaagttttattgataaagcaggaaaaaattacaagattacaaccctggagggtcgtaaccaggaaaaaggaaaaaatataccaccacccacacatcaacagcgccaacacacaagcccaatataccaccacccacacatcaacagcgccaacacacaagcccaggagaaggcaagcaccggaccggccgccgctaagcgtgaccgaccgccgctagaccaacaaaagaacccagacgagatcgccccctaggggatgccaaaacgacgtcttcaagaagagaagcaacggaaagaccgccgccgctgtccgtcggggctcaaaggagccaagactgggctttcgcccggcaaccaccctcttgtgaatccacggctggtgccccgatgctccaccaccattcaagctctgccgacatgtgggaccctagcaccggaatgcgtctgaaggactgaagcacttcttttctgaattcttcttcatctgaaggactgacgcatttcggttatgaattcttctgcatctgaaggactgaagcacttcgtttctgaattcttctgcatctaaaggactgaagcatttcgtttcagatatgcatatgtggactgacacccagtatgttctagtatgttgcattcttcagtatgttaaacatttcgcttcacaggagtagttgttttgagttatgaagttagcccaattcttccctgattgcattatgctttcttgtgcatcatgtagccatttatttagctagttgatgcagttgttgtttcgctcaatagaggatcatgtctgcaacttgcagttaggagtgtttatgggctcctttggaatgcatgggcttttattactccagtcaccataaaaatcttgtgagttcagcagggaactaacttagtattaaacacacttttgggggaactatcaacaaattaattaagcttagtcgtcaatttaatcctagaaagaaaattaattggggagtagctcaatatagtttcttcgcacgcgctctctacagctaacttaaaagttcacaagttgttttacaaacaaatatagttggtctctcactttctactagagagatcaaagatgagtgatgtggtgtggtcactagtcacagtaagttttgccgaatgaaatacagtaataatactccagtaagtttgccgaatgtgcgaaactctgtcctgcaatttgcaggtcaggtaaccggaaaatggcgtggcataatattttctaaaatatccttaattaggcacatttcttggtttctatagtgaattttcagtgttagttttacccaccaccttttcttaggaggaaaagttaagatggtaaaatttctccttactagcaccaaacctgaagagattta

SEQ ID NO: 66734 - DNA, 5960 bp, Oryza sativa
agctagacaagagagaagtggcagatggggggaccctacggatggaattccaacaactgcgacagcagggaagtgcttaagatcagatgctaagccagccaaaagagagccatcagttctaacaacaaagacctaagccatcaagcaaggagcatgcctaaaagagatccagagagaggtgaggcacgagcaacacctagatgatggatgaaagcctagctggtcagggcaaggagcagcgcaaggatcggtgactagagagacatcacagttgtcggtgacatgggaccgggagtatcatgactagaggcttgaggcagacacaatcgcccacgtggcctggcaccctcggggggtgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacgcttctgaaaaagggggaataatagcaagattgagtacaaccaccgtactcagcaagccacaccaacgatgcagacgtgcaaggggatccaaggatggtttgtggctatttgcataaaggcggttgtaaaacattttattgagcaaaacagtaaaactgttgagtaattaaagtaaattagatctccactgatcaacgctacaccacgttgaacaggcccaaccaacccacctgtactacagtgcattgggtcgatttattaggggtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccaggtgtttcgagcacgcagctcaacaagatactagaaaggtctaaaactgtaattatcccatcaactgagctagtggtaattaagcatggctaagcatatagttctagctaggtcacataagtaacacaagctagtcgatttatcacccaaggttgacaaaggacagatatcaagtaaacatggcacaagcgagcagataggtaaaccctattcccatgtaattagcaagacatgcatgtttatttgcaaacggtaaaacatttataaattgggatcaacatgctcaaggggaatgtgtgacttgccttgcttcttcacttggatcttctaaactcttttcctcgcgaccgcggacttccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattaaactcgatttattgcgcaattattaattatttttacaaaggaaaaaggatctcgctgacgtcagcaaggggcagccggcgccgacacgcgggccccacacgtcagcgggtcaaggagctcggtgcaccgtggaccgggaccacaaggacggtccaccgccggtccacgggatggacggcccagatcgggccaagccgatcgggcagctgaggggagtggtggcagggcacgggcacagccagggctggcccgaccgaccacagagggcggcggcgcgcagacggccggacaaccggcggcggcggcggcgcaacgcggcgctggcacgggaggcggccggcaaagaggaaaaggaggagggaggcggctcaccgagaggcgcggcgacggagggagcggccgcggagggaggcggcggcgctccttgggtcgacgacgcggagggacgcacggcggtggatggcgagggcgaggaggcagacgaggtgcaacacacgacgacgaagccgacaaaggtgacggcaagcggcgaccgcggctatggcggtgatgattgccggccggaaacggtgaatggatgtggtggctcgggtgtgtggtgggaaggtggtttcggtggtggcgagggagagaaaaacggtggccgagcttgggcttgtggcgacgaagccggcggtggcgacggagcagtgctgcggcggttctagcgacgggaggcggcagccggcgctcacaaaggcaatggcggctcgggttggcagtggaggtggcagcccggtggtggattgggggagtgtagcggtggacgacgtgcggcgtggagtggtgatgccgacggcatgggttgcgcggcgcggcggtggcgctagcagcgacgaggtgcggctggaggcgacgaatgggtcggcggcctcgggtgcacggtgaagaagtggttccgggggtggaggagggaagggaaacggatgccggggtgaagcgtgggacggcgatgccgatggtggcgacggcgctgcgcggagatggcgagagcggcggctagaggcgaccggagctcgccagagagcggcggcgcgcgggagcggcgtggggagagcgggagaaggcgagggaagcgccggcgaggaggggaaacgagagaagggagcccggggatggattttataagctcggggagggaaaatcgttgccgggcgtggcggatttggggcggcaatgacccgcgacgtgggtgacatcgtgggcgaagtggagctcgatcccggcacaatttttgggggaaacatggggagagtgtagaggaggtggatgggaaccgatttcatgcggtttgggcgcgagggcgcgagcggaagaggccggaatcgtgggcgacgtgggcggcaatggcggcacagcggtttggatgagggaggctggaggtagaggaagggtctgacaagcgggtcccacggccccacttgtcggcctgaggggagggaggaggcgcgcagggacgcaaagcagacttggggaggggaggcgcgctgggccggcggcccgaggagagaaggaaggagggggaggaatttgggccgagcccgaaagggaggaaggggaagaaaggagaattaaatttgttttctttttatttaattggttaaatgatctttgtgactttaaaactatttctcgagctccgaaaattcacggaaaattccggagagtattttagggcacaaagaatattgcaaaatattcccggccaatgatttttaagggaaaattttaattctcccattatttcacttggataaattgatttaacttttatttaatttctagaaaatgcattatttaatgatttttaatcccgaacgaaaatcggggcgttacaaatctaccccccttacaggaatctcgtcccgagattctgggatggctagaaagaaagctggtgctggtcggcggtctgactgatctgcacattgaactgccacatcctgcttcgaactgattgattgactggttgatcaaacctgcacgattgaactggctggattcgacctttctgttcctttgctttgccaaaactggaccgactggttctgcttgaactgacccagactaggactgcggatgctcctgaaacttacttatcttggactgaactgttgaggttggcaattttggtaacctgagaattcaccacgctggctataagaggatgaaaattgaatctggcatttgtaaatcatttaccctatgtccgcttcgactggtcccaattcaaatgacaagtaattccaggaaaacctgcttgacctgcctttcgtctgtactacaactgtcctcgctgttgcttttctaagctaaactgttgacatgcttcacaggtgtaccttagaatcgaacctgtcgacctgagattggggtgactctgctgacaccttgcaactggcttcttcagtactacccggattgttgcactgggttgaaccttcaactaaaacagcgacgaagtgagccaaaactcatctccgagacctaccccccttacatggagtagtcttactttctcctgactaggaacaattggactattgtccttgaaaaataaccaacacttctcttgcttacaaaggccctcactttgaaaactgaaacttcaccgattcatcaaaatagagtaatgacggcgcactttcatcccagcaagatttggaacttaatcctcagttgctgatgggagattccacataaaagtgactctcatttagctcatgaacacactgactcttgactaactttcccataagttctaactactggcatgactgtcctgcttctatcttgacttcggtgtcgagttgcaaaaactgaactaaccgactctgcattggaactgacacaactcgaggagttggggtgtcgctaacaaagctcttgatgtgatgacgctgacgccttactgtggaacaaccctctgagaggtgccctgtcgtacatcttccatggatagttggacactttgcaaaaactgctcttgaaaaccataaccactataggtagcatatgttactcctgggattggtggtggcttagctgtgctgctttgctgaggacttggtggcgtactatctgaggttgtgggtgcttcctctttgaaaacaaattggctttggctctgatcctaattccagcttgcatctaggcttgtacatgttgttggagacactggtgttgcatctgctgcattggactctacggttgctgtatcaacatctgacacatccatcatctgacattggctaaccaaaatctgcccagagagaggtgctctgatttagcttgtagctggctgccttgaactgatccaatggctctgaccgcaacacactactgctggagttatttccgctacatttgaccaggtgtcgaacctgcatctcccacatcgatacacccatcttctgatcttggacaccaaaagttgatcatgagcagggttcatctggcgttggggcaccttgcagctttcaactaaaccattgatctgtggctttaattgatcttatctctgacactgaccatctgctgctaggacggaagagaggtggaagagaggggtcgctaaagataaggtactaaaccacttgcctactgatctgttgtgactacacttttattgttcaagttgcttaagcaaacaacctagtatggtcgcatccccaccaatgatgcaaaccatacccctacacacaagcaaacaacacacgatctagaaagctaacggaactactcttctgggaaagattgggtttaggtcaacttcgggaaaactccacttgatcttcgcagaacgacgactctgaactgatcttctcgctccttgcacgaagcttgaggctcgaattgacttgacttccgaacagacatgaagctgacagctggtcctctagggttgacaactaaaagaa

SEQ ID NO: 66735 - DNA, 14631 bp, Oryza sativa
tatattatgggacaaagggagtacctctgtttcatattatgctttgacttttttcctagtcaaacttctttaagttggaccaagtttataaagttggtcaaacttaaagaagtttgactaagaaatagtcaaagcgacttatagtaggaaatggagggagtatgtgtaaagcttaatggagtttttttttcctattctttgcatactatttattactccattctctagctgcacgtctcaaaattaaaaccaatgtcacaactcacaacatagtaaacagtcctgtatgaagttttattcaaggaatagttttaggaattcaaggacagttttgcatttatcctgtatgagacgtggaaactgttgtttcttttgcttccaatgctttgtaggtttgttattctgacaatctcttcttttttctgaaactcagcttttgggccgatcattgttttgtcttggactgctccttaggtatggttctcaactcatggcagcatccgaaaatcaacttgatttcccaaagattatcagcttgctgaagaaggaatatcttctcaaggatgatttcagcttgaaggttcgaggtttgcaggtgtgcacacttggaatcaattactgcacttactggcactagaaaaactagatggatggatggcatgtccacctgtctagataacagaatgttgctttagtttcatttatttttcatatttagaaactattcagtactagatgatatatttttctgtgcatgcaggctttgggatacatacttattgcaaagcctgattttatgctacgtaaagatatctcaaccctaatagagtcatcattgtcttctgttgttgattatagattaaaggtatacactctcttttagtaatatgtaatggcacatgctctgtatagactgtttaaaatggaccctcctgtccagattcaaggattgcagaacctttttgagtatctacgtgatgcggaaagccagctcaatgcagagagtactggcaagcctacacccaatgcaacaaacggtggaagtgaagtgcctgttgctgcaggtgctggagatactaacatatgcggtggtattatccaattatattggaattctattcttgaaagatgcttggatataaatgatcaagtccgtcaaactgcactaaaggtgaattagaccaatgtgcatacttttacaattgtcctttatattttacaatataaacaataattgtttttttttagattgttgaaattgttctccgccagggtttggttcaccccattacttgtgttccacaccttatagcactagaaactgacccactggaggggaactcaaagttggctcatcatctgctaatgaatatgaatgaaaagtatggtgacctaccttctcattcttatgttccttttggacataatcttctgattgttaggagttgtttgcaggtacccttcattttttgaaagccggttaggtgatggcctgcagatgtcatttcgatttttcgagtccacaatcagcaatcatgatatggtggccacaaacatgaaatctaatccaattgcgtttgttaaacctgggatatctcgaatataccgcctcatccgtgcaaaccggaattccaggaacaaatttgtacactcaatagtccgtaaatttgagggtgataaccgcagttaccccacaattagctttctcatgtaagtagccagattaaattatgcttgccaactctctattactggataatgtatttgactacaaagttgcataacaattgcaggtactgtgctgaagttcttgcgtctctcccattcacaagccctgatgagccactttacttgatatatgatataaatcgggttattcaattaagagctggagcagttgaggcaaatttgaaaaattggacttccatgtatcagcagcaagaaatggtgggtatgccaagagacactggtgatgttatgcatgagcctgggggatgctctgaccaaaatttggttgatgtctctcaaatgatgcttggcaatacatgcagcacgccagttgttaacatggccaaacttcaggtgagttagagagaactatcggcgtagtggctagtgagagttcatcaatgcatagatcggtgagccttttttttttttcatttcagtttgtttttgttgtcaggaggattgccatggcgcgatagccctgcagctccttctcaagctgaagagacatctgaaaactgtctatagtttaaccgatgcccggtgtcaggtttgccctgccagtcccatatttgaacattgttaatcctaagatgattttactgacacaagttctatttgaactttcaacattacaggcattttctttgaaggatccaccaaaatctggcgaaacaatctccaagcagaatatcccattgaacattagtaataccaacaccagtttgccgagctgcccgcaggatgcagcacgtgtataccaggtagcgatgctgaaaaattctggatttgtggggaacaaagttgtagtagcatgttttattgtctggggtttggcaggcgctgctgtgtgtgtaacatttgatgtgaatttggacgtgatggacaggatttcaagacagtgctgcgagaagacaccgtggactacgggatgtacaccgtttcggcccagaaaaaacgtccgactccaagaagctcgtcgagagtaagaagaccggcggctgttacaagaggccgtggtggtggtggtggtggtggtgatgaggacaccgatgacgaagattggactggtggtggagcaagagtgctggacttcagcgctcagggtgggcgagtaacaaggcagagggtccaagtctgactggctgctgactgactgttgttggtgcttcttgtgtacattgtaggaaattttataggtaacaggggaggtttaggtcgtcttaggggccattgttagtacatagaagcagaaaaaaggaaaggaagatatctagcttttacttagatgccattaatttggagcactccttttcttttgcttgctgttgcccaatttagatgttgtaattgctctcgggctctggcaatactccaacaaacaggttgtgctcctttctaattcaatggaaaagaaatgctttcttttgcttctcacttgagtgtttccactgtctttattctcgacaacacactgcattttttaaagtgaagacagaaagtggtcaagaaaaaatgagtgagtacattgctggctggcataaacaatgaggcgtgtgtgatttacgcttgaatcgtgctagctccagcattttctccttgctattaaagaaaattgggctgggacttgggtgcctggtttcgttgggtttgacgaggaaatcaccaagacgaattcaaaaatcgaaacaagacgatgtgtcaatttttgatagaattagtagttgttgactaatctgattgatggcagatgatgtgtcaatttttagagctatagtagactagtagtagactattacgaatcattaaggccgagttagttacaatttttttcttcaaactttcaactttttcatcacatcaaaactctcctacacatataaatttccaacttttctgtcacatcgttctaattttaaccaaactttcaattttaacgtgaactaaacacagcctaaacagctcttagcctaagccaattattggctatgccacatactcccttaattattggctatgccacactccctctgtccctaaatagttgacgccgttgatttttttaaaacatgtttaaccattcgtcttattttaaaaaattaagtaataattaattattttcctatcatttgatttattgttaaatatatttttatgtatacatataattttatatatttcacaaaaaaatgaataaaacgaacggtcaaacatttgctaaaaagttaacggcgtcaaatatttaggatatacccctatgaacatcacgtcgcctaccactgaaagaacaaagtgctaaatcctaaaaaaattgcttccatgtagagttgaacccaggatctaacgtactactaagattcttgtaaccaccaggctagttttggtttgcttccaatttatacccttgctattacaaattatatatgttatataaatttagtagtgacaaaacttaccaaggtttaaacactttctaaaaataaaatattagtagggcaagaattgctagtaaaccaaaccagctcgtaatcaattcatacatggcaagggttaaaacgtcttttctccttaaattattggggaaaaataaatgaaaaacaaatgtaacggaagacagagttgtatataaactctgaaacatttcgatctcggagatctaaaaattacgaaataataatattacatatagttagatcgtgatagattctgacgtgtgtaaagccgtgctaaaaaaaatcaatatagcagactcctctctcggtctcggtgctcctcaaaaaaaaaaaaaaaaaaagcaaaccctaacgcctgagaactgaggagcgaaccggcgggatggcggcggcggcggcggtggcggcggctgggagggcagtccggtacggcgtgttatcgaaagcgctgccgacacggctgcacatcaacagcggccgaggtctcgacatctccgaggctgagggccctctcgataggtacatccaggtgttgatggtgcgtactcctctctaccgcaaacccgctactttgtatgcatacttcgttctttacattcgatccggtttacctcaagaggaaggggattaaaaaaaaattctgttccaaattaagtctctgaatagtcaagtcaaggttcccggctactcctgatctggctggctttcagttgagcaaatagcctcctttctaatcaccttagcttgtaatcaaatcttattctacctagggcagctgctgcttaattttctgcttttgatcatcctgtgtgatgagtaaccaaccaaatgttaaccaattaaactcactggaatcgattgattgttctttaacttcctcaattcacgttcttgttctcttcgactacgaagagtcggatttttttacttttagcgaaccattcgactccgcttatttgccctggatggccctttaagaggggataatctgtttcgccaagattaatgcaatgattataatgttgtttttagaaagattgagaaatctattgagctaaaactctgctagctttgtttggggggaattgtgaaataccataggttccccaacatacttgcaggttattattgttctttctattttcttagttataccctgtgattaggcctggattgaaatttacttctgttttttttggaccttttccttgaattcttgggattttgggtttataattatcgtactaattttatacatttaccaagtaaagtctgggatggctctgtatagaactatagatatggttagcaatatattagaaaataaaggggatttgaaagatgagttgacaccatgcaagggcctattgataattgaaatttgaaaacttaacttgagtcaacgagtcgtggcttgcatgtgcaagataatggggtgctcttcatgttaatgtcaaaatgtcactattctaagtgattcttgggagatatgtcattttaacatatcacatctagttctcttttagttcattgagctcagtcgaaagaattgacttggtaattttcagtatttatccaaagttcccaacataagggtggaagtccaaaatccaaacctgcctttttaatgtatgatagctttctgaatttatcaggcgacaagaaatctctgctgagttgatactcatcataaaccaaatcgtattatatcttttagtggatatggaagtttgaattagccgtgtcaatatgcaaactcgactgtttcagaagctaaggatgtatttggttccttgcatcaatatcatcttggctcagatcatgcagtagccagcagtttggtttcctgcataggccaatgagcctgtctctgtgcatgcaaaaagttagctggagcatggcctggagggaatgagttttagtttcattacttaccggcttggtttgcttgagtcaagaaaagcttcccatgagcattgtcccctctagataccttgaaaaatgtgcagatgcatgaaaccaaagtacttcagtcgggggattgggcaaacaaactcaactagataaacagtttcaacatgcgcgctggaccatttgaaccaggtttaatgggaccggccaggccacccagcacccaggcaaccaaatgcaccgtaagtatacatgatagattttgtcaggaagggtgcttatcagggggtctgactttgtcttggctgtgaagttcttctctcattgatttggttgcaaacttttgctagcatatatggactgagttttatacctgccttgcaaatttaatcttgactgcttgggatctggttttattacaaccctcattaattttatgcaagaccatactatgcatgaccaagtatggtcttgagtgttgaaatgatttgcaatggattagaaaaatctagagactgaacaggtgtgctgtgattgtgcaagatctatcggaaacaactgacatgattgcaatgggcattcggccatttgacaacaaatttccaatagaaaaggggcaatctttcacttctatcaaatccatttcttccccttaagactagggactataaaaaggaacttgagtggaaagctttcaaatgtaactatagcttcattataattgtaagataatcacaccataaatatactaacttcattataacttttatttactgtatataacttgtatgtgagtattaaaaaaattcatgcaatttcatacatatgatatatagaggttacaatgttgttatattgtaattaaactacaattatactatagttgtaatgtagttcaactatactacagttatgtttgaaagttttataccaaaaatcatgtgactgttttttagcagttccctaagactggtatttttctgaagcactatggataatattagtatattacatctgttgcttaactggggtatccattatcataaaacaaatcattatacagcttgaggtatagaagttttgtattaaccatgtcaatttgcagaatgaaagaaaccttggaaaagtaaggagtatagagaagattttgtcaaaaagagatatggtgagagaaagctctgagaggtacttgggatgcgtcatgtatttttcctcactaatgtacactctgcactcaccctaatcccttcgaatatactgcagcctgatccttgagcgcatgaagaagattggcacacacaatacgaaacatgcgtggatggttgctggcgtcactatttccgggtacttgtttggggccgcattcgttgcccttcttacagagtcccaactgccaaagcgtgaagaggagaaagaggcttgaattctgccaagacaagaagcttggatttgaagagtgaaagaagagtacaagggtttagaagtaatgtagtaccttccatccatgcttaaattgttgactcagacctcccttcaacatttaactgagacccttttccttttttatatatttcatgtaactgcaaagtatgctgtgcaaatgcttaccggtgtttccttttcgaatccctaatagtagaattactcttaatatggttgtcttgttttctggatgtggtcattaacagtagcaacaggaagcccgggtaaatcatgtcgttctgcagaatttggtgcatattgagagccaacacaacaaatagtcccccgttcccccgttctatttaacttgtattatcacgcacgtttatgagctcttaaatggtacgattttccaaaagaaaactgtttaccagcatctacatctcttagagaacttaaattaacttatcaactttccaatctttaatttagtcagttaaggctctgtttgaatctcctgaagataaaaataaaaataaagattaaatgttttacgtaaaagataataacttatgattaactgagttttaattattataaatatgaaaaatagattaatctgatattttagaacaactttcatataaaaaattttcgcataaaacgtaccatttagcagtttgaaaagcgtgccacgaaaatccaaaacttaatgttcactttgttgggttctcgaacagcgcttacacccacaaaataataaagtaaatttcatccataatcccatcatccaacagcgctttaaaacaaattatgccataattatttgcgagacaaacaatatttagatattccaatcatcaaacttccagaatcatcacaacaaacacaatcatcaaacttccaaaatcacatttccttcacagtcatcaaacctcctttgggtgttcctctagaagtaacagaagtatcaaacaaactagatgcgcaggtatcaaaagtgctcctccagaagtaccaaagagtaagtactacaaaatggggctacaaaatccggagtcactctcttttgccctgctgaggagcccatccctgtgactgcgaacctctcactcgctctaggacatcaatcttaccgaacactttctcatacgcagccacaagccgaagaaagaagtatccaactgtgggtatcagaatgataacgagcatggtgaacttccccttcttgtcctcaggaaggcggtagccgatgttgtccaacacgccagctatgcccttgggtttctcaaggctacaatgcaaacaaaaaaaaaaggttcaaacgtataatgaaaacaaataccacagaaaaaagaacaaggtaaataccaaaaagccataccttttaattattgtgctcatagacttggtaagcttggttaacatttccacattgccctcgctcaaagtaatcatgtgctcagccctaagtaacaatacaaagaacattagagtttaacagcctttcatgagaaaaaataactcttaaacttgacctaatactaaccaggtctgcatggctctagcaaaaatgcgcttttccaagttggacatcggctgcacaacatgaataatattcagaacaatggtaggtgaatggccgaaggttttctatttgctgattgctaccattcaacaatgttttatgttagttttgacatatatctgaaaacagcagcctgtatccacacattagatgtcatggtcgggattacgtatcgtcgcagagggcgtgtggttccgcaagcgtcgccgggcggaacggcggagtagcgcgcggaagctgcgtgccggatgactacagtgcggcgattggatgagttcagattgttagtctgtttatcagtttgttagcttgtttttagcacattggttaattcgtgtacgcctatttagaggcacagtttcggtggagtttaattaagcagattcaatctctagttctctcatctcctattctctatttgctcatcccttgctgttcatcacgggtcgtcgttccaccaaaccccctcgtccaccgccaatcacacattcatatcacatacgttcttacgccggggctcgtgacaacttggtatcagagctcatggcaacggacgaatcctccaccaacgcagccaccgtcgcagccgcagctgcggtcgcagctccggtctccaatgctgacatcgccaagctccgcgagtccatggccgacgtacttcatggcatgtcgctcctcgcatccaaaagtgacttggcggatctcagccgctcagttgccgtcgcctcatctcgccttacatcgctggagcagcagggtgctgcatcgacctcaactccgccgcgactcggtggcgacggaatgttccggcgaccaccaccaccaccaccaccaccaccatcatctggctctcccccaccaccaccaccaccgccgcccccgccgccgcctccgcctcctccaccgctgttcacgagacggtctcatgcgccccaggacaacagttctggcacgggcgttcctcgcttctataaactggaatttcccaaatatgacggcaaagacgatcccctcaattggttcaatcattgtgaacaattcttccgaggacagaagacaccggatggtgatcgtgtatggctggccacgtaccatctcaccggtgacgctcaggaatggtattttcactacgagcagcatcacggacccccagattggtacgccttcaaggaattgtgccatgcccaatttgggccgccaatccatcgcaatgccctgggcgaactgaagcggctatatcaggcctcctcggtggctgcctaccagacaaaatttctggcattggcaagccggacgacggagccgctcactgacttgcaacaaatccagcttttgatgacaaatacaaaaatacttatgttatgcttaaagaacatttgatgacaaatcaaatcacaataaaataaataataattacataaattttttgaataaaacgaaaggtcaaacatttgttaaaaagtcaacagcgtcatacattaaaatacggagggagtatattccagtgcatgggtttgctgaaccaaagtagttgaaagcttagaaagtgtagagaagcatactataagcatgttaccatatttgggaaactagacccacaaagaaatttcatgaaccatgcatccaaagaattctgactcatattccatcagcgggcaaactttgacatcctgaaaggaaatcaggagaaaaaaattatccccatgtggtatgtgaagtatatatattgcattagtgcaattatgttctatgtgtatcctttcttggagatgcatttagtccaagtgacagcacatgggaccgcccgaaaagtcgattacccagatgaaagaacattacaaacccaccaaaaaacaacagaataatataaccacagtccttatgccaacaatgtgtggtcaataagaattgaattaggttctgatattgcaaaagaagtgaatcaattatgatgagtcaatgacccaattgtgtttattctcaacaaccaccgcagactattttggacaaatgagtagaaatcttaacaaagcagttatcttattcactacagaccaacaaaatggagtgatatacagcaagaaagaggaggaagaatgaaataaacatgcccaccttcacatcagttggctggaagtagatgaagagtactcaataacaatacgaattaagaatccaataccaaacagagagatatcaagcaacatgataactatgcccatctcagatttctataccaacctttaactctcccatagccaagcacgtaagtggatgaaacagaaaggcttacacaggtaaatttatcaactgatgcatgtcaccctgctaaattacaagggaacgaacctgagtaagctaacctactagaataccaaccacaggacaatttggagatattccaccaagataacttgaaacaactattaaggaacaccctaaaacaacatctaagaaagaaccgagggcataatcatgtaatagaacaagtggtatcacacagaaaaagagaagagagaatgtaattgattttttcatgatttcctgttgctttagtgctttagtatagtatttctatgccctagcaacatgcttcaagaaatattgcaaaagatataaatgcaaggactagggagcaacgtcataggtttaaacagcaaaattaatttatcaaatactcatttgagatcaagatagtgcaaaccaggccaaaggcccaatttgtggcaaagaaacagagggagtacagattagtaaagcagtagaggcatcaacaggatatcctattcacaattaagacctataaaattacaaagtaatagaaaaaggggagtatccagagtgctttcgttgttggcctatgccctatgaaggtacagaacaccaggttcattacaactgataccaaaacctaaataatttagggagtggggaaggaccatgagaactttgtattaaaggtaccaacagtaaaacacatagattaacataaacatagctaaaatatgaaaaggtctggaatataagaaaaaatgaacaacttgcatgggggcatatgtgggctgcataaattacaaactttggtgcagcatctgcggtttaaacaaagaaaatgatgctacacctacatagataagatcaggtttgacgattaacgaacgaaaatctagatcaacctcatctactttcgttcattcatggatgtctacaaagataacgatcaatcattctctgcatatttaagatatggttccacttcaccatgctaaaatgttagcatcaggcctcacagatggattgtaaatgttccatcccatacatatatatatatatatatatatatatatatatatatatatatatatatatatatatatatatatatgtgtgtgtgtgtgtgtgtgtgtgtgtgtgtgtgtgtgtgtgtgtgtgtgtgtgtgtgtgtgtgtgtgtgtgtgtgtgtgtgtgtgggtgagggtatatgaggcagttctgaaggcgagtttctaactgggattggattggattggattgtcaatgtagcatctcaggagtgtccatgaatgattttggcctaaatcaacagttgaaacttgagggtttaattggctatttctcccacatcaatcaaatggacaaggcagacacaaatatataatgatactttgatgtgaagccccaataagagctcaagtacaggcagcaaacatgtttttcgcaggcccgctgcacattccaaaaaacaaaagtaagcaaaataaaggaataccacactgcaaaatgtcgtttggccaatgggccaaacaaacttacatatcgccaactagacaggacagaagaaaatatacagttgaatatgaatagtactgcacaatttgaaaggaaatgttttcagcacaagcacaatggaggttctaatttttgccagacttaatattaattgcaccctagatggtactttggaaaatgaagtgatgttaagtcagaaaattataatgttaagaaaaatcatgtgatctccatcaaacgaaaatgcaccagaaacaatggcatacaagagaatatagacccactatcttacaggacggcaacattcaaacatacccaaagtctaggctgtctttactctgaacacgtgagtctagaatgcagaagtctaggctgtcttacaggacgccaatattctaacctagattagccctcttctatactatctattggctaaacagcctagacctcagttcagagcaaagcgtgaattctgcttctatcaaaccactacagcttttgtgggagcgggtgcagaacacaccaatcatccctaacttctctttttgaggagtataaatataaagaatggttatctcaaattccataacatctaataaggaacaaacagaatggaaaaaaaaatacggtgtcaacacagaggctgctaaaaaggaattcattacagagctcaatctgcattaggatgatattgggaaaggagacattgcccaatcatcataatactcatagtaaaaagtctacttaaccccagaagtattatgattcgttcccttttaaccccctattaaaatataaaacggattattcaacccactaaagtatgaaaaccagttcaaacaactccctagtggtttggccatgtggactacgacaagtgatagtgacatagtgatggattcgatttaaaaattaattaagttcagttatacagcttggaaaagaagaacgttaatgtaaataggtattcccaggctcactgataagtgaacaaagggagcgattgggccagcttgagtaaaattagctaacatgggagccgcataagcaataccacccgccatggttgagtagactttctcttctatagtataatataatataattcaatggctcacccaggacatatcaaagcaaccatcagagctaaaagtgagttgacattatgtgtcttgtcattcttcataaagtattttatacaagtgtaaaaaaaaaggagggcttgtatcatttttttcgcatgggcacttgtatcatgtttctagttcaatgtctattcagatgtataggaacttgaatagaaagctaagaaaactgtgcaaaaaaaaatcacatgtatcctcgggggaaacttcaaagaggaattttagaattaagataatttgttcacaaccgtgtgcaactgattggtgtgcaccatatagtgctcatgcataggttgatttcccctctgtagggtacagagagaataaagttatagcacaagttactccctccgcattttatagcgtgtattttgtgtcacaagtaaaatgatttgaccaacagttactctattaatattttaataattatgagccacaaaattataaccagaagatatctaataagatcaattttgtgtcacaaaattatgtattagtagagaagctattggtcaaagtcctgtactgacaaaaagttaaatatgtcctataacaaaaagaaaagaatggagttaggatttacaatttcctacta

SEQ ID NO: 66736 - DNA, 13575 bp, Oryza sativa
acccccttagccattccagcgagtgccgagtggtcgtggaaaaaggcgtgatttttattctgatacaaaaatcaaaggcacgttttttcagggatatttttttgttcactgccttatctaaaaattcgtaagcactaaaaagcaggcaacttttgcgactgactcaccttgaacatggtttcataccaaatggattcacataagggaaagtgcattcgtccatcgagcagatatctccttgtttcatgtatatcatctaaatagttataaaaaatttaaaataaaataacaggatagattaatatgaaatatatcataccacaaacatataaactaaaattcaacttttataaattataacaaaaataataaatataaatataaatgtagaaaactatatttagtttaatttattgttttggttgcaacttgtaaagtgaaacttcccttacatgatacggtttattggtagccagaaatgtatgtcgccagggatttgacttcaatccatacaactcaagaatacttttgagttaccgacacctgtcattattttcttttggcgggaaatataggccctgtttagttcgcgagatgtaaatgaaggggttttcggacacgaatgaaaaaactaatttcacagcccgtacaggaaccgcgagacgaatcttttgagcctaattaattcgtcattagcacatgtgggttactgtagcacttatggctaatcatggactaattatactcaaaagattcgtctcgcgatttccattataactgtgtaattagtttttatttttatctatatttaatgcttcatgcatatgtccaaaacttcgatgtgatgtttttggaaaaaacattttgggaactaaacgcggctataattgatatcaatacaaaacactgtcaagaagtacaattgttttttttttgcccatttttatttattgtcgattaaagttgaaaattgatttacattaaaaataacggcaaaaaaagtactccaagcaaattgttgcataaatataaacaactaataatgcaaaacagtttaataattgagtaaagtgcattggcggtcctcaaacttatagggttgtgtcatatatgttcctaaactctcaaaatacatatccaggtcccagaacttatcaaagtgtatcatataggtcccaaatcgacacattccctttaagatcctacgtggcgctgatgtggcatgccatatggatgtgacatgtcattttcttttttcttcttcttttctttttatttttctttgttttcttctcattcttctttttttcctttcttctgtttgggtcacagagaaagaagaagaaagggaaaaatagagaagaaaaaaaagaaaaaggaaaaattttaaataggatccatttgtcagtcaaaatgatgccacatcattccgtgtggcatgccacatcaacgccatgtaggattctgaaggggttgtggtgatttggaatctagatgacacactatgataagttctgggacttgaatatgcgttttgagagtttagagacctaaataacacaccactacaagtttaaggaccgccggtacactttactcttaataatttatctctccgccgtaccgggcaggacgtacgccgccatgaactccttcgcggcggaggcgacggcggcagggtcgggggagacgagcgtccgagggagggaaagcgtggcggtgaaggcgaggcgggagagggtgatgccggcgccacggacgtagctccgcctggcctttgaagtgttagttggagacaagtgccgcgagggcgcccgagggcggcgaggtcgaggcggacgaagtcgaggaggccgagggctccgagggcggcgtcgtgggtggcgggcacgtcgacgaggcagaggtgcgggagaggcttgcagtgaaccatgcgggcggcgcgctccgggatgcggtcaaacaccttgtgcggcagcgcgcggtgagcgttggaggaggcgaggagcttggctttggcattcacatcagatttggcatccgtttaaggaggggaaaggcaaaaatattttgtcccccacatgtcacatcggatatacgggcacacatttgaaatattaaacatagtctaataacaaaataaattacagattccgtctgtaaactgcgagacaaatttattaagcctaattaatctgttgttagcaaatatttactgtagcacccacattattaaatcatggcgcaaatagacttaaaagattcgtctcgcaatttcctggcgaactgtgtaattggtttttttatctatatttaatactccatacatgtgtccaacattcaatgtgacagcgtgaaaaattttgcttgggttgtcatgaattcatcaaattgctatgcaagagggagtagttaagcatgaaactaagcattatatttctccatcatgatgccattcacaagttatcagaggcacataatagatttcggctccgccatgcatatgttattttcatttgtttagagaaggccatgagtttaggacgttttggatcaatgaaggtttccagaattaccgtcatagaatacaatttgctcttcttatgagattcgtagaaatccaccctgttccaaccaccaaacaagcattgttctgtactgagaagagcacaacaccccatacataaaattcactttgagaaattaatcaatttttgacaaacatgagttcatcctccagcagtccagcacacggctcgttggactttttcactgagaaataaaaaggaaatccattttactccccccaaacttttcgttgaaatgcttgaccccctaaataatttttcagctcattttacactcttaactattgaaaatagttcatcttactccctaacgatatttgtccttttcgtttttctatataggtcatattatgcaatgaaatttggtggtattgatattcattagaacttatctctcaacatcttttggaattgttttcgctgtttacataggttgaaagcaataaaactattttttttttgcggggagcaagaaaactaatttaaacatagaggttttaaatatcaagcaaatggtcgtgaaaaaaaatttaaaattattttagaattttaatattggtgttatttatggcactacaaaatctaaagctgaaaatacgactcatataaatagaaacaagaaaataacgagtaaaatgaatcgtttataatagtttagcaaggtaaaatgagaaaataactagtttacaaagttaagtgatccatcacaatagttcgagggagtaaacttgacttttcttaagatactagtgtattaagttgcgtattcgcgcagctataaactccctctctagattgcggtagtaataataagcttaaatttgtaatgatgattaatcataacctctttaaatggatgcatagctgatagttatatcagtatatcacacacatatacatatgctcatcactgttagatatactttgaatgatataaagcttagtcggatcatattaatctttattaaaagatgaggtttattcgtaaaccatgtgaattgtaaaattatatgcacaatatttgttggatctttctaaatataggttaatgatctatttgcaatttttttcctcgcaggaaagttgcatagtttttaaattaaaagtgtacattgtaaaattatatccataaccttactgttttttcttagtaggttaagaaagcttctagacaaagtgaatccaatggctcatatttcttcttactattttgtcttcatgtggattcaatggctattattttgttaattatgtagatcatcctagttaattcttgggattcatcattcacttatagatactactatttgagggtgtccaattggactttatccccgttcaaagccctattgcgtccacagatgggcctaatagcccacaagtgtcccttttttttttctttttatattttttgcgcgcgacgaggaggataaggagctcgcgaagccgcgcgggccactccgccgcctcccatgtccaccgccgccgccgccgccgccgccgccgccgtgcagcccgtgctcccctcctcctccgcctcaaccggaggccagcagcatggtgtactcacggctgaccgcgtggcggggctgctcaccggctgcgcgaccctccgccgaaccggcgagctccacgccgcggcggtccgcgccggcgtcgacggcgaccgggcggtgggcttccgcctccagcgcgcctacgccgcatccgaccgcctcgacctcaccgtcacgctcctccgcctcacgcccgaccccaccaccgtgttctacacctgcgccatccacgcccactcctcccgcggcctccacctcgccgcgctcgcgctgctctccgagatgctgggtagggggctcatccccacctagcacaccctctcctcctccctccccgcctgccacggcctcgccttggccgcgcccttcacgcctacgccttcaagctggcgctcgccggcgactcctacgtcgccaccgcgctgctcggcatgtacgcgcgcgggggcgacgccgacgccgcgcgcgcgctgttcgacgaaatgcccgatccgcacgtcgtgccagtcacggcgatgctcacctgctacgccaagatgggggcactcgacgacgcgcgcgagctgttcgacgggatgcccagcaaggacttcatctgctggaacgccatgatcgatggctacacgcagcacgggaggccgaacgaggcgctccggttgttccggtggatgctgcggtcaggtgtcgatcccgatgaggtggccatcattcttgcgctctctgcagtcgcgcagctcggcacagcagagtccgggaggtggcttcattcctatgtcaagaacagccggcgagttcagctcaatgccagggttggcacggcgctcattgacatgtactgcaagtgtggcagcctggaggacgccgtgtcagtgttcaacagcatcggcgacaaagacatcgtcgtctggaacgccatgatcaacggctacgcgatgcacggagatagcaggaaggcactggagatgttttcgcagctgcggtcacaaggcctctggccaactgacatcaccttcatcggcttgctcaatgcctgcagccattctgggcttgtcgacgaaggccaccaattcttccaatcaatggaggaggagtacgccattgtccccaagatcgagcactacggttgcatggtcgatctcctcggtcgtgccgggctcatagaagaagcattccaccttgtccagagcatgacgatcgcccctgacaccgtcatgtgggtgtcactgctcgccgcgtgccggcttcacaagaacatggcgttaggccagcagatcgccgactatctcgtcgccggtggacttgccaactccggtatgtacatcctcctgtcgaacatctacgcggctgttggtaactgggaagaagttgcaagagtaaggtccatgatgaaggccagtggcatccagaaggagcccgggtgcagcgccatcgaggtcggccgcaaggtctacgagttcgtcgccggcgacatgagccatcctcgcacagatgagatatacgccatgctggagaagatgaacgggattgtgaaagagcagggacatgttccacagaccgagctggtgctacatgatctggatgaggtgaccaaggagaaggcattggcagttcacagcgagaagctcgccgttgcgtttgggctcataagcacggcgcccggggagacgatcaagatcgtcaagaacctgagggcgtgcgccgattgccatgccgtgctgaagctgatatcgaagatcactgggaggaagatcgtgttcagggacaggaacaggtttcaccatttcgttgatgggtcatgcacttgtggagattactggtgatgccgccatggcgtctcacagctcataggattgatttggttttagcattgctactagattttggtagaatagaatgaagtgttgatgtttggctttgctaaaaatcgagttagtataggttacattttacagtctgcttccggctttcctgatcatgtttgcagccatgttgggaaatcggaggcaggcatcttattatagaaaacaaaatcaagttgtaccattcaaagtgtaattctaagcatcattctacaatttcatgcgccaaggagccaacaaactagcatcaaaacatctaccagtccacagcagctagcacaacctgttccatggcaaggatcagttggcacattcacacctgacctgagggtattcattccataataattaaaagttagtaacaggatactcacaaagaaccaaaggagttttattctaacacaaaactccacaataaatttgttggtttgtctgtaattgtccaattcaattacatactccatccatcccttatattttaggatggagagtgccaaggcttttgcagcttctaacattatgtggtctgcctttctcttaatctttttcacgccatcgtgagaatttcatagtacagttttgtgtgtatttgagtttacttttattagtacagttttgtgtgtatttgagtttacttttatttttttgtatgattatttcttagtatatttgataggttgatgttaggagaactgtgcataaataaaccaagcaatctcctcacctgcaaagctcaagattaatatttcttgcacgcataagtttatcttgagagatttggcacaataagtgtctccatgtatgataagattataaacagatcaagaaacgaagatactttatgatatgtttcataacttaaataggacagatgacaactaaaaattgacttttgggtgccaaactagtataacataaataaaatctaattaacataaagtgcagaagatcttagtcttcgcagagcataagatatagtggtttgatgtcatgtcaataacagataactcgatagagttgtttaaacactaacagcattctaaccgcaaaacttgataaacacaaattattttcatccaatctctcaatatgttgtataagtttctaaacattgacatcggcaccaaagtgcagaagatcttagtcttcaaagcagagcataggatatagtggtttggtgtcatgtcaataacagataactcgacagagttgtttaaacactaacggcattgtaaccgcaaaacttgataaacacaaattattttcatctaatctctcaatatgttgtataagtttctaaacattgacattggcatatgttgtataagtttcaaacattgacattggcaccactagcaggcttcacatatttttgattaactctctctatatatatacccgttgttatgaattcatcaaattgatgtgctagaggttttgggagtagttaagcatgaaacaagcatttctccatcatggtaccatccacaatcacaagttattaggggtattaggttctggctccggcatgcatatgttgtttttgtttgtttggaaagggctaagagcctaagatgttccggatcaatgaaagctttccagattaccacgagataattctatttgtacttaagtacaaatccactctatagtgttaatgtagatggtgactctatagagaaggaaacaagtcaccatctacggtctgtcctttagacaaacttgctttactgtactcagggagcctgtttcagatttttcctgaccgcatttgcggtaatatatgtgcattgaaggcatatatatatatatgtactactataagtaagaaaatcaagctgtatcattcaaagaataattctaagtaagcatctttatacaatttcatgcaccaggtgccaaaaaactaatataaaaacatctatgtgaaataacttgaaacaaaacaccagtcgacagtggcacaacctgtcccatggcaaggatcagtgggcacattcaacacccgaattggtaactaaatagttacaagctactcattcaagaataactaaaaatagttacaatttaatggagttttcatcggcgagcccgggaggctgcccgggctagctgggcggtggctccgcccttgcttctaatcaatggattattgtgtgatgcttgtgcttccgtctagtaagctggtctgctggctcatatatcccatcatcacatcattattgtcgtaatttcacatggcttctagggtgagagaagctaattacatatcttacacaaggaagtgtgcaccttggccaacggatcaaaagttattgctatcatcctgagatcagttgcccatcgaaatagttacctcggaaaaacaacttcaattcatgtttcactccttcaataccatgtactttcacttcttgaaaatccaaggagatgtgcttagttttccagtcatctggctgaccacaaatactttacccatcagtcacctagtaataaccatgcataatactaaataaggaggatgcaattttaccttccaaggctgtaagtccactatcagtacatccgtagcacatgaaatacacaagctccataagcatggggtcctgatgataaccgcaggaacagtttctccgcatgtggaagtatagttatgtagtccatcatgtattgcttgtcatcaaggttctgttgcagcaaagtttcgattagtcaaaaagaaaggaccacatatacatcacatagccacggaaaaaccacaggcatctttttgttaaaagaaaaacaaatgcaagggaacgagaacaagaacaagtcagccttgtcgtaatgctagaggaagtgtcgcaacatgttctaaaatattagctatcattatgcaaacgatgtcattaccatcatatcacatatatatgtccagaactaagtcatagtgttactttctaattttactctataatctaaacaccgaaaacctattaaacaatattttttctcttttaaaaaattgaagtataggtaatgaggtttagtgataaggaagcttgttaagactttattgaagggcaattagttggaatatactctattcgtaaaaaaaagagtaattgtagcattcaaaacatggtaattgtagcattcaaaacattcaaaacatgaattagttgggagggaaaaaaacctaaatgcctctcattaaatcattactcaaataaatcattttgagtcttagatttgagctgtgcatgtgaggaagttgtcggtttgcttatgcacaattctcttaacattgacctatcaaacgtataaataaactgttatatgtttattcaaagattcattgagttatacaagaatatcaacaataaggagtacgtaagttattctgatagatttggcatccaatctctcgatatgttgtataagtttctaaacattaacatttggcacaccactagcaatcttcatctattttagattgactatatatatgcacacgacacacgaattgttatgaattcatcatattgatgtgtaagagattttggaagtagttatgtatgaaaaaagtgtttctccgtcatgatgccattcataatcacaagatatcataggtataccaaaggtacaggctctggcatgcatatgttgttttcgtttgtttagaaactggtagaagcctaagacatttagatcctaagacgctcagatcaattgaagctttccagattactgcgagagaatccaatttgtatttcttgtgaatccaatttgtatttcttgtgagatttgtacaaatccacactctgttccaaccaccaaacaagcattattatgtacaagtaccacatacataaaattcacttgagaaattcattgaaatttggacgaataatggtccttcagctcatcaaagtaaaaataaataaataaataatagcaaaacaaatgttacatcctccaatattcggctttctacgccgctccatccattatggcctattcaaaacccattacattgagatatgagccgactaacctatactgggatttttcttctacgacaagtttaccattcacaatttgagtagaaacagaaaattgaggtttgtctttgctttaaaaaagagagcaaatatagagatggaaaaaagttcccattcccaaacttaaagtcagtctttgcttccggttttcctgacagttgccttggaaacctaagtcagtctttgcttccggaagtaactgagactgaagcgagaaaaactgaagcagaagctgcttggtgtgcctccaaaatgaccccaacgtcactactgtataacatcccacgttcaactccattttaccctcgaatctaaacactaaaaaagctattaacaccaaaaaattgtccataaaaatttttgaccaccacacacatattttgaatcaataacataataactatgcagaagaacacaaatcatggtaaacgatcatagcaaggtaaaatcagagtaccaaagctctgtatacatagtactgcaaccaggtaaaggtgacactaaaagtgtacatagtactgcaactaggtaaaggtgacactaaaagtaccagcaacaacaaccgttttaagttttaattgcagttttaccaccacaaggtatcacaccaccaaaaagtatcagataccaaagatcaagcaacatacttactaaccataataatgatcatcaggtgtcttggtgaaattgctttgccgaaattcatagaacaccccactcgtattctggtgtatttcaaggcaagccccagggtggcctgctacaatctcgcgtagcttctggcatgattcctcacttgcatcagccatacaatctaaagttatcgtcatttttttaagcgctggtgacaccaggaacagtagcgccacaaagttaaaatcatgctctgttcctctgaagctgcgaatttctgcttcctcgagaccatgcacgatggcttcccattcattccagtctgggtgctcatcacactcgcaattcgaatggcaaggactattcgcctgaaatcagtagacaatatactcatggctgattgattggtatataaacaaaatgaggtgtgacaggaaatatcactaaaaacaatgtagtgtaacatttaagcctagagtattgtgcccatagttgcaagtttgcgcatttaataatctttacaatggaatatcttaatgttcatgcctcatagtataaaagtaggccttctcaaatacaccaatcatatgacaaacataaccaatcttagaattatatcctaacaacgctttcaatgttgacgtaccgagtaacatatcagcccaattaccacgaattcaaatatattttctatctcaacatgacagtgatagagatgaaatggtttgtatcacaccggtagtcacctatgaaatcacaggtgcatggcgcaactaccaaggataatacctatgaaatcacatgttcaggaacaactaccaaaatggatgtgaacataaagccaatctaaacgacagaacattatagaacaggtaatgctacaccccctgagtcagcaaaaagaacttctaatttggagtttcttgtgcctttgcgcatacatcaagttttgttatagtttacaagctagcatacatatgaaaataggcacagtttaaggttcccaacgaaccaccagaaacatcagagctaagtatcatattcaaaccaacatggtatgtgctattaggaaataaagccttagtagtttaccactgttccatcaagtaatgtcagttgtaatcttttaacactggggcatagcgagagcaaatagaatactgaagttccaactgaatgtcctcttgcgtacaaccataaagacatggtattcatgttgggaagcttggttatgtattccatcaaatattcatatttatctaaatcctgcactaaattaaaaaaacagtcaaaaataagaagggtcatataagatagtacaagaaatgcagaaatatatagttttattcatctgtcataaggaatgctttataatttaaaatgagcatttaaattgacggaaaggtgaaaggggtgttatctatttggatattccatggtcacaaacaaacagttgcattgctaattctctataaacaaactctgagcatgagtatcaacactgaagattgatatgacacggagggggagggtggaatacaaaacatgggactttcgaattcagcttttagtgctatgctctacacttcttcttttttttatctgtttggccaacaataaggaaacctatacttgaattctaggcacatgatgcttgatcatgaataaggaaacctctatgtggtaatgtaatacaatttgaccaaataaacaaatactccataaagataggttatatttctcaactctcgagttctaacataataatttcttaattttccacgtttgaactatgtgtgttaatgatagttatttttttagcttaagctacgcatctcaaatactctccctattccacttgccaaattcagaacatggatgcatgccgatgtccgacactcgcatttacatctcgtaagcattgcaaacatgcaacgacagtaccaaaacaagaacatatataataaaaatatgccattcatgtaactacatacacttaatcctcccgtggtcccccttaactaattttgatggttcgatctcgcaaagagattaagaaccgtttaaagcgttttcgcgggaactacttgctaacttatttccacattagagtgttttcgcgggaactacttgctaacctatttccacattagagaacaggtgttatgttttccatgtttgaactatgtgtgttaatgatagttttagtttttttttagctttagctacgcgtctcaaatactctccccattccacttgccaaattcgatgcatgccgatgtccgatactcgcatttacgtctcgtaaacattgcgaacatgcaacgacggtaccaaaacaagaacataacaaaaatatgtcattcatgtaactacatatgcttaatcctcccgtgcttcccccttaactaatcttaatgcttaatggttcgatgtcgcaaagagagtaagaaccgtttaaagcattttcgcgggaactacttgctaatctatttccacaatagagagagcaggtgataagtactcactctttcatagctgagcaggaggtctagacggtagacagccgagaagcgccccaagagcaacgcgaattcctgaatgattgtgttgtccggccgaccaaagacaggaatggtgaaggcggcgagctgctggaggcgcgcgaagccgacgaaccgcacagaacctatattaaaccgatcgccccatcgaagagactccagatccggggcatggatcgagcaattccactcctggatgtagtagaagcaggatagcagttcgagcgtcctgaggccgggcgccatgagcgtgagctccatcaatccggggacgaactcgagctcgaaatggtggagggagtcggagtagatgcccatggtgtcaatcc

SEQ ID NO: 66737 - DNA, 888 bp, Oryza sativa
aaaaaatttaataagacgaacagtcaaacatatgctaaaaagtcaacggtgtcaaacattttgaaacgaagggagtataatgcagagtgacaaaacagcaaaactcatgtctcgcatgagaaatgtaagacaattagaatccaagtagttgtaattggaggaaggtcatttcagtcattcagtaggaatgggaagcactgggatagataacctcttcggcagattgagagtactgtctccgaatttctgttacttcaatgatcctgacgcacagcaactatctcgaacacatgatgagctgaggcgcattggttgtcagtcagacatcaagtgatttattcttctgactacgcctacaaatcgcaagaaatgagattgcgaaagtacagcctgaattgttgcatgcaaattttgtttattatgaaatgagaaaacgaaacagccgccatgtgtaattcttgttacgacactaattgtgcgctaagaaaagagcgacgactagcagttagggtgcgtttgagccgtgtggctttatttgtttttttttaaaaaaaaaaaaaactgagctgcgttactatgttcttgagttcatggttacgccttgggaggtacttggctctatgaattcatggcactattcaaattgctctattcatgatcatgccagctgttcttttgtcctccattatttacaaaatggaatagtttgagctgttctaaacccattaagtagtactgtatcagggtctcatcgtttggcttttttcgtaataagccaaaacggcttattagagaacaaaaattaatttgtaggtaaaacttttatatatgtgttctcggtgacttaaaagccaaatactgaaaaagaaactacgttaaaaatatctc

SEQ ID NO: 66738 - DNA, 4444 bp, Oryza sativa
  unsure (1)..(4444): unsure at all n locations
tttgtaaaggctaggttttntgtagttattagagactgtacatcatcagtatatgtggtatctgcattgagaaatctcagaatggactcgtgcctgctgatgttttgatttgatactaacatgcattactccactaacgaatcgagtattatcttttgggtgttattttgacctttcttgagtacgctgtaggaaaacggattgcttcatgtcccgaaagaggaagcacagaaagctcaggctgccatgttttcagatccaaacatggccatggacatgatgaaaaacaacctctctatgatagttcctcaggttcagtagcttacatttcaattttcttccatcttagctaccatggctctgtttactaaacatgttgcttcaatatttttcagacacttacatttgcatgggtgaacttcttctttttgggttttgttgcaggtatgcactttatagtgtatgctactgtggtacctgttcttctgatatgccgattccatgtttatatatttatttaatgctgcttcaaaatcatcagtgttaagtattaactagtataaaaatacatcaccattcaagccttggcaaactgatatgatgtgtactacgttgttctcatgtgagatctgtctttttttatttgaggcacaagtgcattgaaatggttgtcatgtaatgcactggtggatcccctgcctggtggccccaggcagccgcccgggttcgtcatgattgcgcagtgaaattttagtgttaacttagagatttaaaataatattttcatagcagacacttagttgagatgtacttgcccaggctctagaattgctattgggcattgaagcttcagtcatgctacttatgttaagaaaagtatatccaggactgcctggaaaaaagtagatatcatatttccacgtcgatgtttaacctgtttactcatcaaggattaattctccatggaaattatgaagtatattttttttcagttaatcagattgccttgcatgaaataaccttatgacagtatgatcattttagcctggatatatactgaagttatcccatctcctatagctgcatttggaaaattttagtttaaaatattgaggtacatcatccttataaccatgatcttccctgagacgagaagtttgacaacaactaaaattctacaagagtgaaatgtgttatccatgattttgaattttcagatatgattgaatggttgatgggtttggtatactggttactgataatatagccatacgtgtcatccacttattttggttttgtaatcatatgtacaattcaatggcatgtacttgtgtccctggactcacatatttcctgctctcttttcagctaagattcccttttcattgactccgcgattcaggggaatgctgcaaaacgggatagacctgagtactgttgatgtgagctatgttagcagccgttcatggtgcgtatattttatttttaatttttttggcaaaatgccaggtaaggaatgatctaggttatatatgaatcacaacttctgaagtgctctaatggtttcttgttattatcaggtactttctcaatttgtttggtttgaggggtctcttcagtctgatcctcggtgaagaaaatggttagataacaaagtcactcctatgtggaactttgtcatatttatggattctcttgattgtgctttgttgtcttggagttttatgatttttttttcatgacctgcagctaatgatgatgcacaaaagatgatgcagatgggtgggggatttggcggtaatcccacaatggtatggtgctccccatcttttaatggattcctgatgcttatcttgaactgatgcatataaacatgcattacatagcacaggttcctgaatacaaaagaaaaaaaaactccagttagcatttttattttcatagaccctgcatgttggaccttcacataaattagattaaattactttaagcataggatgtatagcttgaatgagtctgtatgaaaaaaatactttgggcattttgaattattgtaatgatgtatccacttgattggagcgttggccatttttagtgcttaaatgctacttgagggtttcagttgttccattattttgttgcgcaatgcaaattgtaccttcttgctccaaaaccagacataataaatactgcaggggagtggtgcagctcatatcttgtcatattatccctttgatagatatattcagcaatatgcatagctattttaattcctcattgaatagttaggtattttgttgtccaaaaattcatctgaaatctgcttgatgttttacagtcctttggttgtccttttccactattgatttcactaactttctgtatgcatgcatgttataatggttctttgaacgaactagattaacacagaatcatgtcacatttttgaactggctgtttccagggtttggccgcagagaaagacaacctggatataatccagcatgactgggctttaccaaagatggagcatcatgctgaggaagtgctgaggaagcttctgaagaaatgataggaaactaggctgctccaatgcattactacatcttgcaaaatttttgttttaacctgtttattgaccagacagttaaaactttgtatctgtataacttatggccaagaatttccttcagaaagtttatgtatcatttttctgttatacggaccacagccaggctcaatgcagaatgaacaaaaatcttttttcttggcaaagaggtactgactcagtaaatttgattgcaggcttagcattagtaattcctatgagctctcgttagttgcacaatacaatattatgttgtggcgatgtagttttacactggagaatgcccatgcttcccgagcttataaatggtgcaaattttataacaactcttcatatgaatttttcaagtactgttttaaatccacttttcaactttatttaattcattcatttgtagtctcgaataattatcagaaatctaaatcattacgctattcatcataaaataaaagctattcagcacaaatgaacgtggtataatgcccataggatagaaatgcacaatctgaacaaacaagtttatcatttaatggcaaaattagtcagataacaccgaaagttttcgttttggttttatagcaccaaaatgttcttgttcactttaatgaaccggaagtaactttcaatgttattaaagtgaatcggaacctttcggtgctataagaccaaaacgaaaactttcaatgctctgtaacccatttaacctaatttaattcgtcaatatatcagagatgttctgaacaaacaagttcataatttgtcagtatatcagagatgttcgtgctttctttataactttatacagtgacacaatggttttccgtttatacatacatacatacataattacatcactaagtagactataaacaatcccaattcaagccacacacacaacacaaattcttcattcttcacacgcaccgtgtgatcgggccacgaagctcacatgacggggtagctcggcagcagcgcgatgccgcacagcccggacgccaagccggcgacgtcgcgctgcatgaggatgtagccggggttgccccactccgccccccacgagttcttcacgatccagtacttctcgccgcctttcgccgcgccgccgccgtccgtcttcggctcggactcgccgtagcccaccacggtgacgccgtggttgacgtcggcggtgcacggccccgtgtagaccccgctgccgtagagctggaacatgaagctgccgccgtcgacggcgacggacaccggctgcgccgcggcggccctcgccaggtcgggctcgctgctgggcgtcacgttccggtagcccgcgatggcgaccgcgctctggttcagcttcgccgcttggcacgcgccgttcgcggcgtggtacgggtagctcgcctccgtggtcaggccgtggttgccgacgacgaactcgaacgcccagctcatgtacccgccgccgcaccccaccgccttgtcgtcgcagtccacgagctcctgctccgacagcgacaccagctcgccgttcttgatctggttgatcccctctatcgccgccaccgcggagaacgcccagcaagaacctgcatccacgcagattttccatcggttaatctccaacattttttacagggttgaatctttctttaccattgctattgctcacacaccacaatctccttggttcttcacttccaccactgcccctttcttcctccaatctacgctcttcggcagaatatcatcactgctctctccaggcattgctatgtcagcctgttaaaacacaaatttgttgttcataattcactcttattatgaaaaacaaagtataatttgagtgagtgaatatca

SEQ ID NO: 66739 - DNA, 1395 bp, Oryza sativa
tttgggatctgtgtgacttgccttgctggccttgaaactcttcaaaatcttcccctgtaaaatcggactctccgggaacgtcggaatctaaagagaaaagaacaaaatcaccaaaacaacacttaaacaagcatgaacagtacatgtggatatttttaacatgtagatctcaattttagaaaaatttagagacttgaaccaacaaaatccgagctaagataaattagttatgaattttcaaagattaaatcggattaaatcatttatatggattttaattgaattatgacgcaataatgaattatttttgaaaaggaaaaagagattattgcgtcagcggctagggttcacggcggcggctcacggaaacgaacggccgggatcgatctatccaaatcagacggccgagatctaaacggtctacgaccggtctacggcggatggcgtcgatgatgtcagcggtgacgtcatcaccggcgacggctcggacggcgcatgctcgccggcgaacgacggcgcggcggcgcgaacggacggcacctacgggttgcgggcgacacggcgaactcaccggtgaccaaagtagcggcggaagatcaacggacggcgacggcgtcgaggaagaagcggcggcgtccttcggcttgacgacgacggcggtgcttcggcgacctacagagacgacggaggggtggacgaggtcggcgacgacttgacgatcacgatggcggccttcccgagcgacgacgacgaccggagcggcgacggcgcaaggctggacgaactgcggcaacggcggcgctaggctacacggcgctagagctctaccggcggcgagagacgaaggcgagggtggcggcgggtagaggagacaccgggggtccttttataggggctagggggccgcggcgaaggcccacggcggccggcggcggtgatggaaaggttagggttcggagagagagaggaatccgattcgagatcgaatccaccgatttccaaacgatttagccgacgattccaaaagtgaaaagatagaggagatctcggggatcatttcccctctattaatttcaccggaaaaggaaagggatgaacgaatttggaacgagacggcggcgcggctcggttagggttcgggcgtggcagctgcgcgaggaagacgaagactgacaggtgggccccacctgtcagcgagcgggacgcgcgcgcgcgggcggcgctcggctgcgggctgacctgggccggggaggagagagagaggtttgggccgactttcggcccaaagccaaaagagagatttttaaaactttttcatttaaattattcatgaagtgcaattccatttattaaaaatacttccttagctcaaataaatcccagaaaaatctagga

SEQ ID NO: 66740 - DNA, 25636 bp, Oryza sativa
  unsure (1)..(25636): unsure at all n locations
tagcggccgcgaaagcgaaagccaacacgcctccgtctccgactctccgcctcctccgcgctataaaaaggcgcccccccataaccccattcggcttggaccactcaccgatcaatccgtctcgtctcgttccactgcttcaccgcgagcgaaaggggagagttggggttttgcgagcgagatcgagcgatggcgacggggagcggagcagcggcggcggcggcggcggatgcggaggagaaggagagcggcagcaggatgatcaccctgacgagcaacgagggcaaggcattcgttgtgacggaggcgtcggcgaggcagtccgcgaccatcaggagcatggtcgacgacggcggctgcgtcgacaagggcttcccgctccccaacgtcgactccaagaccctcgcgagggtgatccagtactgcgacgagcacggcaacaaggagccccacaccgtcgacgagagagcggcgctcgccaagttcgacagggacttcatcgccgagctggacgccgacaaggccttcctctacgacgtcaccatggccgccaactacctccacatccaagggctcctcgccctcaccacccagtgcgtcgccgacaccatcaagggcaagacccccgaggagatccgcacggccttcggcatcgagtacgacctcaccgcgcaggacgagaaggagatcaaggaggaggatactcacgcatgacgcaccagctagctgcccccgtaagccgtagtgtcctcgtcgtaacgattgttctctcgtagttgcgcgttgtgtctctggtggattcagatccaatcaagcttactgcctttgagttcgtgcatcctgtgtccaagtagaagtgtagaactgagtcggctgtgtcgttgaatgcttttgcaactgctggatcgcttgcatgaagtgaatattttgccccgaaattgttttgctgtgtccgcttggcgttcatgcagttagtcttcttgttaaatgcttgctctgtctctaactctgtctactcgtgatgcttgggattccaaaccaacagatttggtttcagatttgcaatgcaacagttctcagtcctcagggatgttttcctgctcacaaatttttatcaggtgcaagtttgtgttgcgttttgcttgaactcaagtgcgaattgaattcaggagggagaaacacatcgttgcaattttatctgaatgctgcatttcgttttagtgatgcatggattggtcctgttcgaactgtaattttttgccccaaattgtttgctgtcgctcggttttcatgcagttagactactcggtctacttgttggcatccaacccaagagtttggttgcagattagcgatatctctcagtgctcaaacttaccggggatgttttcttgttcatgaatttgtatgggttgcgttttgcctgaatttctggtgtgaactgaacagagaatggaaagcgttttgcaaatttatctgaatgctgcatttcatttcatatatgtatgtactgattagtaacaatgaccaactgatcagtttttggttcagttctcaacagtaactgatccttctgtgttgcaaactgatccaactccctgcatgtttcatgtttgcaacctgatcagataaagtttcagagatgttacaaactgatccttcagtatgtctgtctgtttggttgattgacccaactccctgcatgtatctgaattcttctggatatgaaacaattcgtttcagatatggatgtggattattaccctagtatgtcacaatttgttgcattcttctgcatctgtagcattcagtttcagagatgaatgggcttatatgaagaatcatgcttgtaacttgcagggactgtgtttacaggcttgagtacatgaattttatatatagttttcgtatgaacaaattacttcagttaccataaaggtcctgtaaggtttctttatttcagaaggggctaacttttcagagctcttttagggaactatcaacaaataaattaagttcagttgccaattgaaaacaacaaaatttctagaaagaaaattcacatactatgtaacctaatttaaaagttcagatgctttttttaaaaaaattcacgcactatgcagtaaccacaaaagctccaatgttgcgccgtgagccaaggaaggggacgggactagtccacaaaagctccaatatcggcatgtccagcaacctctgagctgctctgaaggaagaagaaacaactctagcacataccagttatatttgttgttgaactcggagtgaggtcataccactttttttagataatggaagcttttattgaactcagtcaattacatcaaggtgatccaattatcctgagaacacttccggcctatgcataactaagatgcacacagccgaacaaacaaaaccacactcgaaaggaaaaaagaatgacatggagtattgagaaccatcaatctaacgaaggaccaccaattctaagactagattgtcacctatatctctgggtaaaaaactccttgaccaccttctccaaatgttgacatgccgcaactaccatatcccgtgaaccaggcttctgtaggatagcccatgtacaaagccaatggataagagaatatataacctgcaaaggtgaagatatgatttttttttatcaaaaaccacattattcctgcatagccaaagcgaccaacaagtagcaactgctcctaacagaacatgtaatttcaaattatgatgaattccatcaaaccagctcccaaacatatgcgctacacaatgtgaggtcataccacttgacatagatgttctgatgcatgccctcaaaatgaggcaattacagatgtaactggtccaggattatttatattaattgtaatcaatcgagttgtaacctcatttattattcatatagcaaggtatataaattgagcaagtttcgagtttctagtaaaaacaaataatatcctagactagaatatgatgatcatatatcaaggttataacatatcaactccataatactccctccgtcccaaaataagtgcagttttacactattcacgttcaacgtttgaccgttcgtcttatttgaatttttttatgattagtatttttattgctattagatgataaaacatgaataatactttatgtgtgactaaatatttgtaaatttttcataaatttttcaaataagatggacggtcaaacgttggatacggatatccacggctgcacttattttggaacggaggtagtatatcttacaatctttgtctaccccaatgctgtgcattgggcgagtcaatcttgtctaggactaggtatatagtgttccatgtaagatatatggcgcctagtaatagaccacagaatgagtgtgtcttgtggtgagaaagacggtggctggcacagagatatccaatctcccaaacaactctcaataccaaatctgcatccggattcccccgtcgaggcatatcctttatgaaagtatgtacctggaaacacgcagatcttaggggaaacaacacaacactcaaagttaatttcataattgaaaagatcagcactgaaaaattccatccaaaatacatcaagggcaggccaagacgaagcaatcaagcaactcagaaagtttgtaagttaatttgcaacggtgatcaggatgtacaaagaaattaaacttttcccaaaaaatattaaaataaaactagtaccggcaaataattagctagcccatgatttagagaaaggaccaacgaaatgtaacaaacttgacatatatctagacaaaattaactaaagaaggtcctaaagctacaacgaaactaactaggggatacttgatcaaggaaataactcgactagggaggaagatgcctcccagctcttaaaaagaaattaaaaaaaacttgactacggaggaagacaaatttcgaattttaactcacatgtttgtgaaaatatatataatagattgatctatcttgacaaattttttgataaattttttagtgtcatgcataaaacggtatatttacgtctatgcatgctgcgtgcgatgcgttgcacttgcacgttgcacgttgtaaccccacccaagccgtcgatcaggcctccggcccatccgcccgcccgtggcagcgttggggagagtcgaccgaccgacgcgcccgccgatcgatcgaaaccatatcaattcgttcgcccggcgggtaaaatgcggtacatatgttcctgttgcgtgccacgctgggagtttcgatatatcgatcctgcgcaatcacatgctacagtacataatcacgttagcgtcgtacctattcccggaaactctaatggcgagcgatcgccccctagtttccttttttagcaccacattactttcctattttagtaaatttatacgtctaaagtttatacacctcaagttacacatctaaagtttagagaccaaaaatttatatatccgattaaaatttgaatttgaattcaaatatttttttatatatagtatttctatacatctaaagtttataagtcaaaagtttatataccccgtttcaaatttgaatttaaattatatctgattcaaatttgaatttgaattcaaatattttctatatatagtattttcatacatctaaagtttatacacctaaagtttatagatccgaagtttataattaaaagtttacatacccgatttaatttgaatttgaattcaaattttttatatacagtatttctatacatatataaaaaaacgtgtgtgaagtggtatggacatgatcgtgggtcacatggtctcgatcatgtgcgtggggctttttcagttttgccgtttctgatcgcgcatgcgtccgtcccgcgatcactcgcgtttcaggaggacccaccgcttcctgccaccgagtcggccgtcgtcgtattcttcggtgtatctttttttttttcacggtatatatgcatgtcacttgtattgtaaagggaggggaggcaatcattctagcaacacaaatacaaaacatctctagttttagtctttgccgatagacaccgtaacttctttaatttgctcgtagaaatcttaaaagcatgataatttgctgaaatatagtgtatnnnnnnnnnnnnnnnnnnnnaaactttaggagttatagaaagggattgatcgccaaaataaatagcattggggagagatgattgccctgcgtcgtagctcactgctatagtaccctgatttactcacacgcagactacttaactatcgtatcatgtgggccccacatgtcagcagcaaactctttccttatctctcacacagtcatcctccctttgctcttcactatcctcactagcccgggaggcatgctgcgggcggcgtgcacaggggtggtggccgatagtgtcctagtgaactcattgcaagataaaaggcaaaatccctcctctctcctgtcacagtggaggacgacagtaagaacggtgaggctaagcttagacggagaaagcttggggacgtgcggagctcgagcttgatgaggtactccaagcctggggaaggttccaacaaggcttggggcagcttgggagctcaagctcgagcacccctacgactacttgctctcccccaccgttgaatcggcgccgacagcgaacccacgaatccttcgtcccaagatctcaatttaggctgtgtttgtttggagttgttctcaactctcccatctcgttttctgcgcgcacgcttttcaaactactaaacggtgtgttttttgcaaaagtctatatacgaaagttgcttaaaaaatcatattgatccatttttgaaaaaaaatagctaatacttaataaatcacgcgctaatagatcacttggtttttcgtgctcaggagatgggttcccaaccccctccaacgaatacagccttattttcttcgcacacactctacatctaacttaaaagttcataagttgttttacaaacaagcatagttggtctccctttctaggttgtgtttagttccacgccaaattggaacgatgtgacggaaaagttagaaatttttgtgggtaggaaagttcaatgtgacgaaaaagttataagtttgaagaaaaaagttggaatctaaacatggccctattagagagatcaaagatgagcgttgtggggtcactggttatagactcagtaaattttgctgaatgagatacaatataatagtacttcagtaagttcgccgaacgtgcgatactctatatatgttgcagtttgtaggtcaggcgtgacgtagtatttgctaaaatatccttaattaggcatatttcttggttgttgtaggtgaattttcagtgttagttttacccatccacctgttcttaggaggcaatcaggctgtgttctttatcacctgctcccaatttatatcccttattttctgcacacacgcttcccaatcggttaaatggtacacttttttaaaggaaactatatgaaaattacttaaaaatattcatactattttattttttaagtttgttttagctaatgtttaattaattatgtgttaatgtattgcttcattttgcgtgtggggatgtgaagtttccaaccttcacctcacaacgcaacctaagatggtgaaatttctcataactagcaccaattactgtcgttcatcgatactaaacctgaggagatttaacgtacgaattcttttcccagccgaaaaataaaggaatatgggagcacgtacagtacgatagcatggttctcaacatgggccgagtccaatacaaattctctgcccatggaccacaaccttctggcccaacacagcctgcaaacacagaaggttctcgtgcagctggcgagccagctaggcttggagaggaggaaacgtagcggccgcgaaagcgaaagcgagcacgcctccgtctccgcctcctccgggctataaaaaggcgcccccccatttggctcggaccactcacctatcaatccgtctcgtctcgtctcgtctcgtgccagtgccactgcttcaccgcgagcgaaaggagagttggggttttgcgagcgagagcgagtgatggcgaaggggagcggagaggcggcggcggccgcggcggcggcggaggggaaggggggaggagccggttgcggcggcggtggtggagatggagggagaggacgcggtggtgccggaggcggtggcggcggatgcggagaaggcggaggagaaggagagcggcagcaggatgatcaccctgaagagcaacgagggcaaggcgttcgttgtgacggaggtgtcggcgaggcagtccacgaccatcgggcacatgatcgacgacgactgcaccagggaagccgtcccgctccccaacgtcgactctaagaccctcgagaaggtgatcgagtacttcgacgagcacgccaacaacaaggccgacaccgacgacgagaaagcggcgctcgacaagtttgacaaggacttcatcggcgagctggacggtgacaaggccttcctcttccacgtcaccatggccgccaactacctccacgcccaaggactcctcgacctcaccacccagtgcatcgccgacaccatcaagggcaagacccccgaggagatccgcacggccttcaacatcgcgtacgacctcaccgaggaggaccaggaggagatcaaggaggaggatgcctgggccttctgaggagcacgcacctgccgcgtaattgttctcgtagttgtgtgttgtgtctctggtggattcagatctgatcagcttacctttgagttcgtgcatcctgtccaagtagaagtgtagaactgagtcggctgtgtcgttgaatgctttgcaactgctggatcgcttgcatgaagtgaaatattttgctccaaatacttttgctgtgtctgctttggtttcatgcggttattcttctgatgagatgtctgctctgctctgcctctaaaaactactctgtctactcgttggcgtgtggttcattggtgggattcggtttcagttttgcaacatttcggagctcgatcgatcggggatgtgttcctgttcatgagtttgtatcgggtgcaagtttgggggtcgcttttttgcttggattcttgtgtgagttgaatagagaagggggaaaatgtcacgccatctgtttcactctgttcttcctttctaccgatctctgttcgtaacaaaaaatcgctgcaactttatctgaatgctcaatttcgtttcagatattcatggactgaccagttagtagtgaccccgtatgctgttctgttgtttggttgattatttgcgcaactccatgcatgtgcctgaattcttatggatctgaagcatttcatttcatatatgcatgtggactgaccctccagaatgttctgcgttgtgtgttcttcagaatctgaagcatttcgcttcacagatatatgaactgatgtcccagtgtgttctgacttctgagttgtttggttaaattaaacctaattccgtgagttgtttggttcaattaaaacccaattccatgaacatgttctgctttcttacagatcattcagttgatatcccgctgtgtttgctttataaaatttctgtacgtgtctgaattcctcagtgctgatccaaatgagttcgtgttgctttgagaaattatgggctgttcgttgcacctgttgctttctcctgctctgtgtttctgagttccatgttaaattcctgcacaatcgtaaatctgtttgaattggcattatttctgaacttgggatcagaggatttgcacaatttcaatttcagttgaaacacgtgattcttactatctgagactaatagggggcaagcttctgataattagacagtgatttctgctatgaattgaatagagaagagaaatcctcgtttcaactttatctcaccgctgcattttgtctcagagatgcatggactgaaccattagaactgatgccttagtattcagtttgctgtttgctgataaaactccctgcaaaatttgtctgaattgaattcttgtgtatatgaagcatttcgtttgagactgatacacagtatgttgcattcttcagcatctgaagcatttcgtttcagacttcagagatgtatggacttactacttaagtgtgtcgtgagttgtttggttaaattaagacaattcagagatgtatgaacttactactttcttccgcatcatgtagccatctgcccatctagctacttgagcagtattccacgtactagttgttttgctcaactagtgcacatttttgtaaatgctagtgttgtgtttacgggctcctttggaatgcacgcgttctgtatggttttcgtatgaattactacagttaccatgaaaatcttgtaagatttattcatttcaaaaggggaataactattaaaaactcttttgtgcaactatcaacaaaatgattaagttcagatgccaatagaaaacgataatattccaggaaagaaagtaattaagttctgttatttttagagaagttggctaagacccccgctgcaaggcggtcctgtgttgtcgttttgttctccttctctctgttctcccctgttctctccctcgacagtttaatgccgatcttgtaaaattgtaacatctttctttcagtcttaataaatttaggtcggccgcctccttggccgtcccggcaaaaaaaagtttcttcgcacacactttatacagataactgaaaagttcatttgttttacagaaagaatagttggtaacttggtatctccctttctagagatcaaagacgagtgatatgggggtcactggtcacagtaattggctcttgtccagttgttgttgatggagccaaacaacatgtgtgaaataatagtaatactccagtaaatttgcaggtcaagtaacaggaaaaatggcgtgacatatttcctttgttactgtagtgatgtttcagtgttagctttatccatcaacgtaatattaaaaggaaattaatacgataaataattctcataactatgaaccacttggttgttattactagcatcaattactacagttcatcaatatgcccggagttctttctcttcgatttaaatcttaaataatggcgatatatcaccaacgatcaccgaagagaaaaaatacataatatgcagtaggaattttcatcatgagaaaaatacaaaacatatcaacctgaggagattcaacaaccatacagatactcttcccaagggtgggaaaaaagaaaagaaaatgggagcatatgtactgtacggtaacatggtcctcataaatgggccgaatccagtacaaatttctcggcctatagaccataaccggcccatcattatgctcagccagctcggcttgcaggagagtaaacgtagcggacacgaaagcgaggcaccgagcaacgcctccgctacaagaaatttcatttcggacccgatacagtattgtttcggtcgaaatttttatttttattttctattgtttttataaatttggtaatattttgattaaatttgatcaacatttgtttaaaattttggaaatttcggactttcaaattccgtgacctcctgaatcggtgaaactgaaaaattaaaccccgacccgaacccgtaatccggcggctatatattggcgccccccatcggcctccgacccgatcaatccggctcgtcccacctcacccacggcgagcgctaggtagtcagtgagagaagagagccaagttgatcagtgagcgcgagagcgagcgatggcggccgcggcggcggccgcggcggaggaggaggaggagaaggagagcggcagcagcaggatgatcaccctgaagagcaacgacgagaagctggtcgaggtgacggaggcgtcggcgaggcaatccagggccatcgcgaacttgatcgacgacggctgcgccgatgtcatcccgctccccaacgtcgactccaagaccctcgcgaaggtgatcccgtactgcgacgagcacggcagggcgaactccggcaccgacgaggagagggcggcgctggggaggtttgacgcggacttcgtcggcgagctggacaaggacaaggcgtccctcatcgacgtcatcatggccgccaactacctcaacatccaggggctcctcgacatcacctgccagcgcgtcgccgacacgatcgggagcgccaccgccgagaagatccgcgaggcgttcgacatcgaggacgacctcaccgaggcggagaagaaggagatccgcgaggagaacgcctgggccttcgacggcatcccgtaagccgtactgtgtcctcgtcgtcatgattgctgatctctcgtagaggcctagctgtgtgtgttgtgtctctggtagattcagatcaaatcagggagtttcgtgcattttgtccaagaagaacagagtcggctgtgtcgatgcatgctttgaactgttggatcgcttgcatgaagtgaatattttgccccaaaattgtttgttgtgtctgcttggctttcatgcagttagtcttcttgttaaatgtttgctctatctctagctgtctactcgttggcatctggttcgatggtgggattccaatccaggagattcggttgcagatatgcaacatttctcagtggtcagtgctcgatcgatcggggaatgcgtttcctgctcgtgagtttgcattgggtgcaagtttggtgttgcttgcttggattgtggttcggattgaattgagaatgggaaaaaaacatcgttgcgattttatctgaatgctgctttcgtttcaaagatgaatggactgatcggttcgaactgatccatgcatgtgcctgaattttcttctgcatctgaagcgtttcgtttcagatatgcatatggaatccctagtatgttctgtgttgcattcttctgcatctgaagcattttgtttcagaaatgaatttcaccatttggattgatcccctagtatgcatgttctgcgttgcatctgaagcatttggttcagaatggtttcagatatgcatttgggttgatcccccctatgttctgtgtttccggatccgaagcatttttcgtttcagtgatgcatgtacagatctagcagtatgttcttggtcgtttggttaattggcatggacgcatggtaggattccagtccaagagatttggttgcaggttttgcaacattttagtgctcgatgttttcctgttcatgaatttgtatcgggtgcaaatgtgaaagtttggggttgcaatttgcttggattctggtgtgatttgaatagagaagggaaaacattagtgcaaatttatttgaatgccgcattcgttgcaacttttcctagtatactgcctttggttgattaattgcccaactccctgtatgtgcctgaattcttctgcattcgaagcatttcgtttcagagatgtatgtcccaacatgttctgagttgtttggttaaattaaacccaattccctgcatgtgttctgctcatgctttcttccggattactcagatggtatcctgctttgttgtttgatttacaaaatttcttctgaactcttctgtttctgtagatgttctgaattcttctgtgctgattcaaatgagttagcaactagccaatacttggctcctgttgctttgagaaattatgactgttgattcacctgttgctttcttctgttttgtgtttctgttccctgttaattgctgcacaatcgttaaccggtttgaattggcactaattctgaatttggggacaggggatcacacggctacacaatcgcaaatctatttgaattggcactgtttctgacattggggacagcgtattgcacacttttagtcgacatgtacatttaaaatctcagcctatggcaaacttaagtcacttgggtgcctggaagtattcccaggcctgaaatatctgtttgaatttcataaagatgaaggatgtgtttagcttgcagaacataaaagtttacgattagcatctgcttctgttgtaattctaacaaaaagatcagatatgctttcctgcatcattcagaaatcagaataacaacagcctgcatgcttcatttttctactttattctgaatgaaccatcccaatattgtacaaactaatagcaatccaggaaacagtgagaaatggcaccacgggcacggctatagaagtcaacattagcagatctctccctaaaagagtcactgataaatcacagcgcaatgcgcatacaaatcacagcgtttcagaaactagatcatatgtggtaaaaatcttcagaggtaatagtaagaaagcagaggtgcagcaaccgtggctacaatgagcatcgccgagaccggagattgggccgccgccgacttcggtgaagatggcgtgccggtggccggtgttgatcctgacccagaaccggaagaagatggtgcgggtgctgcaacattgatgcagaattgtgagatggccagataccacatatccaagcaattataatttctaaaagatgaattggtgaatacatgtcagcagggcagaatatttcattgggttcagaactccaggatccaaattttttgtttgtaattagtagaagaagtcagaaaatgtttatcaacgcaaaatatcttcttatcagtcatgaggtcttcggagagctttcactttcagacctcacattgatttcagaagtcagaactttcagataactttagataatgaatcctcatcaatgtgcagtagatggtgagttggttaccccacagaaagtttgttcagttcttttttagtgtgcatgatggattacaaaatttggctgccaactatgccaggcaccacaacaaccacaacgccaggtagcaggtacaccacttgcatagagaacataataatgggaaaattctactaagatgatcagatctactagtagtactagtagcgagtagtgactaatgaggagaggaagtcatcaggaaggaccagccatctactctgctgatgatttagaatttaaagtttcttttgttttttatcttgttttacttttttcatttttaaataaaaatgaccattctctgggacaaatttcagttatagggagcaaaactgaggataattaggcaggaaatcctttatttgattcatttacatcaaaattgaaatcagatcgacaagaacaatcagacagggattcaggattttgctttacctccagtaggagaggcaccgggaaatttctctgccaagaaaaaaaaaagagatcaaattatatacatatacaaactataaatcgatctataaccaagtactactatataaagggaaatgcaaagttttactaaccatagtcacccaaaaagacacagaagaataaaacgaaaaaataattgaagaaacaaatcgataaattgatctataaccaagtactaaagggaaatgtaaagttttactaaccatagtcacccaaaaagacagagaagagtaaaacgaaaaataaacagagatgaagaaacaaatcgataaattgatctataaccaagtactacggagtactatataaagggaaatgtaaagttttactaaccatagtcacccaaaaagacagaagaataaaacgaagaaaaaattgaaaaaaaaaaacagagatgaagaaacaaatcggaggagtgagttggttgtactgactgttgcacttgctcagggcggaggagtcgccgccgcaggcggcggggagggcggcggcgcgggtgtagttgatcttgatgccgaagtcctggccgagcgcgccgcagaggcaggcgacggcggccgggctgcccagcgcgctcttcacgccggcgcagcagtccttggccggcctcgcctcggggctccccggcgtgatgtacgtcaggcaccccgccagcgccgtgatcgacgacccgcagtccgacgccggccccgccgccggcgccggcgccggcgactgcgacgccgcgccgcacgccagcgccagcacggccaccaccaccaccacaactacggcgcgcgacatagctgtgccggccgagcaatcaagaattcaagatggtagctagtggagtgcgtgcggcggggcgagattgcagtggtggtgggttcgcggcgaggactccggcgagattaattataggggagaaagagatagttatcgcggccgaatgtacagggaatcggttacgcgctggatggttgccgggaccatcaatgcggcacgtggcggcggctggggttagtatagtgcctgttcacttttatgctaaaaaaataccttactaaattttaatattgtcaaaattttggcatagttgtcaaaattttggtaattttggcatgattttattatataagttaccaaaatttagtagcaaactaaatatagccacttttttggtaactttatcaaaatttggtaaggttgaaaatatcatcagaatgaataggcccttattaataacacccatttgagtttgactcgttttgaattaattttgggataattagccgtgatatttggtttacgagaattgtttaggtgcattcaggtgtagatagatgccctcttttaaaaataaccgttcagaataaatcattacttccaagttggtcatgttaattctagatgggaatgataccatgtagtacttcctaaacatttatatttagctgggaggacagcagctgacagccaaactccggtgtccagtgtgctacgtgtaacgttgcatgcaagcatgtgtttttccagcggcgactgcacatgccgcagcatcaaatcgggccatgaattagcgtgcaataatttttttccctcgtagtatctaattttatactctcataatataataaggtatttttgactagcagatcactcatcttatttaaaaaattcgtgcaaacataaaaaacgaaaagttgtgtttaaagtactttgaataataaagtaagtcaaaaaaaataataattctaaatttttttaaataagacgagtggttaaacagtgcgagaaaaaactcaaaatcacttatattatggaacggagggagtagaaatagagtagtactagtagagcaggtgcaatagcagactattaaccagatataaacatattttaataaggtaaaagatgagagagaagagcagtaagctacagatctgtggccagctgcagcatgaatttatagacgcaatgtgtatatgacaggtgagaccatatattaatagtatagtaagtaactattgtataaattggctattagattggctatagattaattggagctagtagtgagctatactattaaacttgctattagggaagtgtgagaggatcaaattaggctgatgtgcttatcaactcgggggctgatagtctccggctgaattttgcgatactatgcttttgtacatggttatttctgctacggtgacattatgtgttcttagaattttgaactaaaacgaagcagcaaatggaactgtgccttacatgatgtttactagttttttttgcatacgtatcttatatagcatatccgcaacctgttacgccccaatcctaatttgggtgtggtgggggggggggggagttggaccgtaatcttcaaatcgtgctggtgctgcaaatattagttaacgccgtgtttagttccaaaatattccttaaaacttttaactttttcatcacatcaaaactttttcacacacataaacttccaactttttcatcacatcatttcaatttcatccaaacttttaattttagtgtgaactaaacacaccctaagagcaagtctaatagtacagcccactactagctccaattcatctataaccaatctaatagctaatttatacaatagttacttactatactattaatatatggtcccacctatcatacacactgtgtgtcttggagttcgtgctgcagtggctacagatctgtagctcgctgctcttctctcccatcgtttatctcattaaaatatgtttgcagctggctaataacctgctattatacctgctctaagtgccttcatataagagcaggtacaatagcaggctataagccagctgtaaatatattttaaggagataaatgatgagagagaagggcagcgggctacatatttgtagtcagctgtagcacggactccaagacgcatcgtgtgtatggcatgtgggaccaggtattaatagtatagtatgtaactatgtataaataagctattagattgactataaatgaatgaagctagtagttggctatatactattaaacttgctctaaaccatgttgcaaagctttaataagaaagtttctgggcatcggttcggagctttctccaaagtaaaatgcgcccgctagcgctgatcatgtcagtctgctcaatgccaaaaatctgaaatgggcttcttaagtcttaacatgtgcagataaagtacagctacaaaaggaaaactcgttcgtcacacgctacagcagcaaaggaaccaaattaaactttcgaaaattttccaaattttcgaatttggcaggagtcatttccaagattttttttccaaattttcgaattcggtgggagtctacccgcctcctgacacacaccacccaaataaataacagctggctttggaggaagtgggacgacgaagagaagtggattcttctcttctttttctacaagcacctcctatttgtctgcgtagctagcaccagcctcccaactctcctcgcccccctcctccggaacgtgctcctctaacgtagaggaatctacgttagagggacgtccaacattggcgaaaattcncctcgcngccgctatcattcaacatctgacggtagagagcgggtatagcatatgagaagcctggttggcccacaaacaggcacactttcagcccaactcgccgctcgttggccagcatgtccttcaccgccgggcggcggcacaatatcccacgacggcaccctccgcgtgaggttggcggttcacgcccgcgcagccgcactgtcttcctctccgccgaccgcgattctacaacttcgtcgccggcccagccacccgagcgctatgtcatccagaaggcgtaggcgaagctcgtcgactaccgtggctctggcatgagcatatcatggagatgagccatcgtgcgaaggactttgatgccgctattaataaggctggggctgatcttcactcgctcctcaccgtgcctgacacccacgaggtgctcttcatccagggcggcgccacctcacagttagccgccgtgtcgctcaacctatgcgcgtcaccctgccgaagtcttctccagctcatggagtgacaaggctttcaaggaatccaagaagttcaagcagattatggaatacatcaacatttgcagcatctacggaaacgtacacaaacagttggtgatacttctaataaatagggaaaaaatatccaaggctccaagccactagattagattaaaacagaaagcaaaaaaaaaaaaaccaagatataccagcccaagcaagaacaaagcaaaaccaccctcgacagtcgacaccatcggtaaatcagcaactaggaaattcgcaagcaaaccaagatggggatccggcaccaggaagcctagctaccgttggatgctgaatgaacggagatgcgacgtgggatgtccctctaacgtagaggaagaggagctcgttccctactccagtcctgcaccaccaccgagatggctcgcctcagtaaggcctggtttagttccattttttttcaaacttccaatttttcaatcacatcaaaactttcctatatatataaactttcaacttttccgtcacatcattccaatttcaaccaaactttcaattctgacgtgaactaaacacaccctgtgtgttggaagtttgatttcacgcaaaaattaaaagtttgattgcaattagaacgatgtgatggaaaagttaaaagtttgtgtgtgtaggaaagttttaatgtgatggaaaaattgaaagtttgaagaaaaaatctagaactaaactcggactaagattccttggtctgtgtggcgtataggggtggatagcgagccggctcggctcggataacgagccggctaacgagcagctcgactcgactcgtttgaaagctcgagccagctcgttaggctcgcgagccagaactagtatgctacagagaagtagagaacgcagcagcaacatgaaatggctccaaaattatctgagaaattatcaaaagatataagaaaaagtctacaatctcccatcaagaaactctaacacaacaacaccgaaatctttcaccacgaaaagcaaaatcagaaaagcctcctactgtgacagagaagtagagagcagaaagcatcctttcgtttcttcatgctccatcatccatggtcatgactgacaaggatgcatggccgatggcaacacaggatggagacagggagcagcgctggtgcggcagctcggagtggccgacggcgactcgatctggattggagtttggagatagatgagaggaaggggaagcgatactattctgttcggtagacgcatgcacgggtgactaatgtacttgggctgtcatggggctttgtttatgggccataggtgtcctactgatttatcttatctctatgtgtaagctcgttaagctcgcgagcgagctggctcgttatgcctaacgagctgaaactgtagctcggctcgtttcaaaaccgtaatgagccgagttgagtcaagtcgagccgagctcgtcatgagccaagcgagctaacaagtcacaagcttttcgtccagccctagtggcgtcgtgtttctcttatccattgctacgcgtactggtactggtgttgtgtacttgtgtggcggtgttgttttctttttctccgttgtgtgtggagacgatttgatccgatcttgggtgagtttctcccgtgttctcgcgggcgtgaaagaactgatgtttctactgtgtgtgttgggttttaccatgtggtgtagtgtggtgcgcgtgaacgatctgatgttgttgagcctgcgcaagtttgctcccttctgtgtgtctggtctgaagaatctgggtgttttctcgatcgctgattttagttcgctctccgatgctgctcgctaggaactgatcgattttagccggcttttctttacgtcgttgttttctgcttcttttcaccgttactgttgttttctactcccatctctctatactatatctatacggcatgaaggatttctcattcgctcatctttttttttttctaaaccaaaatcactaggttgtaagaacgaggcccgtttgctgggtagagtggacagcgtgttttctccctcgtttgtgagcgccacctttctctacggcattgtggtcggactcagtctgaatggacgtggacttatttcccttgtccatccgatcgaggccggagtcagttgcacaccggagagagcgttcggcatcggtactgggccagataggtggaagacgacccatccagttggcctcgcgagcattgctttgagtttttgggtgttgcgggatgttacctcatgattgtgtcgcatctgtccatgaggcgtctccctgatctatactcactcacccgagtagcatcttggctgatgccacttgtcttcctcgtttcgatcgagtcgtattttctgaggtcgctacattcttccaggtactcccaaggaggctatctatatgtttttatttcttcaatgttcatccaaatctcgaaatgttgatagatatggtgttcagagcattgagtgggtcatcttcaccgtcatgacgaccgtcgtgctcatcggtacacttgtcatcattctcgtgagtctctgttatatttcttttactcagtattcatatccgtgaattcgtattgatccgattgatttttttttcctctcagcttcctgttacacagaagggaatgatggaggaggtgcccctgccccccagtatgaagagatcagaggatatgatacgagaaagcctgcaccttctatttccatttgtacaaatgaagagatcagaggatgatacgagaacgcctgcatcttctatttgatcttgtacaaattttaacggattatgttaattccctacttaggatgctggatgtgaccgtggttaggagttgagatgggaggatttggcgccacaattggtccatcaccatgcggtccactgacatcctcaccatatgccgcgaagccttttgtagttcacttgacgttgtttcattcttttgggttttcccattttttattaatttcagttgatgttgtttcattcttttggcttttgggttttcccattttttattaatttgctacgtaattattttggggctccaaggattcttttcttctttccaaatatgattgtaccaaaattcggtagctgcttgtgcgattgtgtaccaccttactctgctaatgatttatacaaagtttctcgcgtggtccatcttgttactttcgttaaagaaggccattgccagaggcaaattcacttgttggctgtcacctaaacgtgttgcctgttagctgcatcctgtggctttcttctggcttagatgtgccatgtgaattgctacacaaccgttagtcagtttgaattggcattgtttctgaatatgggaaaatgagacattttgaggggcagactgaagacaattaggcacgattcgtttatttacccatcaacacaactaatgttgcctactattgatttatttcagctcatagtagctttgtgtgagattcagtctagtgctgtaccaacagcatcaagctggtgggattcccaggcctaagcctaaattatatgtttgaatttcatataaaggtacagaaaatgctcaatttgcagaaccgaaagttccactcatatcatttatttactcgtattataatccgcttctgttgtaattgtggccaaagctcaaatatgcctttctgcatcattcagaacaatagtctgcatgcctgcattttttactttattctgaagggggcataccaatattgtacaaactataaatctgatagaatccaggcaatagtgagaaatggcatcatggacagagctaaaatcaacaataaatcaatagcagaaaggtctctccccaaatgagtagccaataaatcacagcgaaacgcgtatacaaatcacagtatttcaaagtgaaaaggcaacgacaatgcaatcgagacctgcataagaatatgcacctgctcaatttccccaatcccatcgaaattccaattcaaacaactcaaggcacacaagaacactgcaccaaaaaaggcccagctaagggataagcattaaattatcaaaaattaaagggacacaacaatgttttgaagaaacgaggaggcaaaagacgcttattgcttaagcagttttcacttttatttttgtcacggcatattcataaagtaatgtctgtggaccaaaattttcagaactgttcaaaaaattctagacctatactctatccatggcatcagaagtcttacattgaaatgaactaatcatatttcaatacccaacaaaaccagttaaacagacaatacatctctagttttcttcagatgaacaagtgaaatgtactatctaaaacattaattcacatggcagctatatgagcagatttaagctttgccttccacaatatgattacaagatagtactccaaataactgaagctagcatcctggtgcacaagaacaaagacagaggaggcttttcattctggtgacattccaaagcaacaaataactgaagctaaccatatgcgaatcactcgatacagtagagccaactacaattgtatctctgtaagcccccccagacaagtcaattcagctaatcagatataccatccagtgatcccagaccactaaaatagacattattgcgtgattcaacaagataaatcagtaactaggcaagctacaacaatgcaatcaagacctgcatcttcttatacacctgatcaattgccccaattgcatcgaatttcaatccaaacaaaccaaggcacccacaagcgtagcatcttcgatctaaggataacagtaggaaccaaaaataaaaagggcgaacccgttcttccgctcgggatcactcgagcgcgacggcggcgccggcggccttgagcttggcggcgagcgcctcggcctcctccttgggaagcccggatcgcaccacgaccggcgcttctccacgagctccttcgcctccttcagccccaggtccgtcaccgcgcgcacctccttgatgatctttatcttcgccgccgcctcgtacttctcgatcttgacatcgaacgacgtcttcaccgccgcggcctcctccgcgccggcggagccggaggcggcgtctccggccgcgccagtggccgcggcccccgatgcggcgctcgacgtgagcgagaggcggagcttgagccgcaggagcgccgagtagtcgtcgagctcggcaggggagagttccaggagctggtccgctatgcgcgacagcttcgggtcctccccggcggccgtcgccgtcgccgccgccgccgcggtggagaggcggcggagccgggggatcagcggcgcgaatttggaagcgaagagtggcatttcggtaaatcccgggaattacgtggtgaggggttagggtttttttggcccattcgacacgacccttatacgagaacacaaacacgtagccccaaccattccgccttccgatcacgaaagcgtattcgttctggcccgtttaggacgagcctcgtaggctcgaaggcgggtttcagtttttctctgcggctaccggaggcgtattttccgcataccgtggcccacctgtcattgagagtagtggctgttccgctccgagacaaggactcgccatacgactccacaacacactgcctcctgagtcctgactccccccgagcgccagtctctctctctctctctctctctctctctctcctctcgcacgcctcggcggagcggagcggagagcaacaaaagcgcaaaaaccctcgtagagatcgaaaccgccgcggcggggtgggatcgcgtgttccgatcgtgcggaggcctcccgctcttatcgagaggctttcgatccgcttgcgattttttttctgggatttttttggtgcatttttttcggtttttttgttttccatttcaggtggcgcgtgggggatcggtggattcctggagttgctggtcggtggaaatcgtttctcttcgtgtgcgcgtttgcgtttgttctggggtttttgttttgggtggtgggttttgatccggttgctgcgggcttgtaggttggattttgcggtttgggagaaaggtggtgattcgctccgtacactgttgagatttctctgtgactctgcgttggtgttgttgctaggtgagctgcgagcttccgtccgtttgcgatgtgccgatgtttagggttttacttgagggtccatttgatattccttattatgttttagagcacaatctagggttctagactggcatcattacgctgcatgtaaatgtattatcaagttgggggttagggatttaggtggggatcacttgtgattggggttgaaacctgaaagtaatcggagacgtctgcaatgcgttatgtgtatatgtgtttcgggtatgctgctaaagtgaagtctctaactgcctcatgttgttttgcatgttccttgtgtgcggaaatgtcgtatgtaatgttttcatgcttaatataggaattgttctcagctgtttctcccttgtacttagcatacagctcgtatcaaatgtaaaattctgttttgacatggagcatatcagtataggaatttttcaccagaatctgggagttggatcttttgaagaacaaattttgtctgcatataaactgctacttcatcagaattcctaatgcaagaatgcatatacatggcatgacttaactatatacatacttgtgcagtttcaactgaagattacagttattcagtctgttcttgtttcattataactgtaatttccagttctacatgttagaaggctgcacattgttcctatttaattgtatagccactttgattgtgataagtgtgaatttttggcagtcacaatgtcaacgtgtcctgtgctgaatgaccgaccaattgatgagtggaaggttactgaattgaaggatgagctccgtaggagggatctatctattaaaggtttgaaggatgatcttgtgaagaggcttgctgaggcccttcagggggaggttattgatggcggggaagaaacagtcaatggaactccccctgtggagaatcagacacaagacggagctcttgttttagatgatgcatctggtttccaggcttcagcagaacaaaatgttgatgaaggccctgctgaggttgctgcaaagaatgaaggccttgtctctgttatagaagctagtacagagggcggaactcttgttttagatgatg

SEQ ID NO: 66741 - DNA, 1150 bp, Oryza sativa
  unsure (1)..(1150): unsure at all n locations
tttcaatttcaaccattgcnccttcttcctccaaatttacgctcttcggcaagaatataatcaatgcctctctcaagcaatttgntatgtcagccggttaaaacacaaaatttgttgtcaataattcactcttattatgaaancaaagntatattttgagtgagtgaatatcatacgagcaaggtatttgaaatctgagaaatcgtgacatgaggtctaaaccccagcatcttggctctgaactcctcgttcgtcaggtcgccgaacttgttgtcagccagcttgtagccattgctcatgaagttgaacgtctcaacgagctcgacgttcctcctgtacacctcgaacctcctctgcttctcaccggcgtcggtgtaggcgcggccatgcctgatcatccactgctcgaacctgtccagcatgagatcggcgcgggcgagagccgcgccgatggagaagatgagcagaggaagaaggaggagcaaggatggtttagccattgttggagcttggattggagagggagggtcagcaatggtgaacactgagtggtatgaggcgcagcaatgattgcaagaacatatggtttatataatttgtaggagggagtatcagtgataaatcctatggcctgttcatcatgcagagagtgtgcttggagatgatctgttgtgcaagcatataacattgcatatgcatgtgaattgtgctggaaagagcaatggttgcacaagttttccaaagtctcagcaaattggttaacctccagcacaccgatttatcattttactagaggactgaattctgtatagaaactagcacacattgtattcaagtaaaagttttgtaccaataccccacatctgacttgatataggtaagagttcatataataagttccatcataagccgaaaatggagaagtcgggtaattctgaatgtttagaatttacaagagaatatatttttcgatcagacaacagtttggtgtttctgaagttgctaagacactaaaagatatacaaatcatccattggaatggaagtaccatccttcggtccagttttgcatttcagaaagtatagctgctacatctaaaaggcaatgtgcagtgcacaacaagagcagcaactgctcgtcagtggccaag

SEQ ID NO: 66742 - DNA, 628 bp, Oryza sativa
ttctcccaccgaccactgttccgcgactcggcggctccacctaggccccacttgtcattgttgccattccccgggtcccggacgcctgtggctgccacaggcgatctggaagcctgcagccgcacctccatgtttttgtgcatgaacccatcgttacccccgagcacctctgctgctctacgtgtcacagccaattattataactaggggattccctgcgatttactgcggaaattactaagtaattttttaatgctattttttttataattcagctaggagtaaaaagaaaaaaataatcaaatcttagggcttatcaatatttatcaaattcacactttaatgtaaaacatattgatatgtacatattaaatattaaaaaaatgatagagagatttgtaaaactattgtggaaataatgtgagaagtgatgattgaatatgcttgcatgttaatctaatttggggcatttgcaaatttgccaatcggttttttcaatattgcaaggatgccactcgaatgacagttctagtggcatttttgcaattttctagtggcaattttacaatagtgtttaaaagagtggtaaaatttgcaattgggccccttaaaacatctttttcaaaca

SEQ ID NO: 66743 - DNA, 1728 bp, Oryza sativa
ggcacagcggtttggatgagggaggctgaaggtagaggaagggtctgacaagcgggtcccacggccccacttgtcggcctgaggggaggaagaaggcgcgcaggaacgcaaagcagacttgggaagggaaggcgcgctgggccggcggcccgaggagagaaggaaggagggggaggaatttgggccgagcccgaaagggaggaaggggaagaaaggagaattaaatttgttttctttttatttaattggttaaatgatctttgtgactttaaaactatttctcgagctccgaaaattcacggaaaattccggagagtattttagggcacaaagaatattgcaaaatattcccggccaatgatttttaagggaaaattttaattctcccattatttcacttggataaattgatttaacttttatttaatttctagaaaatgcattatttaatgatttttaatcccgaacgaaaatcggggcgttacagggggcgtcgggcccgagggtgatgtgttcgccctcctctttgtctccccgagggggttgggccgcttccgcctcggccccgagggctggggcgccccgaccccttgtggattttgcgccgcgtgtatgggttaggtacggcgctcacctaaccgcatttattgcggtttggacgagcgcgttacgccgcatgtaacgcagtgcagcgcgctcgtttatccggtctgtgaccagtcacagaccggtcagatcatgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccggtctgaccggtctgacaatggtcatgtcatcagcagacagccatgtttccacgtcgcgcctgcttccggcggaagtggaggtaggtatgggccgtcccgtcagaaggtcattcggacgacggcgatgcaaatctccgtccgttaatgaagagaagtcaaattggagggaagagaggatgagtccccacacaaaagaaagagagggagagatggtgcatgtgggatccccttgagatataaaaggaggaccttgcccactgagagaaaaaagaagaaaaaggatccgagcttaatcgggggctggctggcattttgtagcttcttcatacacagatccaccaaaacacaggagtagggtattacgcttctcagcggcccgaacctgtatacatcgcccgtgtcttgtgtgtttccacgatcgcgaacttttcacatacagactaggagcttagaatctcacccagggcccccggccgaactggcaaaggggggcctgcgcggtctcccggtgaggagcctcacgctccgtcaacagttatagagcacctcaaagaggaggaaggacaaaggagggaagatgttgctgggcaaggttgcaggcaccgaagaccgcattcgtcgaggccacagcccgccgccggcaccacagagctgaccacgagccgctgatcggtgcaccgcagccgggaccagctacggtgcacaagctgtcgaggccaaagcctccaccgccggccgtaagggggtgggtgggtgg

SEQ ID NO: 66744 - DNA, 9382 bp, Oryza sativa
  unsure (1)..(9382): unsure at all n locations
aggatgaattgganattcccaactangatacccccctcgagcgagcttttgcacctgcggccccatcgnggacttggaccggccagcgcgggaggcggtgagggacaccgtcgcctatgtgctccgcccgctggtggacaacttcaaccgtctattgtcgctcaagaccgcctttgatattaaggattacaatatcggcatgcccaccggtaagtacctagagtacgtactataagggggtgaaaacaatcagaagcatttcttgggaaacgtcgacgctcgatcgacgggtaattgactatatttatcgttaaaattactcagtgtcagacattaatctgtgactacatactatacttattgatgaacacatgtacaatttgcgtggttaatttgattactgaaagtctgaaattaggtgcactcatcgcgtgtgttggatgctatcaactcctgaaaatgaatcccttcgtgttcgtcgatgctgtgctggggtacgcgttctacaagctcagcgtcttgtcgtcgcaggtccggaagcaggaattccccaacgagtacatcacccggatcaaaccagtcagttcgtcatctcatatatatatagagaatttaccttgcgtatatacatgcatggacctgaataataataattgaagtgatccacgagagtaatgatttttttttgcagttattgccttaatttttatcgccaaggatttccataagaacttcgtgcccttggattacatcaagtaagaaccctttgcttgctaattccttgaatgatattatgctcacttcatccaaatttacgagtagctagcgctcatatatatattccaagctaggctcaaactttgcacgttttaaaactaaactgttcagattcagataacctacaggcatatgaggattctaccaatatacagttgtataatatagtttgagtctgtttaaatgtacaggcgtacagctataaaaagcgattttctttttaaaaactagagataatttactagtataagatagatttacattcaaaaggacaaggattttctacacctaggtgccacggcacctatcatttacatgcgactcaaatagttatagaaaaaattgaaaaaaattagtaacatcatttgtgatgatacaagtctatatacaaacatgcatgactaaatttaatctacaactagagaaacaaaaataataaaatcagacagtcaatagtacccgtatagtgtagataaaatttgttatttttatttcttcatatatcgatcgaatttagacttgcatgtttgcatagtgtcttatattatcatggactatcttattaaattttattctgacattcaaaattcaattaaacgaccatgtaaaactaaaatatgccttacaaaatgtagggagtgagtatatgttactaacaagttacttctgccgtggtaattgtgttacacagggtgccagtttttttcttctacctcctaacattactcgtcgaagtgcatggcctaaagaaagacgcaagatatcttttgtctagattgtttgagctgcttcaaatcaaggagggcagacgcgagctactagtcgacatcctcttaaccagatgaataattcttgttgcatgattcaatcaagaaacggttaatcgatttgtctggcttaaagcagatctcgtagtcatatatataattattcttgattaacttgttagaggtatgtgtttgagtgccatccgaagggtttctttatgcataataagttcaccaagcttaattttattgaaagctaattagtagcgttttttagtcaattatgtttaaagtactataacagttttcttctcgaatactcgtatatactcattgatgtagcgaaaattgttaaagtataaaaagctgtaatacttaaaaattaacatacaaaaaaaatctacaaatatgatttctatgcaatgaatctagaattttaaaatgatactaatgttgaaagtttttaaaggttcattcttttctaaaactatatatttgtagagaaaataatttctatgctactcacactactacagcaaatatttttctggacgccggaccgttaatttacaggcgggcccgaagtgaaaccgcacagaaaaataggtggaccggaactggaccgtcgccctcacaggaaaatcaattttcgtgtgcgggtcacttaacaggcccgcacgcaaaaataagccgattttcgcgtgcgggcctcctaatctacccacacaggaaaatacttgttccctctcatcctattccaaacattttaaatttccttctctctcccccggcccccttatctcctctctctctctctccccattatcttctcctcactttcgtctcctcttctcactttcctctctctcaccttctccttctgtggcgccgcgcgcctccttcacctcctcctccggtgccgcctccttctccttctcctcccgtggcgggcttggcggcggcgggctctcggcggcgggctcggcgaccgggagcggcgtgcgcgcggcggtgggcgaccgccccccgcccggatacggcggcgggcggacagtagggcggctacggatccggctacggtgtcggcgacgacgacgacggcgaccgcgatggtgacggcggggaggacagtggcggcagctttaggattagggttttgtttttttggattttctttttttttggttttccatttttgcatgcgggcgacataatcatcccgcatggaaaaatagcgatttttgcagacgcttttttacagatggttgaaagatccacacgtgaaaatcgttgcacgcaaaaatccattatgtagtagtgtcaaattatctagttcccttatatatataccactggaaattggcaatttctctatgggattatctattaaacatttgatagaaaaccccttaatcttagtccaatggctaggactacatcaagattcgtgctagtaaccttagccttcctcttcccattcttcctccctgcctcttggcctcgccagcgttggaaggtgccaacagcgctagcgaggtcccgttggccgttctcccctttccctacatctccttctccccaagcatggcaacggcgagatgcccccacctcatgacatattcggatctagcagcctaccattggccttgcccttctccaaccctgcaacttcaactataccagcaataccttacgttcacctgtatccgctacccaccatctggcctctctttccgttccccaacccatcctcctaccccttatcccaactccaaaggcaaatatgtaggtttattccgggagttaggcgaggagttcatcgaagctagaggagaaagagcccccaaaaattcacgtacacacaaatcttgatgtaatccatgtaatccaatggttcgagattcacaagaagtttcccctctttttttctgagtgaagattatcaattgtgttccgttatatatatgccattggaccataatttttcttcactcgaggacatccccgtcaatctatcattagtatgttgttaaactaaccgtagagagaaagacagaaatgcacatgccccttgcttccccacttttctcattgtcctctgactattcgagcggcgagagctgctttctcccaccgaccactgttccgcgactcggcggctccacctaggccccacttgtcattgttgccattccccgggtccctcacgcctgtggctgccacagccgatctggaggcctgcagccgcacctccatgtctttgtgcatgaacccatcgttacccccgagcacctctgctgctctacgtgtcacagccaattattataactaggggattccctgcgatttactgcggaaattactaagtaattttttaatgctattttttttataattcagctaggagtaaaaagaaaaaaataatcaaatcttagggcttatcaatatttatcaaattcacactttaatgtaaaacatattgatatgtacatattaaatattaaaaaaatgatagagagatttgtaaaactattgtggaaataatgtgagaagtgatgattgaatatgcttgcatgttaatctaatttggggcatttgcaaatttgccatcggttttttcaatattgcaaggatgccactcgaatgacagttctagtggcatttttgcaattttctagtggcaattttacaatagtgattcaaagtagtggtaaatttgcaattgtccctaatttaattgtagaattaaatagattgtagatgctcttgcatgcttgcatgagattgaatatgtaattattgttagtgggtgatgatgtggcatggttgcatgttaaactttagagttagtgggttataactttatagaaagtatagattccgagtcgagattttggtaattttggaaaccccccccccacacatgttcgcgcttggaatttttagatttttctcttttttaatgaatttggttaaagtttatttaaattcagtcaaaatttatttaaatattcaaataatttcagtctagaaatgctgaaaatcctgaaatttcgtaaattttgatcgaaatcgaaagtgcaaactctggtcgtagcatgctgggaggacgaagctcatctaagtgacatcatgccgtgagacaacgaggagaagccgccgcatcgcattcagaggccgtggactcccgtcgacaattttatcgtcgccatcgcattgggaaatcggaacaaggtttttggtgccctaattgtcgcatgacaagttgcctgggtgagaatcttaacagagaaacagccgagtttagcaagtctgtcaaatatgctacagcctctgcacgataacaaatacaggcacacaccaagttcaatttttagaaaattagaataaatccagcctctacattcaaccggatatacataggcaaacatacaagttgtatgatttctgaattctatgggagctggaagagaggtagtaatccaaaggcaatgttcagcacatcaatcatcagaagagcgagaaatgccaagacatattcgagctgtaacaccaaaagaaaacaagaaatgccaagagcccaagagatgaagagattgttcagtaataaaggccagtttaattagaaggccaggcttcgctgcaaacctaaaattctctcaacagcagtacaatatatcatctaactcaggaaccatgaagtggaataaggccaagatactacatattgagctctgtcaaacaccctcttccacgtgtaaacatgatctaggaccaaatattgcttacacactaaattcagcagtgtagatcattagcgtcgtaatgtagtaagtaccactaatagcaaccacaaaaaaacagaacaatttgtgaatgcacattatatcgcaatttcagtacaacgtaaataagctagaactgaagtgcaaatttatctcgacacatgcatacataaactaagtgaacagtaagtcaccagcagaatttcttcaacgattaaggaatcttgcttccgcttacaccagcaataattttaacatgacagcaccaatgaactcagcaagaagaaacaaacaaacataatatgtgttgatcaacgcatggagagagtactagcatgatcgtgaccactggcaacagcagttaaaagaaaaagagatttggagggagagatgtctctccaatcatttttaaagaagaaattgtgaacgttttgaggattgaacacgtacgggacctcaagtttgaaatcacacatcctttgtcactgcactatatatttcaacatgcatttaagtgtaccggttaaaattgcagatggctactttcgtgggcttgggccaaacgttgatggttcagtccctcatgcgtgtatcaatttcttttcctcctttacagcatgtatgaatctcaaagtgcatctaacggtcaaaaatgcaaggtacaatttttctccattttctatcgaccgtaataccataaagagaaaatttttgagaaaaccatcgtaacgatatgtgagttgcaaaaaatactattgtacgtaaggacagggtttgaaatttcggttcgaaatttccgaaatttcgccccccccccacccaccggcatgctcaaatctcgcccgaaatttttggttttttgcatttttttttgtgaatttggtaaaattttattcaaattcagtcaaattttcaaataatttcggcttgaaatttcggaaaccctgggtataaaatctaatttcgaaattgaaaaccctgcgtaaggatcgatgacatgtgaaatctggacttacatgaaaatgacacatatgcactggtatttttcaacttcagagatctttgtgatggtaccaagaaaatcagcccgcaccgcacttcagcgaaaccgtgtcatgtataagcacgccacctaagcaaaactgccaatcggttaattgatctatcgtttgctcatgacaaaagggacaaacagagacacgagatataaaaagctcactaggaatatgcccatgcataaacacatatagtactcctaataagcaacaacttgaacggacaacaactttggtaaaaatgacagcaagacgcgctgttggattccatgtcatatgcatgcaacgaactcaagaacggatttcctagtaccatctaggaagcaacttatatcgtccactgacgtacgtgttgctgatccacaagaaactagctttttcgtccacgcatgcatatgcactagctatagagccaaattaactaccaatgtggcagtctactgtaccatcactacacttatatcacacatgaacaagcatgctgcaggtaccgtaggtaccggtatctcgaggtattttttgttggaccggagcaaatctcgctgcagatagatcgatcatcgatcgagccaagattgctttgcttgcttcttcgtcagacaagcgtgcaatccatggcggctgcggcgccgttcttgtccaccgatgatttcccattgccgcagccgcagccgcagtcgccgccgcgatgtgatttgacgttgacgacgtcgaggttgtagaggatggggatcatgacgagggaggagaggaaggcgaggagcgggccgaagatccagaggaggagcgggacgccggcgaagaagatgcggttgccgacgaagttgagcgtgaaccccttctccagcgcctcctccatgtagtccctcgtcgacggaaggccgaggaggcggcggccgccgtcgtcaccggcgccatcgccgccggcgaggagggtgggggaggtgttgatgaggaagctggcctcgttgaggaagcagatggcgagggagtgggagaggaaggcgacgaggaagaggagcagcagcgccacgtacttgagcgccatcatgtactcgccgtgggcgccgaagacggcgtcgctgagcggcttcttgatggtgtacgtgctgctcagcaccgccgcgatccccgtgcagaagaggatcgccgtcgtcgccaccagcgtcgaccccatgatcacgttccgcagcgactgcaccaccagcaccgccttcttctcgttgtcctgcgcatattcgtccatccatccatgcaccaagaattaatcaagatgtgtacagccatctctctgtacttactccggtgatcgatcaccggcggcgaaacgtacgtaccttggtcatgctgatggcccagaggcggcgggtggcggagttaatgccggcggcggtgcggagcggggtgaggcggacggcgcgccacagccagacgtggtacgccatggggacgaggaggctgagagggatcaagatcaggtccaagaagctgtccctccactccatggcggatcggatcggacacacgattgacgatactatcgatcaaatcgaagatcgatcactcttttcttagatcacgtactaattactattgctagctactatatgtgcagaacaaatatatgcttcgatagtatatagtacgtgataatattgtcaagtttgtgatgatatattgtgcctgcttaggattgagaattgttagctttccgatcttggagatgtctgtgtgcggcgtggagttgatatataggggagaaggggatactatacatgcaaaaaggggaaactgttttaaacactcgggtggacgtccacccgtttctttcatgtcatctaaatggttataaaaaaattaaaaaaattgacatgataggttaatatgtaatatattacttcacaaacatacaagtccaaattcgacttctataaattgtaacaaaaacaattaatttaactgtgaatatacgtataccagttagagtttgatttgttattttcgttacaacttgtagaagtcgaatttgaacttgcatgtttgtgaagtgatatattacatattaacctatcttgtgatttttttaaaaaaaatttcataatcatttaggtggcatgcaataaacgggtgtacgtccacccaagatattagaattcatcctcgtgtaaaaaggtgcaagagatcacaccatagtggcatcttacacaaaacccacaatcttcaatcaatcaaaagaggtatgtaaacctctaaagtcgggaaattaaattgctagagtaatctcgacaaggaaaagcaaggcagattgcaatagaatagaatgtgatatccagcagcatcgacaacgtgtagtattaattcgccgcatcccattcagctacacgcccttatattcccctgaatatcttagcttttccacttaactgcatccaccgatttcttattatgcatatgcgaataaatgaagaccggccggtaagtactgctaaatgcttcctcagtttcagggttagacatacgtataaatgtgagcaaaactagaaagtcttataatatgaagcggaggtattactagtgtactactccatccttctcaaaatataagagattttaattggatgtgacacaaactagtactccctccatcctaaattagatgttatttttaactttttttacaacgtttgtccattcatcttatttataaaattagtgtaaatataaaaaaaatcatactcaaagtacttttgataataaaataagtcacaaacaaaaatgaataataatttcataatctttcaaatatgataaatggtcaaatgttaaaaaaaactaaaaacgataagtattttgggtatcaagacagagagtttgtccagattcatacacagaaatatgtgtccaaattcgtagtactgttacattcatccaaaaatcccggacggagagggagtagtagtagctgatgtagatagttggctagctgcggttagagtaa

SEQ ID NO: 66745 - DNA, 12162 bp, Oryza sativa
  unsure (1)..(12162): unsure at all n locations
gcacggaactctggtagcacactctggtgccggcgaggggagagagaggagcagaaagtgccggtgggggcgctaggttttcccccgagtcgcccgctccccgagtcgcccgcgcgcgggcgacgtgggggccaacagtttcttcatttgtaacagtattgatagaccagagtctgtcgcgcgggcgacgcgggggccagcagtttcttcatttgtaacggtattgatagactagagtctgtaaccgtgcatgtatagtcagcttccttgcgcaagtggatcaggaaggatgacgactccgtttttacatcactaaagaaattcgcagggaatttttctaaaaaaaatggtgaggaagatacgagaacagaataatctgagaacccaagcaatggccttgcggcttgtttggttattaccctgataagaatttgcctgacctaaaactagcctgacttatcttagtccttgtttggttgccacactgagagctcttctcctcggccttggcctgacggacccgggcaagtgattagcctgagctctacgcacacgcgcgcaacataaattaatgataacccattggagcgagtgttaggaaacgatcggcagataaacgataaaaaacaatagaacgattggcagataaatgataaagaacgatagatcaatcacgaagacacgagatttaacgtggaaaactctcctaaaacaggagagaaaaaaaccacggttgccagtcagcaaagatctttactatattatgtgagattacaatactgaacagcggcttacaggaagtatatatataggtgaaaccctaaaaggataacgttctgtatcgcttcgctccggcccaagcctctagcgacgggcctccgcttcgctccatccgaagttggtgtttatatgtgtgtaaatgaatttgtatcacaactcaccagcgaggacccctgtgcgcagcatgaggcccatagcaccactacaccttcgccgccattgtcgtcatggcgagaaaagcccagacctccgctgtcgtacgtcgccgcgtgaagcccagacgtcccatctgccgctgtcgtcgtttcctgaagctccactgcagtgtcgtcgtcgcgctagatttggccatcgctatcgcaccgaagccaccgactgctgcttgctagattcggcgttgtgcgcgcgaagacgccccggacgcttagctaggatgttgattcgctgagttccggtcacgcggcctgcctttccgcacgaagcacgcaacaggtcagcaggtattgtcttcgatggaatcagataactttgtacagtctgcagttgtgccactgatatgtgggccccactttagtatggcccacatgtcagtggcataactgcaaactgcacaatattagaggagtctcatccatcttcgatgctgggtgttcccaacccttctccctcatattctgcgtgcacacttttaaactgctaaacggtgtgttttttttgcaaaaagtttatatacgaaagttgcttaaaaaaatcatattgatccattttcgaaaaaaaatacttcctccgtttcacaatataagtcattctagcatttcccacattcatattggtgttaatgaatctgaatagatatatatgtctagattcattaacatcaatataaatatggaaaatgctagaatgacttacattatgaaacggagggagtacctaatacttaattaatcacacgctaatagaccgctctgtttttcgtgcgcaggagatttgttctcaactgcccacaacgaacacagcctttgacatgaagttggagtttaatttgatgcattctcctaattgtttcccctctttagatatgtgatagatttgtcatttgcacatggaaagctaggtagcagatagatttttggtgggccatgcattcttgccaatcccacattgataattgatggtggggaagcacaacttaaaagatagtctcatccattagacaagtcttttgggttgtatagtcttaagacctaaaattgtggcctcagtcgagcctgtggcggagcgagcccaatgtgattcgggtgacccacagtaagtgagccaggttgcgcactctaacaaatattttgcatcttattccgattatcacttgacttagggcctatttagatcctccaaaatggcaaaagttttatcattttggagcactttttaccattttagatctaaacactagtagcaaaagttggcaatttggcatttgtcatttgctagtctagggtagcaaattttgccaaaaatgctctgggaccatgcgcgtgctctctctctctctctctggtactaaaatggtaaaactttaggatgcatctaaacaccaactacatgccaaatcttttcccaccaaaacttttaccatttaccatttgctattccaaatgaatcaaaacggacccttagcaaaaattatgtaccgcctaatcatacttctcaggcggcagctgcaaatcgaacaatcaaatatcccgcctgcctgaccaggcaaaaaagtagggggctgtttggttgctgccctcgcctggagaccattgctcaggcaggtcgatccgaccgcaggcgaccgaaatcggacgcctgagatcgacgcctgagccaggcgcgaatctgagggcagcaagcaaacgcgccctagaactcatctgtcaggcatgaaaaaaaatctcaggtatgctgttcaggataccatggtcaggcggcagctgcaaatcgaacaatcaaatatcccggctgcgcaaaaaataagggggtatttgggagagaggggctaaactctcaaaaacataagtccctcccataggaacttatatttttgtgagagagactaaattgtttagccccactttagtcccttcaaccaaacaccaactaaagctcatctgtcaggcatgaagaaaagtgtcaggcatggtgttcactgttcaagtgttcagggtaccatgatcacacaaaaaatagaactcatcggagaactgtcaagcatgaaaataaataccaggcatggtattcaggataccaaccaaacagacccttgatgccagcatgatcgaagcatggaactggcctgttgggcttgctgaaatgggccgagatcaaggcccattaaaacgccacgtggtcacgtggagcgctgctctccctccttggcgggcacgccaagcttagcacgcaccgtaaagtccaaatttgaccagtcaacaagtcaaagaaaggcacaactccaccttatcatctccactatataaaattcattttcgatcgatcgatcgctcactcacccacttgtctcacactctcactgagctcctctgcttctcgcatccatggccgccgccgccacgggccctgtccccttcaaggacgccgacgacgacggcacgctcgccgccgccgaggcgcgctcgcctctcccgaaggaggagttcggcgacctcgtcgcggcgctgccgcggaaggagcagtacctcgacgggcggctctacgaggggttctggctgccggagcactacgcgccggggatcatcgcgttccgccgccgcttcacgccgcgcgccgacgacgtggtccttgccagctaccccaagtgcggcaccacgtggctcaaggcgctggccttcgccgccatgacccgcgccgcctacccggcggacgaacacccgctgctccgcctcaacccgcacgacgtcatcccgttcgtcgaggacgtcttcaccgacggccacgaggccaagctcgacatgctcccctcgccgcgcctcatcaacacgcacacgccgtaccagcttctcccggagtcggtcgtcgccggcgacggcggcggcggatgcaaggtcgtctacatctgcagggaccccaaggacatggtcgtgtcgctgtaccacttcatgcggcgcctccagcccgacctgtcgctcgccggcgtggtggagtccgtcgccgacggcacggtgccgttcgggccgatgtgggaccacatcctcggctactggcgggcgagcgtctcccgcccggaccgggtgctcttactcaggtacgaggacctgctccgcgacggcgccgccggcgagcacgtcagggcgatggcgaggttcatggggcggccgttctcggccgccgaggaggccgccggcgccgtagcgagcgtcgtggagttgtgcagcttcgagaggatgaaggcgctggaggtgaaccggcggggcacggcggggtcgtacaagagcatgccgcgcgacgccttcttcaggaagggcgtcgccggcgactgggcgaaccacatgtcgccggagacggcagcgaggctggacggcatcttccgcgaaaaattccgtggcacagggctcaccattgttccatgacacggatcgagcagttggccagcgacgtcgtcgtcagtcactgacatgtgggccatagcaaagtggaacccacatgtcaatgacccaactgcatgtcagaggatctgcttccgtgtgcttcatttcattgtgattttgctgctgtttcggacatttttgtttggcatcgcttgtttttatttgtgattacccacttttctcggttccaatcatggaacggagatgtgacgaaaggcgcatcgaataaagaaatgagagtgattcgggcttgatcatcatccacttgattttgtgagcatcatgatacaaattattaaatgaaatgatgtattttgtacgaaaaactttaaaatataagataaatctatttctgagtttaaaacaattcaaacttcgagttatgaaattagtttttttattcgtgtccgaaaaccccttccgatatccggtcaaacgtctgatgtgacacccaaaaattttcttttccccaactaaactaaataaggtcttattttgtttgggctatttattgatttgggccgagtttgtttgttcgttttggacttttttgtgtgggccatgtgttctgcatttgcccaagtcaaagccatgaaaagatccaaaagagatggtggttttgatgaaacaagcagagtaagaaaacgagattgatcaaaaaaacaatcacacacaaaaaaagataaatcagaaacacagcatgagcgaaatacactactagaaaaataattttttatggtgttggtcaataattttcgctggcggaaaaataccaaaaccgccagcatggtcgtaacgagggggtgaggggtaccatgttatatcggccgccaacgaagatatgttcattttcactggcggtcacttagatgagccgctaacaaaaatggataatttttgctggcagttgggttaaatagtccggtagcaagttacaattatttttgctggcggcccacttaatcaaccgccagccaaaattgatttacactggcgctcttaaaaaaattcgcacataaaaaaatcaccgcgcgcccatacctttatccacccaccactacagaataaaaatatctccacttctcccctccaaatccagatccacttcctctcctccaaatccaagcaccctcctctcctcttcccctccagatccacatctcctctcaggcggcgactgcggggttctcgggtggcgacagcggctccggcagctatgcgtggtggcgacggcgacgggaggcgggcacgtagctgcgacgggaggccgtcgtcgggggggtgcggcgacagcaacgggaggagccgtcggggggcgcgacgagctcctctcctcccctccccctcccacagtggcttggtgctgcgatggttgcggcgacggctcgttgttgcgggacatggcgagctcccccctcccctcccctccccttcccttcctctccctctccctctcccagatctagccggaggggagggggtggcggcgaccacggcggtaacggaaggcaggcggtggtggatctgacaacgggtcggcggcatgagagcaaccgcgacgacgacgacccgtgaccggggcgacgacgacgacgatgctgcgcgccggccgggagcacggcttttagcgggttcttccctcccctccttctccctttccaagaggagaggtgnaagcggtggccgtagcggcgacgacaggtgggcggaggcggcggatctgaccgcggcggccataattattagaaccggaccggaccggcggtccggccaggaaaaaccgggaccagggcaccgcccggtaccgcggcagccatagttattagaaccggaccagaccggcggtctgaccgggaaaaaccggaaccagggcgccggccggttcggttcagatataagatcagcgcgcaatcaaaccggagagaaaccggttgaaccgggcggtttactgcagaaccggagaaaaaccggggtggttcaaccgcttgaacggcgtcacacgtgaggtggcgacgctgtagagtacatgcgtcacatgaattagagaaaataggtaaaaaaaagctgtagaacccaaaacctccatgcttccaccgagaatctctaccagcaggctatgtgatgggttgtgaaacaactataacacacacctatttgaacctctttaaaccgacggtttgaccagtccgaccaataaaccagtgacccaagtgacttaacggttcgatcaccggtctggtcttaataactatggcggcgacgacgacgacgaccgcaatcgtcgaccacaaccgtggcggcgatgacgacgacgccgctatcgacagctctatgcgtgggcggcggttgtgatattgatgtttgcttgttgaaaatgtggtgaaaattgatgtattgttttctgcatgtggatttgaatatggatctgatgccgatttgaattgattttgagtatggattgaaaaaaatccaactgctcaagaggtcgattgctatttttttattggaaaaaaaatcttttcgttggcggtcctcttaaggatccgcctgcagcggttctcttaagggtctgccagcgaaaatctattttcgcaagcggtcctcttaagcgtccgcctgtgaaaatcctattttcgcaagcggatcgcaactgccagcgaaaatcttagatcttcactggcctttgctttgtggcggctccaaataccgttagcgaaaacgcaaaatgaccgccacgaaaaatagttttcctagtagtgataagaggagatcgaataaaataaaataaaaatccagaagtgttttaggtggaacctgaatttggttggttacggaggtaatcttgaccctctcacgcaagatttcgttgattttgcttactctttgtttacttgatctcaaccgcgtcaactttttttttgttcgatttgttctactactcgatgaaacaattgcagctctgtgaaacttcaagagaagcctccattgcttcattgttggcctttttattatcgacgtttaatcattctaccattataaaaaccatttgtcgcacataagaaaatataaaaagaaaattacactaagctccaaatgtacaaaaagttactttggcttcatcacagagtatgacaatatcgatcacaactattactcctctctctgtaaaaaagataaattttataactaagaatatgtgtctagactcatagttaagatgaggcttaggatatgggatatagatcgacgttcagagtcgcaagaaggcctcattcaatacaagaacgagagaactagagaacagaaaattttctgaaatactcctccgtttatatatatattagtttcaaaccattacagagcaacaaggaaacaagcagccatcccgatcgatcgaacgaacatactcgaccatgcaagaaagcatctagcattaataggtagaagtagaaccacaagcaacgatcacaatgcgtgcgtacgtaatgtcgtcgtcgtacgtcgtcacgcggcggcggcggtgcggaggaggtagtagtagagcttggggttggcctcgaaggccacgcgggagatgaggtggccggcggcgcctggacctttcatcatcaccaccggcgccgccaccggccaaagcagcaggctcaccgccgcgccgaccacggccgcggcggccgctccgacgacgaatcccagcgacaccatggctagctctcgatcgatcgcggtctcaacctcccaaggtcgactacttctgaacttcccaagatcgagatgactagtgctagacgtggtatatataggcaatttagtctgcattaatttgcttgttttcctcgggaaggggatgggttggaacttggaagctgatcacaatttgaaggacggtatagatcaaacggctcgtagtaaaatgtgtgaagacgatgggacgatgctttttttttttcgcaaaaactaatcagcgaggcctcttgatattgtcttatcgggcgacgccaaccatagaagccgtggagaagccagcgcacatgcatgcctttttttctattacacatcatgtattgttttcccttcttacaaagttttctctcaaattaattatccgatctataatccgattacaccattgtgttcgttgcaattaaatcttcaaaactagatcttacatgattatactacgatgaaaaaatatttatacttgtaaattacttttgttatatacttaagttacttttatcatatatataaattacttttagatttaattaattactttttatatattcataatgctttaagtcgattatatttattatagtttttagtcaattctataatttatgacctttaaatttaatttttagatacaaaatatttttctctcgaatttacttctaatgttgtaacaacttacttctattttgtgctaacttacttctattgcatagctaagttacatctattgcatagctaagttactactacaatttaaataaattacttttaaattaatgaaatgtttgaatatattcaacatggatttttttatctcatattttatgtagagtacaatgatgtaaatagatcatgaaaataatatgtgatttaaaagatataagttattaaagagcttaaatctaaaagtaatttatgtataggacaaaagtagcttacatatataataaaagtaatttacaacatagatatttcgtgtaagatcttgttgtaaagatttaattacaacaaccataatggtgtaatcggattataaatcggataagtaatttaggagaaaattctctaggaagaaaaaaaaggcatgtactgttgagtgtactagtaactgtttaagagaagggcgtcgctggttagcgatatgccgctagcgcgcgcgatctagccgtgtctttttttcccacgcttttttgggactccggccggtaattgatccttcaataaagttctacaattaagtgagaagcagcactgagaggatgcccgtttcgtttacccgagtaattaagggggtgtttgggagacttcagcccctctctcaaaaacataagtttctaggatatggacttatggttttgagtttagcccctctctcccaaacaccccctaaatctgtgagcagacgataaattctagtagtagtgtgctccttcccccaaataaaccatctcatttataaaaaatcttagagcaagtttaatagtatagtccactactagttttaaatcatctatagccaatgtaatagccaattcatacaatagttgcttactatactattaatacctggtcccacctatcatacacacattccgttttggagtccgtgctacagctggctatagacttatagcccgctgctcttctctcttcctttatctatttaaaatatgcttatagctggcttatagcgtgctattgtaattgctcttacatagacgtaggtaatagtatagtaggctagtaacaccctagttttctccatcctaacaaaaagtgaatctagaactctagtacaactaatctatatgtgttacattcaatactagattatttttttatgggatgaaaggattaatttttcataggacggaagaagtggtatgaaactcaacgtagcacaaaaaatctagaacattctcatttataaaaatcctatatagatgtaggtagtagtaggctagtaacaacatagtaacatatgaaactcaacatagcactaaaaatctggaaaggaagcttgtttggttggtttagaatatagtaaaataaaaattaaaaatcaccaacatttgtaactaaatttcactcacactaaataagttgtcactcacatccgtggaccttttaacttctaacgataatatctaacttttaaaaataaaattagatatgcattttttatccagatcgatagatccgttaacattgactcagactcgttcgttcatgatttttataatctatgggcatgtttaaatcaattttctgtggtaaaagttttggtgacaaaaaaaaattagcatttgaagttgaagttttaatagttactgtttagatgcatattctaccatttttctggtagagagagcactcccaacgcacttttcgacaaaatttactactctagattttcaaattttcaaatgacaaatattaaattgataacttttactactagtgtttagattcattttgacaaaatatgcttcaaaacggtaaaaacttttaccattttagaggtttggaagaactaaacaggccctaacttcaccaataaacttcaccaataaattgctcgatcgtgcatccacataatgactttaagttgatttttttatatgaagggattaaagttgatttttataataggttaaagttgatatattttataggatgaagggattaaagtttatttttttaaggatgaactaaaggagtacgcgatgaccaattcgaatggaacatactatttgggcgtgtatccatgcaaagctaggatgcacgatctgttgagattatagacatataatgatttaatttattccataaataaatcatgacattacagatgaaaactagcatgaacgcatcattagatctacatatgtaaactatacagtataacataaacagatcaaatatgcgcaacatattgaacacgtaccgaggtgacagaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaacttattgccgccttctcccggtgcaggacgtcgaaggcaaaggttccggagacctgctctcccgatcgccggtgcacgctggcgagcgggatggagtagtctacgagcgacggcgcagtacagagtaggaggcaaaccctagattgatttcgtgtgtgttgcgtgaagacggcaggtcggtttatatagagaagggtcgcttgatcagggcgcccgcacgatctctactgcgcgtaaccgaaccggataagtcacgcgtaacttatctggactccacgccgtttgcacgcaccggatttttcggaagaatctgaatttgcagcaaaacaaaactgcaaaaagaggctgcatctgcgcaagggtgaggagccaatttttcggaccattcaacgcgtacgtcgtgcacgcgcgccgcatgccctgccctgccctgccaggccaggcgaggcgaggcgagcgagcgtgcgcgtgtgtttcccctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatatactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtc

SEQ ID NO: 66746 - DNA, 671 bp, Oryza sativa
ctgcaacaatacaatttccctgcagggtcctacatatatatattacactattcgtctccacgccgacaaaacaaaatatttcagatctccatagagatcgacaacgccgacaaaccctagctaacccgtctgcattaagcctgtgaatcaaggcggccatgggacagggaagctccggcccagtctcgtgggatgctgctctagccgtctcctacatcgccgacgtcgccgcaacctgcaagcacatggaggccggcgggtgcaagctgcacctcctgacagcgttgcgggactgcgtggacaagccgcgctgggacgacgacgacgacgacagcgagagtgtcgaaacatgaattcggcaataataaaagggggtagcgcacgagacctaaaagtggatggatgcagagacaaaggatttagacaggttcaggccctctcaatgagaggtaataccgtactcctgtttggagatttgaatccgccgagtatagtatagatctgacgatcaggttgtctcatgccccctagagggcctcctatccaccttatataggatggggggcaggattataagatagaaaccttaaccaatacgatatcggtttcctaaatctattttacaatattatcaaatcaggactttaggccgctccataatataaaaggaa

SEQ ID NO: 66747 - DNA, 3615 bp, Oryza sativa
ccacaacccccacatgtgatcaattaacattatctaccatttattatcatcctaattacctcaacactatctaagtcctaactacagtaattaattaggttctccaactttattggcactcaacagttgtcggccccgatcgatcaacttcatgcatgtctccaaaaggccataattaatcattatattggcatgtacattcatgtgtgtgctattttctcaagcattctgctgagagagagtagtgagattgatgatcgcttgcggaggcatcgatcgagcgatcgttgtcgattcgatcgataggattagttgtgcatgtctgcgttggtttgcaactgtgggctctagctgcttaactatcatgcaattctggggcgcgaaagctacgtatcatgctacgtatgacagcactacgtgtgctagagcgtggcaggttttgtggcctcaaaattaaggctctgttttgtttctaaaacaaaaaatttcacgctgtcacattaaatatttgaacacatatataaagtattatatataggaaaaaaaatcaattgcacagattgcgtgtaaattgcgagacgaatcttttaagcctaattgcgacatgatttgacaatatggtgctatagtaaacatttactaatgacggattaattagggttaataaattcgtctcgcagttttctggcagaatctataatttgttttgttattagactacgtttaatacttcaaatgcgtgcgtatatccgatctgacaatcaaactcaaaaattatctccaactaaacaaggcctaaatgccaatacacttggttgtaaattcaccaaattattattttttaaatgaattgacaagctgtcaattttattgaataaagcaggaaattttcaccaaattattactagtactgataaataataatttgtagtattcatgaaaaggttgggtagctatagctagtaaatttaaagttgactctagtcattagtggagtccaatacatgttgattagttaaagagaggatctgacacattacaggaatcccagcctttttcttccatgatagtgatcgaagccatatgctgagtatataccgatcgtatgggtacatatatattagttctgcattagcttatgatgcaatgcatgtacgtagttctttttttatgaaaaaatatcgctatgttcatttgtctcctagcaaaaggaaattactgatgaaaagcaagcagctagacaagtatctttacagcctgcattgctttgtcctccaattgcattcgaaggtcacaaagtaagcactggtattctaccatattaaaactcctcatgtggagtcaaaatccaggagaaaagtggcaatgatcgatggaaaaaaatagaagtgcgtggggtatatagagctagattgagagtgaacctggccgagacggcgtcctgatacaatccggccagaggccacatatatatgcctgggacacgcattgcgcctctcaccaacaacctaatggtgtagtgtagagtccagtaggcaggcaatgaggcaactgctttgattcggtgtgagaagcagctagtaggagatgccaacgcccaagtgcttctgcttttttaggggagagttgagaagaaaacaattggagataaggctcctttttagtgagtcagcactcagcagttgcaaacgccactaggtactgtgcagatttccaaatatatttcttgaccaagagtagtcgtcggtaattgttatttcttgctctctctcttttttgccactcgtcagttttgtttattttgttttctattttgaaaggaactcgttgcttaattctctcttgacgtaatgctttcagaatttctcatttcatctcctcttctatttccttcttcctctatgctatagctgtgtgcgcaatatgttgggaggaaaatttatggtgaaactaccattggatcgaaaatgaacgtacgagattcgtccactttgagcatgatgacgtggataaatctcatatatttatttttcgatccaacggtagtttttaggatatataatttccactacatattttctcgggttgggaggaggggaccagagaggacatgggtgtgtttcaattttaaagttttgcatttaattcgttatatttgaaattgagtactttttttcaacggtagacaaatgttgacatgttttttttttcttcatagttcttaaagatacgtcaggagcatgatccgaatatctccaagatgcatgtaagggtatggtgtctgtgcgtgtgttgtgcatatgtaggtaagcgtgtactgtgtttattataaaaaacaagtcgagtaaacttgattagagaaatatcttaggatgtattcccaactccttctcttcgactcgcaaaacaaagtaagttttaattagcgcatgattttattttcaaggcacgttagcgtacggttagttaagtattaaaaaattaaaatagactaatataattttatatataattttttttagaaaatacaccgtttaatattttagaaaatgtacgcgtgaaagataatgaaaatgaaatcggaaaattagactaaataacacagctttagtggcagacacagattatctggctatcagcacggcgagaacacgcaccggcaaaagtgtcaaacgagtgaccgcgtagccggcagtaaaacgtggcgaaacttcgtgccacagaacctcgaaatccggccggtgcatccatgactaattattgaccatgcaccacggagcgatcagccctgtgtcgtgtaaaatcacaaggaaacctgttccaccctggtttcggcccgattcggcctccaaactctcgggccgagtgggagtgggaggatacatgggccggaaggaacggtgctgccacgaacacgatagatgggctggaactggatgggctgcgcggtggatgatgggctagaaacgaggtattgggacggagaagacgtggattggctgggattacactgaagactattacgggcaccgccatgtgggccacacgtatcgttgccacgtacacggtacacgtccacggtccaagcgccacgtaggattcgagaagcgatgcatcgaactgaagcgagaagcgcggaaatattctagagcccacgagagcgcgaaacgaaccttctccaactttccctttccctcctcctaaattttcgccgcctcctcttccctcccctcccctctcgccattgccgcatcagccatcatcgcgaaccacacgagctctcgacgaaatcatcaaccaccacatcgctactggatcagttggggtctgtctcttggagacggggagtttgagcagcaggagttgagatggcgatggacgcggcgccggcgctgaagaggaaagacgcggacccgccggagctgtggatgggcggctctctttgctattaacggttataatggtaatttcatcatgcaatttaagaaaaattcctagtaaatgagtttctaattataaaagccaaatctattactttccttggagaaatttcatgtaagaaatttaaccacttaggcttttttggtcgtaacggtaaccgctctacctttcttc

SEQ ID NO: 66748 - DNA, 729 bp, Oryza sativa
gcccaggagaaattgtagtcgctgttaaacatccattattatcatttgatatttatgaaatgactgttattctcgaagtatttatatatttcgttgcatgagtgtttgagttatctatatgcatgaatgtgtatgtggcatctttccacatcattcaaatgcctaactataaatatgtgcagactgttgatgtacctaaggacatcatgaaacttattcaagatattaatgtagaactccgtgctgaagatgaaagtcgggctccaaatgaaacaaattatgtgagagctcttcccttttcattccagatgcatgcatggcatatcactgatctaattaatgttcctgagtgttaagctgtcatgtcctgtctatcataatcataatagactcccttgtttcagcttaaacactgtattatttttgtgaatgattttttcctcgcttccaaaaaataatactacttgccaaaaaaatattgttctatgttattgtttaaacttgttcgaaacgacttgttaataagttttatctcaatgttgtatcatatatgttaggtaccaactctgtcatataaacgctttcaggagactgacagccatgactggcattcacggtctttacaaactccagtggttgccgaggaagagaaatctcaggacgatactcgtgaagcaaaagaaccctatgctttaggttggaagcaaaaggagtttaacaagcaagacc

SEQ ID NO: 66749 - DNA, 11509 bp, Oryza sativa
aggcgaggcgagcgagcgtgcgcgtgtgtttcccctcttttttccaccacacatgcttcaagtgactaggagggcatcctcccttttaaggaggtccccctctcctagaataaagcaaggtggtactaaactccacatgcatgccatcccatgaggggggcttttgtgattttccaaagaattaatcttcgagtgggctaaggcccattcattaattccaacaatcccccaccaaatctcaaaatcccactgagatttgccttttccaatatactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatactctgcaggacaacatcttcgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccagatttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagaatagtgaagccccaattccacagtacctttcagatagcgcattactcgctcaagcgcacgccagtgatcatctcccggattagaggtaaatcggctcaacttgcttacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaagatttgtcccaaatatcagtatgtcgtcaacatacaagcacaaaataactccctcacccccaccatggtgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtatcaaagaaatcttcgccttctttctgagtatagcccttagcaacaagtcgagccttgtacttttcaatagtaccgtcaggcctaagcttcttcttgaacacccacttgcaccccacaggtttacacccatagggtcgctctgttacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctgtgatgagcatatcccagaaaaacacagtccacagtcctagctccaagtttgcgcttcttcgttattggtacattgactgtcgccaagcacccccatgtgcgcaaataagaaagtgatggttttctaccaatccatatctcatatggtgttttgtccttatttctgttaggaactctatttaacacatgatttgaggtcaacaatgcctccccccaccatgccttaggcagtcccgcggcgtccaacatggcattcaccaagtcagtcagtgtgcgattcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcttcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctggtcagacgggagccactaacaagattcctgtcgaaaacaaaaacgaatccgaatttgcagcaaaacaaaactgcaaaaagaggctgcatctgcgcaagggttaggagccaaatttttcggaccattcgacgcgtacgtcgtgcacgcgcgccgcctgccctgccctgccaggccaggccaggcgaggcgagcgagcgcgcgcgtgtttcccctcttctctccaccacacatgcttcaagtgactgggagggtatcctcccttttaaggaggtccccctctcctagaataagcaagtggtactaaactccacatgcatgccatcccatgaggtgggcttttgtgattttccaaagaattaatcttcgagtgggctaagacccattcattaattccaacacgatcaaccacactgcttaccctacaacaaaaccagcagctttttcccgtacgtacgtggaggataactatgtactagtgtagctacatagtacttactagctagctatagcctataggtgtgtagtcgtctatccagcagcagcaatagctaacggagtggagtacgtacgtcgccggcgccgtcgcgcgcgtcaggcggcgacagcaaaagcggcggcggccgccttggcgcctgtcacatcctgattttcgtttcaggatttataaattatttaataaattattaatagaatttatattaaatgttctttaatttacaagtgaagttaaatgtgggaaataaaatttccctaatataaagcatggatggatttaatttttattaaattctccatgattaagtcaactctctgaaatcttctcaaatttttcggagctcaattcctaatttttaatcatacaaagaacatttcagtaataatccacatattaaattaatcattaaatggtctggttttaatattgttaaatactttgagtgtccaagtattttcatgatttttcttgaaattatttgagcattggaagtatttttaacaattcaaagatcatttaagtgattattttaattgggaaagtaataaaaatcctcctcctccgcttgggccattttcggcccattccttcctcttctctctcccttgcgcgcgtgctgtgcagcccaagccggcccaagtcaagtgctctgttctgttctcagccaaccgaaaaaagtctagtttgcctccctggcactgttcatcttccagctctggacagagcccgagccagccgagcctgtgcacagtgccgccttcttccaccaaatccggcctcctcgttgctcctctttccaaattagttgaggggaaatattcctcttattctcctcttccttttccccaagaaatccccaaaattttatatggaaatcctttccaatttcgcggatcaaatcctttcctttttccggcgaagataaactttcccgagtttttcccgtcgttttgggcccggacccgagcttccaaggctataaataggaccccctagtcctcctctttcgtttgccccctctcccgagctctctagtgcctcgtagcctcgtcgccgcgcgcgtttagttcgtcgccgccgccggccgagtgcagccgcgccgccgcgccgcttctgccgtcgccgccgcttgccgccgtcgccaagaggtgcgccaaggggtggagaagcccggccgcccgtcctttttcgccgccggccgccgtagctcgccgtcgtcggtaaggtccaagccgccgccgcctcctctcgtcgccggccgtcgtcggacgtcgaatgtcgttgtggtgagtaccgttgggttcgcctcgtcgtcctctacgtgtgcatgccctccaaatccgcagccgggcgctctatctccggcgaggtcgtatcgtggttcgccggcgccgctccagcagccccgcgccgtcgctgtggtcgtcgccttcggtcgccgctgccgccgttgggttcgcgaggaggagaagaagaccggcctccacttccccgtcgtcgaagaccccgggaagcccgtcgtcaccgtgaagccgatccgttccatcttcagccgcgccgttcgtcgccgtccatcgccgccttcattcaccgtcaccaccctcgggatcgcaggagcgaggtgaagaccgtccgccctcggttgttgcctctcgtcgccggaaagccgtcgccatcgtcaacccaaggtcgccgcctttggagctcgtcgcctgccatctccctcgccgtctgtcgtcgcataagtggtggtaagggtcactttgatcccctctcgctcccggtgccctccgtttgcgtttgtgccgtggttcgccggcaaccgccgctcctttgccgttcacctgtgaggttttccctagggccttaatccgatctaatctaatcttgtttggccctaacgtcatcatcgtctccgtgtgtgtcgtcatcgctgtgtcgtagctgctgcttgccgtgccgctgctgcgcgtgtgccggctgagccgcttagctgcagctgcttgccgctttgccacagccgcagccgtgccggttgcgtttttgctcatagccctgctgttctagccgtgcatggttgctaccggctgtgccgtcaccctaaccctagctttgtgtatccgctgagctgccgcctagccaagccaagtcgccctagtgccgccgtgtcgcagttgtgtgccgcttaaacctagccgctgcttttagtcgagttgtgcagccgtaggtgcaaccctaggttcctaccggtctatcgtttgtcgtaccggggttttaccatgaatcgtttctagtccaccggtttagccgcagccgttgttgagtcgttcgctcgttcgttcgaatgaggtgttccccgtgcttcgttcgttcgtccgtgttgagtcgtcctttagttcagagccgccggttccgttcgccggtttcggttgatcatttgggtgatcccgtgtcacgtagaattgactcgttgagtcggtatctcgtgaggcccgcttgccagatcaatctaagccatccgatcttggtcaactctcggtcaagattaatctcagccgtccaaaatcaatataaattcgttctatcttttcaatggcatattagtcctttttctttttatcatgtcatctaccaatataatctaatcttttccggaggttgctttaatcttctgtctccgttataaatcatttgtaaattgtttaattaatttggaatagtcttttctttaataggtttaattggaatttaatcttgtaaaattcataataaattcatatgaaatcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgcttgcattgattactttaatccttgataccttgggttattataatttgactagttgagctttatatattagttcagctagatattagatgtgattgcttagccatgcttagaaacattagcacactattgggataacttatgattcgttattatttaatgatggtttaatggtagctcacgatggtcaaacgtgattggttaattaattacttgccaactaaaacttgataatggtgggttgtgagcacatggttttgagagtcgtgctcatgacaattaaggaccggttcgcgaggtactgttgtgaaacattaaccgtaccaaccacaagccagcgtgggcaacggctttaccttttgtatagcatggttcattgcggagcaccagactgagaagtggcggaaataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgaacaatgtttttcgtgattagtctcacacctctcacaataattatggatgctataactggtaataatttgcttagctcctggtttggagttaaatctgtacagccgggtatggttgttcaggatggttgggcctgtgcagcatgggtgtgctgttcagtgttgattaaaatttttaattaattactctactgttttactactcttaactctttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaagaatccagaaggagaagacgtttggcttataccccagttgagctgcctgtgggagtggagccggagcttcgctagattttattttccgctgcagttttcttcttggtgaggacttagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacagcgcccaccgtgcgcaggaggtggaagtagacctgcgggttcgccaggaacgccgcgcgggagatgacgtagccggcggcgcccggcgccttcatcatatcatcgccgccgccggcgccgaggccggccacagcaagtacaagaaggcggtcgacccgacgcccacggccacggcagcgatcatcgacggcgccgcaaccatcggcactacaagtttgtaattccagatcgcgcgcgtggagaccaacgaacaatggaggagatcgacgaagagatcaagcagagtgaaaggtgcggccactggtggtaaagctagtggtaactggttttatagaggattgcaaaacacaggaaagacatagaaatgactgtttgattgggccgcaggaaaaacataggaatttgaggagaaataaagactcaaaggattctttccatgaggttctatctcatgtcaaatttcctccaaaacttgcaaaacttgtatggaaaaagataatccataggaatttcataggattttataggatcaattcctttaatttaaagggctatatagaaaaaaaatcctacaggaataaaaccatctaaaatttctatgaattctttttaatcaaagggccctaagttgctggtggttctgttcatggtggctgggttcctccggaagggccgggaaggggcgagggtgcacggacagcgggacaggtggcagaagtgtgggatgcatattgcctggttttttacttttacctggtccgtctactcgacacgcgtacagggatcgagatcggtaggggcggcgctccaaggagcatcacatcggtagagacggtgacgaaggagatcacggcaggctcgtatgttatcatcaatcaaatttgtatgctttacacgtgagatctacgtgttatatatttaaacaaacattattacactataaatgtatgttgtgtgttcttatttatagggatactagcttaattaaagaaaaacagattgagaaaaaaatttataaatgataaaaagaacgttgattggggaccaaatcagagtattccccaagtctatttgaagattactacgtcacttttagttcatagaagataataagatataaagtttttaattcggattcagctctcctaacaccatcaatttcaaacggatctagccgctcatatagaaggaatctcgggggtccatgtcacgccccgaactagtcccgaccggaactagcccgtgacgttccaaattaacctgttaatcgataccagtcccaggaaacagtgctggtatcacagggagacagaatatcatagcatcagaggtctctttattatagagtagaggtacagtcatgttgggctgcggacagatcccgagctcacaactgcattacaaaagggaaacggaagccaggacttggaccaatcaacacaggcgcgacttgggaactaggccgaaaccctaaaactcatcgtagccggcttgctcctggaagaactcctcatcagcagcttccgcttcatcttcttcagcaacttggggggggtcatttatatagagcaagggtgagtacgggagtactcagcaagccatgggaaataagtgtttaatgcaagcttcaaggaaaggctgttgtttttgcaattgtttttatttgaactcttttctaaaacaactaggtgagtgcttctcaaacgacacggatgagacagtgcgtctcgtccggtcggagtatgtgcaatgtatcagtctttagaattgaaacaaggttggcacccggccaacagcttttcaaacggccacccgggccaaccacttttcaaacggccacccgggcctagctgatcccatcacctgcagaattttcaaacatcgaaccccttttcacaacagtaatttcacaagcagtagtcaaacaaaactacgctaggaatcacctcacatccgcccatgaccgtgggcacggctgttcgaacagtttgttaacctctgcagagggggtacactttactcacacgacattactaacccggatcacccagcccgtggggatcagccacgtcgggagacctccaagctttcatgacaaggcatttccaaagccgacacaggtttaccatatgccgacgagaggagtcccagaccaacaacaggttaggtcccagaccatactgtgccaagaagcccaggggtcctccccgacaccaccccggcgaatccacatgtctctcggcatcaaggctcccctgataagctagttactcagccaagggtgtcccattccacccatgtggtcgtacttgtcttatgtttggatgaaattccaaggaaatcggtccttaagtgcgagagcgggaaaccgtacacccggtacgttccccggtccgcggttttggaaattcatttagttcgcaagcaccgacccaggtgtcgggttttccaaatcttttgtaaaacccaagttttacgcaagttgttattcagattttaagtttgaaggcgtccgtcgatactcgcacagggtgcacgaatatcgagacgcaactagatggttacaaggggacatggtataacaattaacaaaagaaggatcaaatacaacaaattagataggtccgccaatctgccttgcagacgggacaaacagattaagtgcgatcctatcaatgcataatatttttcaagcaacataattaaatttcaaatataggctcaagatgttcaaaggtagcttgccttgctcgagatctggagcttgatcctcgaaatcctcgcactgcgggtcttcgggctgtcacgccctgaagttttcccccctttgcttgctttaaaaattggttaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaatttttaatcccaggaaaatccttt

SEQ ID NO: 66750 - DNA, 754 bp, Oryza sativa
attcctgcagccccgcctcactcactctctcgaccgccgccgtcctctccaccgccatctccaccgtcgccgcctcaacctctcctccgccctctccgccgccatctccgctgccctctctgccgccatctccgccgtcctctccaccgccatctccaccgtcgccgcctcaacctctcctccgccctctccgccgccatctccgctgccctctctgccgccatctccgccgtcctctccaccgccatcttcaccgtcgccgcctcaacctctcctcctccctctccgccgccatctccgctgccctctctgccgccatctccgccctctccgccgccgcctccaccgccgccctcgccgccgatcgtcctctccgccgtccgtccatcgacttccccgacctcctcgaccctgacctccccgacgccgggatccccgaccaccgccgaccgcctcgacctcttcgccactgcctctccgccgccgccaccaggatccaggacgactacggcctgcgccgccgtctccaagtacgccgcttctccaagtatgccgccaccctcccccattcctccttttttcgatggatgaattgcattgtttagatgaatgaaatgtgatttgttgtttcgattattggtgctgctgtatagatgaattaaatgtgatttgttgtctgtggatgttttggatgaatgtaggggctagattttatatacatgaatcttagcatcaatagaggatcttagcatga

SEQ ID NO: 66751 - DNA, 14028 bp, Oryza sativa
gcggtggatgagttgttcttgctccgaagtgagctccatgtcatcatgaggtatatcaatacctgtacaaacatcattccaaatacttggatgcaaagagattagatgcaacttcatcttgtgcttccaagcagcataatatgtctgatcaaattgaggagcacgccctgaaggcacggagacgaagttgtgagagggaatggtaagtttgctgtaatcaaaaggtatagtagctcccttgggtggtggagttcccttgctactcgcttcatcttcatttcattttccccgttctttccccctaagtccgacatcgtggatcactcaaaggtgtgaagcttgaatcaagagcaccaggctctgataccaattgaacgtgcagagatgtagcctagaggggggggggtgaaaaggctttcctgaaattttctcaacaattgcagcggttaaattgacagggcccggaacctcctggtgatgaacaccggaacttccgggcaggatgagtagcccagaacttccggggttcttgagtaaggaacttccgggcagcagagataaattaaactgagatgaaaaacaggtcctagcaagagaagtttaggcacacatcggaacaagatgaagatcgcagaatatcagcagattcacacaaagatcatgcacaagagagacaaagacaattttttcccgaagttcggatcacacgaatcctactctccgttgaggtgctccaaagagccgggtctcgattaaccccttggctcacttatgcaaagatcccagaagaggtccacagccttcaactcaacacttctaggttattttctagaattgagagaccaccaagatccaactcaaaatttcttctagaaaagaccacaagtgcaagttgctctacctaggacaacctctgaaaactcagcacaagaatctttactcacttacctcgtttccttgcggaggtgaggaaaaacttcacaaactttcctacgacatccacaagatctttggaagctcacgggagacacctaaccatctaggagaagatctccaagagtaataagcccaagtgacagcccacaaggtatccaaagtgctcaatcaaacctaatcttcaagccatctccaaaacactcctacactctcatctaatctctcaatctcacaagataggctctagatttgagtggagaaagcaaaggaagcttgggagtggctagaaaaccctcgaacatgaaagaactgaagtggaatggccaaagggtgacctggggatgaaatccatatttataacggctaggtgatgtcatctagccgttactcacatgtttgaactggaaacctgccatgaggttccgggcaagtgctaggaacttctgggcagcacttaggaaaatttttgcaattaaacggcgcccggaagttccggccagaaccttcgggtagccctctctgtcctggggagaaaatcatttttcaaaaatgattccaaaaatcttttgactcatggatatgactaagagcactttgtataccatagaaccacacttgaaacccctcttaatagtacggtttttcctaaactcaatttcgaaagtgaaaaacctagtctaatcacctacagcgattttcgcacttaggaacattcgaattggggggtctccttgcattcttagtcatcacaacttgctttgggactaaactcctgtgaataaacttgataaacacgttagtcccctttaaccacattgtcattaatcaccaaaacccactagggggtttaagtgcatcttcacccaaaatgtggtggctctggtatagatgatacatatattgattttgatctggaggatatgttgtggcacgttgaaccagaggttctagctagtacaagatgagggtttgacaattgggaagcgttggaaagaagggatacgagtgtacgacgagtactgtagggagcattttactctacgtgccattatattcattaccatcaacgacctgccggttaacttttggctcccaggatagcttaagaggaagttcggatgtcttatatgtatcgacaacacgtcatacaggtacctcacctcctcaaggaagacagtgtacatgcgtcaccgtcggttcttaccacagaggcacaagtggcgtaagatggccaacttatttgacaagtccgtagagaacgatcttcctcctgaagcatgaactggtgcacaagtcttcgacatggccaagaagattaaggtcgtgttcgggaaggtatagaagaaggcaatcaagaggaagaaagcaaaggatcaaagataaagttagctcaatcaaatatttcatctttgtagagaacacgactattacagaaaacatggcgggttcgtaaaggatcaaaagaggacaagacttctcgtaaagggacgctggccggtatgtaatcaaatatatatattcgttaagtatatgatgcaattgtttgttcttattactgacgtgtctactgttcttacgcagtgttacaagcaacccaacagtaccaacctatggggatattaagtgtgcgagatgctcagggtccgtgggagatacataactgagtttacagatataagtcatcatgctccttacatataggaaatagtcatttaagtcgcttttaacacatatcatttttcttctattttccatagcttccgagcatcccatatacagcaaactggttcgaccagaaaacgcttctgaacatctgcgcggacttatgccggttcattcgttgcaacatccgcaaccatccaagggagttctatgacccttacagcgaacttgctatggacccccaattcaaaaacctaagggagtgggagagagaacatgcaatagaataaaaaacatctatttttaatattatgaacactagacatgtacatatgctatgtaatatatatatatatatatcgatgtttctaattgtgcttgtataatttatatgtaactttacgattcaaaaatacacaaaaaataatgagtacgtacattttcccaaacggttagcaattgctagggtgactgcacgaatctattatcccgtgcggtcggcctagcacatgctagccgactaggataatagattatcctgtacggtcgacataactgaactgcacgggataatctactatcctgtacggtccacttaacataacgcatgggataatctattatcccaagaggtcctcttaactcgatcgcacgggataatcgattatcccgtgcagtccacgtaacccggccgcacgggataatagagtatcctgtgcggttgggctgcccgcacgcgataatgttgatttttgcaaacacctaggtgcagatgggcgctacctccgcatggaaaaatcggttttgactacatggaaaaatcgaatctgtagtagtgtgacaacactctatttgctgcccgctttagaatctccgggtgcataatcggcagtgaaactgctactagcacctaatgttacagtactacaagaaaaatgttttgtaagagacatttttctagtataatagaggcacttttcaaatgcctttacaacaatatagaggcattttaaaacatgtctaataataagtgtcttatggtgaattctctctataaacgaagagagattttataaaatgtctataagattgtagaggcattttctagagacattaaattgtaccacaaccatataaaaccagtccaaaaaagagaatataataatatccttgcttttgtcaagccttgatctcttggttaaatcattttaatcttcaatgcactaaccaactcacctccatgtcattacttgtatgtttgtttctttagttacacattatcattctaaaaagtatctctacatagtttaaaatgtctcaacaaaatgcctttacatattaaacgcattttatagtgccgaaagaatgcctctataagataagatctaacaaactgagctaaaattgtctctagagtaaaagttttctagataatttttgaagtgtctctacactataaaacttatgatcttagaagcaatttgcaaaactcctctacaaaagtgcctctatacgaggtttttgttgtagtgttaataccacttaagctgtgttcgtacatgtgagtttccatgcgcacgtttcccaaactactaaaaggtgtatatttttgaaaaaaaaaatcttgaaaagttgcttaaaatcatagtttttaaaaaatccattttagctgatacttagctaaacatgtgcaaatgagttgctccgttaaatgtgcgtgggggaaaagttcccaaagtgagctccctgaacgcagcaaatgataatttgctttccacaaacattaatacacattggcatatgtgaaatcaaagtgtgttttgattattatttcatgataaacaattggcacgagagataattgatactgatatttagagatatatggtgaaatggttttggtgccagtcacaccgggtgtcacgcccggaatttctatccaaaattccaaacgcttacatgtgtgtgaaccctcgtccaggaatcagccgaggcacacaataacaaattgataatagagtacaattattactctaattaataagcgtataaaatgtcattacagaggtagatagttcctctcaaacaataaagatctaagcagcggaaaataaaataaacggcgcagacggctccactccacaggcagcttgaccaaggctactcctaatcctccactccatcagcctcattgtagaactcttcctctgatgaatgattgcaaggtgagtatatgacatactcagcaagccacgtagcaaatatgcaagtgcacaggataacaaaggatggcataatagggtttcatttgcaaaagcagcatttagcaaacatttcagaatttaacaaaacagttaattaatttaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaagagttgtgacaatacccctcgcataacacaatccactgcagcgcaccttcctggatcataatcacccccttataaacaaggcatggactccccagcgacccccgtgggcttatctccgccacttctcagtctggtgctccgcaatgaaccatgctatacaaaagataaagccgttgtccatgctggcttgtggttggcacggttaatgtttcacaaccgaaactcgtgaaccggtccttaattatcatgagcacgaccatcaaaaccatgtgctcacaacccaccattatcaggttttagttggcacattaattaattaaccaatcacaatcgaccatcatgaactatcattaagccatcatgaaataacagtgagtcattaattatcccaatagtgtgctaatgtttctaagcagggctaagcaattatatctagtatctagttgaaccaatataaataaagctcaactagtcaaattataataacccaaggtatcaaggaataaagtaatcaagaacaaaagggctataacaaagaataggttgattccacccaatgacattcgaaaataaatgcaatagttgaaaagaaacaatagctttaaataggatcaacatgctcaaaggattgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttaaagattaaaccggattaaaacacttaaatcggttaaaattgaattatgacgcaataatgaattatttttgaaaaggaaaagagggtttattgcgtcagcggctagggttttggtggaccgggcgcacgggcggcggttcacgcgaacggacggccgagatcgatccaatccaaaacggacggccgagatcgaacggtccaagaccggctcacggcggacgaccccgatgacgtcagcggtgacatcaccgacagcggtggcggctcggcggaacggacggctcgggcggcgcacgctcgccggcgaacggcggcgcgaggacgcaaacggagggcaccagcacgtagaggacgacgcggcgaacacaccggtgaccaaaacggcggcggaagaacaacggacgacgacggcgacgaggaggaaacggcggaaaccttcgggttgacgacggcgacgaagctccggcgatctccggcgacggcgaaggggcggacgaggacggcgacgacttggcgaccacgacgacggtcttcccgagcgacggcgacggctggagcgacggcggcgcacggctggagcagcggcggcgacggcaaagctagggcacacggcgctagggcttttccgacgacgagaggcgaaggcgaaagtggcgacgggtagaggagacaccgggggtccttttaaaggggctcggaggcggcggcgaaggcccacggcgacggcaacggcgaaggaaagctcgggaagaacaaatccgagacgaactcgaatccaactctttccaaagcgatttagccaaagattccaaaggagaaaaggtagaggagatcccggagaatgtttcccctctattgattcggccggagaaggaaaggaacggccggatttggaagggaaacggcggcggcgcgaaactagggtttcgggcggcggcggccgaaggtagacgacgactgacaggtgggccccacctgtcagcgacagcgagggcgcgcgcggctgcggcggactgggccggctgggccgaggagagagaagagagattttgggccgactttcagcccaaagccaaaagaggactttttaaaacttttttcaattaaaattatttcttaaatgcaattccatttattaaaaatactttcttagctcaaataaatcccagaaaaatctaggaattatagaattaagcaaagtatttaatgaaattttatctgggcccattttatattggaatttattaattaaaattagattttcttttcaagactttttaaaattatttctaaaaattccatttaaacaacaatttataaattttgaattttcagggtgtgacaaacctaccccccttaaacagaatctcgtcctcgagattcggaagaactggcgaacaattgcggatgagctgacttcaattcatcttctcgttctcaagttgattcttcttccgagtgattactccattggactttataaaaacggataactcgattcctggttcttctctcacttgtttccaagatacggattggtttctcaacataggtcagatcctcttggactcctatctgttcaagattagcttcttcggtaggtacccttaaacacttcttcaattgcgaaacatggaacacattatggactcctgccaaagattgaggtaactccaactgataagcgacttctcctcttctactgacaatcttatagggtcccacaaaacgcggtgccaattttcctttggtacgaaaacgatgaactcctcgaaaaggcgtgacacgaagatacacataatctccttcttcaaaactcaaatccctacggcgattgtcggcataactcttatgacgagattgagccactcgcaatctttcctgaatgattttcaccttttcttctgcttcccttaggatatccgtcccgaaaacctgacgttctcccgtttgatcccacaaaagcggagtgcgacacttccgaccatacagtgcttcgtaaggagccatctgtagactagcttgataactgttgttgtacgaaaattctgcatagggtagattcttatcccaacttccaccgaagtctaaagcacaagctctcaacatgtcttccaaaatctgatttaccctttcggtttgtccgtctgtctgcggatgataagcagtactaaaattcagcttagaacccatctcttcctgaagtttcttccaaaaatttgaagtaaactgactgcctcgatcagacactatcttcttagggacgccatgcaaacacacaatccttgccatatacaattccgccaatcgacttccagaataggttgtctttaccggaatgaaatgagccactttggtaagtctgtcgactattacccaaatagagtcatggcctgatgacgttctaggtaaaccagtaataaaatccataccaatttcttcccatttccattcaggaatcttcaaaggctgcaacaaaccggcgggtttctgatgttccgccttgactcgctgacaaacatcacatactggtacgtactctgcgatttcacgcttcatacttgcccaccaaaatctttccttgagatcctggtacatcttagtactaccagggtgcatggagtataaagtatcatgagcttctttcagaattgcatctttcaaatctttgttatcggggacacagattctttcacccaaccatacagttccttgctcatcctccaagaaaccgatagcttttcctcttctcatattcttcttgatttcttgaatatcaggatcattaatttgggcttctctaacttgatcaattagagtgggcttcgcttctaaggctgcaacgaaacctctattgacaattcccaaatttaatctttcaaattccttgcataactccaatggcaactgtcgtccttctgtagcattgcaataacctttcctgctaagagcatctgctacaacattagcctttcctgggtgataatgaattcccatgtcataatccttaattaattccaaccatctccgttgtctcatgttcagatccggctgagtaaaaatatactttaaactcttgtgatcggtgtacatctccgtacgagtaccgaaaagataatgacgccaaatcttcaacgcatgaactactgcggctaactcaatatcatgagtagggtagttcttctcatgcggacgtaactgacgagatgcataggcaaccaccttgccatcttgcatcaaaacacaacctaacccaagtttggatgcatcgcaatacacttggaaacccttctttggatcaggtaaaatcaaaataggagctgatattaagcgacttttcaactcttgaaaactctgctcacattcttccgaccacttgtacttcacatctttctgaagcagtcgtgtcatgggcttagcaatcttggaaaaattctctataaacctccggtaatatcctgcgaggcctaggaaactgcgaatctctgaaactgtctttggttgtttccagttggttacggattccacattactaggatcaacggcaactcctccggctgagatgacgtgaccaaggaacttcacttcagacaaccaaaattcacacttgctaaacttagcatacagttgatgctctcgtagcttctccaatgcaaggcaaagatgttcttcatgctcttctttggttcgagagtagataagaatgtcatctataaagaccactacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactggtgatatcctgatcgaagatctatcttggagaaaacagtggcacctttaagctgatcaaacaaatcatcaattctgggcagcggatacttattcttgatagtcacatcatttagtgcacgataatccacacacattctctgggtatggtctttcttttccacaaaaataaccggagctccccatggtgatgaactcggtctgatgtatcctttctgttgcaaatcgtccacttgcctcttgacttctgccaactcattggctgccattcgataaggtctcttatggattggagttgttcctggtaccagatctattctgaactctatatcccttttgggcggcattccaggtaaatcatctgggaacacatcggaatactcccgaactataggaatctcttccaaagttatttggttcagtcttgaccttaaagactcagatgacaatgcatgaacagttacaactcgaccatcattgctggtgagagttacttttctgttagcacagtctatcacacctttatgtctggctaaccagtccatccctaggatgacatcaaggtctttggattctaacaagataagattggccagaaatggtactcccttaatttctattctgaccgaggggctacgttgcaaagagagtgcttgatcacttggggtactaaccatcaaaggacgtctaagatcttctacttccatcccattatttcccgcaaaactcatagataagaatgaatgtgtagcgccagaatcgaaaagtactgttgcaggaactgagttaacagggaacgtacccaaaatcacatcgggagcatcttgagcttctgcagcagcgacatgattgacacgggcctttgatgctggtacagcagagttattctgagcagggacaaccttcacgcgacggggcttcggacacttgtcagcataatgtcctgggtctccacagttgaaacataccacgggcttgctgccttgctccctcttggcaggttgttgctgtgttggagctgcaacaggacgtggagcttgattgcggatgttgttgccagcattgttgttgaagaactgacgctgcggacgaacaacagatgaagaacctccctgtggcatagactggggtcctaaagtaaggcgcggcttctgattactcccctgttgtgccttgaagtgagcaatccgacgtttcctctgctccatgcaattgtacttgtcctcctaacgtatagccttatccactaatttctggaaatcaggataatctccaaccatgagtgggtaagaaagctcatcattaagtcctcccaaaaacttctcctgacgctcttcatcattacgcacatcttccggagcataacgagcaagacgattgaactcgtgcagatactccgtaacagagcgagatccctgagtaagcgacctgaactccttcttcttgagagacactactcctgatggtatatgcgtcttccggaaagcagcagtgaattcaagccaagtgataggttcagcagtagtcctattcaggcggaagtgatcccaccattcagaggcagagccatgcaactgatgtgatgcaaaagataccttctcctgatcagtgcactgaagtaaatccaacttcttctctatggcatgcagccaatcaccagcttcaacaggattagtggtactagagaaaataggcggcctcacacgaagaaattctgctaacttattctgaggaggtgcatagttatttccttggttctgctgattctgaaattgctgcatcatcatgttcatgagttgtgtctgttgagcaagaacttgggccagagttgggttctctccattgttattgttattggggttgttggggccattcccattgctgcgagtgttcaccatctggcaggaacagggcacaagaagagaaaccggggaactacttaggatagagaattactttaacttttattgatcttaactgagtttcattattacaaactgaagactctcacaccactaaactcaccaacttcctaacactcaaaagcaaacaaacacatgcaattacatcccaccactgatgtaaatcacatgcgagccacacacaagcaaacttaaagcaaacaaactaacacaacgatctaagacaacgacttaacaagtcactctagttcttccaagcattggaggtcgattgaaggctcgttcggctcgtcttcatcatcttgggttgctacccactcaatcttggaatggttgcgcttggattcttcttcttcatcacttatgatgatgaccggaggatccgcttgggatggggcaacttctttctccaccacacggacctttggcgccaattgatagcgagggacaaataaagctctcttccttgcggtaagacgaatcctggccttctgcggcggtgcttctccctttaacgcggctaattccttttccaaacgatccaccttgtcttctaacttgcaaatcttaccacgattccggtcttcacgatcttgagccgctaacacagtctccgcacgaccttcatccatagcccacagcatctcaaccaaatgccttgtggtagcatcattctcaattccttcagtctcaaggtagctgccacggtcacttccctggggttgacgaggatggtagcgatactcagtgtcggccaactgatcactatagcgatcacggagctctcctatggcaatccttgccacttcctgacatgcatggatgtagtttcttcctccagcttcgaacatcactgaggggatctcttcactattgctgttcaaggtgactttgactcggcacttctcttcatgacgatcatgaggaatctgggcataaaaaggggcagtcccaaatccaatggcaaaggacatcgtacgcaactcctggacaaaaccctcaacaccaaacaggtactcaagcttgtagcgcggcatctaaagacaagtgaaaggagggagttaagacctttatccaattaatagcacaagtttttggattaatttgaataaagtttagaaattcaaagtaaaaggtaagtgaataaagtaaaccaaacttgcaagataatttgaaatagttgaaaacaaggttacaaattttgtactttttaacaacaggtttcaaaagaaagttataaaatcaacatgctaaatttattttattgcagcaagattaaataaaacaacattgtaaaacttttgctgataaatgagccattagtacagtaatggatgtacagtactaataacactggaataaattttgaatgagaaccattaaaagagattatgaagtgcatgtgccattagtttggtttaattaaaagagaaagggaggagaacagttctacttttccaatatttttagagggcttctatgggtaaccatttggcataacctagggtcaagggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgtataaaatgtcattacagaggtagatagttcctctcaaacaataaagatctaagcagcggaaaataaaataaacggcgcagacggctccactccacaggcagcttgaccaaggctactcctaatcctccactccatcagcctcattgtagaactcttcctctgatgaatgattgcaaggtgagtatatgacatactcagcaagccacgtagcaaatatgcaagtgcacaggataacaaaggatggcataatagggtttcatttgcaaaagcagcatttagcaaacatttcagaatttaacaaaacagttaattaatttaacaatattaatccaacgctatacaacataccctgttgtataggcccaaccattctgaacaaccatcccggctgcacagttctatctc

SEQ ID NO: 66752 - DNA, 5907 bp, Oryza sativa
ccagtttttggttgcaatgcttgtcatggattcatggcagtattttgtgcaccgctacatgcaccagaacaaattcctctatcggcatatccattcacaacatcatcggctgatagttccctacgccattggggctctctacaaccatccattggagggactccttctggacaccgtgggtggtgctatctccttcttggtctctggcatgacaccaaggacttccgtgttcttcttctgttttgctgtcctcaagacagttgatgatcactgtggactttggttaccgtataacatcttccagtccttgttccaaaacaatactgcctatcatgatgtccaccatcagcttcaaggctcaaagtacaattactctcagccttttttctcaatctgggacagaatactggggacccacatgccctacaacttagtaagacggaaggaaggcggttttgaagcaagaccactgcgagactagcttgaaccgatggaagtgtatagaactccagcaactcagtgagatacaatgctctacctccctttcatatgtttagaacctcatagggaccaatctaacttcgaagatgttgaagctgttcaagtactcccagattttctttttcgcgtcttgctggaagcaatacgctagtcgggatttgggaagacactgaagctcttgcgcgatgcttgttcttacacctgctgttaatctagttagatcggtcacctggaatgtgtgtggtactgtatggtttgtcttgatggcttttctccttgtcatggctattttttgtgcagagctggcatttacattgctgtgcagatagtgtatttggaatcacacttctgtatgtacccccaattatttatgtaactgaatatctgggcatggttggtaacttcaaagttcaaaccaatctttatctactactgtatagtagtttgtttgatcaattacagatcaactttgatggtactcatgtttccatttctaagtgtagcttttacagctgttgaaaaccaaagacctcctgaagcttaagcttgcatgttgggttacatattggttgatctggagttcatttcacttgaggcttgagaatgtttgtgtttcctatcataagatttgtgttttgcaacaggattttaattaaagataattatcatgtccaatcattattttcttgcatatagattcagtactcacggctaccactactcccttctgaaggagtataggcccttggacagtacatcatcattagggatgcaagcgggtcgacccacgagctcacttaaaggttaaataagtgataacccatgggttttcgcgccgtggcctgacttaccatgcctcgggatgcaagtgggttaacccataaacctatttttagattaaattagtaggtaactcacaagtcagttggtgagtacccgctaattttgcttataagcgagcttgcgtgttagcccgcttgcatccctaatcaacatcactgtcatccctaatctcatccatctcttatcgttgcagacggtttaatgggggattaaaacgcaaagcatgggacctctagctattagcggccaaaataggggccaaaatgcaaattggctcgttgcatttggaggcccaaaatctcaaattctcaaggcttcttccaacccacgaagcccccaaaaaaagcccaaaaccagtagcagcagcggagcggggcgccgtggactgacggcgacgtcgccggagaagcagaggcggcggcggcggcgggcgacgaaggcgacatcacaccgacggcgatgtgatccccgcgagtgatttgtgccatcattggatgccacgtcacgcgtcggcagttggcacgtcgacccgcgtcgtctcaatttattaagattaattaattactactacgactctacgagagtggtaagtaacaacgagtcatcgcagaaagcatcagctcacctgcgaagctgagatgagccccaggtgttcttctatttctaccggcaaattcttcgtcggcagaaaaaaaaatcaagagaacactacaccgaaatgatgataaagcaaaatattacagcatttgcatctcatcatctcattaatcatagtaggctgcagtattttgattatttactatattgattagaactttaacacatacaaccagatttggaatttgtgatttaatcccagatgctgtaactcaatagtaaactcatagaagtgaagtaattaatttatgtgtagaagaacaccaccttatttctattttgggagggattatgatcctatatacatagctaaatgatgagattttagagagggagagagatcgagttggcgctagaacccgcggtggccggagtcgtcgacgtcgtcgtcctgcgagtagaagtcgacgatctccgacaggtcggcggcggctgattcgtcgtcgtcgtagcccagcatccccttgtctccggccgcctgcagccacagcaggtgctcgaacagcagcacgtccacggcgaccgccaccgcgccgccgcgggtccgccgcccggccgccgcgaggaggcgccgcaccggcccggcctcgagcacggcctggtcgacgtggaacacgctcctctcccccttcgtcgtccccacctccaccctaatcacatcccccgccgcggaggaggagtcgaggcgccggtaccctccgccaccgccggcgccgccgcggcgggacgcagagcggaggaaggtgtagcagccggcggaggacggacgcggcgacggggcctcctcctcggcctcggcggccgcggcggcgtggccgtggcggcggtggtggtggtggggcatcgccgattcgccgggtttcgtggcttgcgggaggagcgaagcgattgctttgtggtggtggtgtttgtgtgggcgggtgtgtgcttcttttcttttcttggggtggggagcctttttatgcagtgggtttggaactaacggtcggcttacggggcagctcggtttcctccctcgttccatattggatcatgtgatttttggtttctttttcccttacattggccttgattgtagtgtgcttttttgttcttttgtttttttgaatttgttactaccttgatccaaaatgttactccatccctcccaaaattataggacccaaattataggacgtcccctttttaagaaaaataaaactcaataacttttgactaataattttactaactatatctatactgagtattattgagtattatgcatgttatatcattagattcatattttaaagtactttcatgtgatgctaattttatattcgttgggatcatagaatgaaataaaatattgattaaagtatgttattgaatatcgtgtaaaaaatataggtcttataatttgagacagaaagagtactatttcgtaccggataatgacgtatcttaattctacgaatctgacataggtaataatattttgagatgaatgtagtacaaaactttcgacaatttttcttcaaaacttttagattttcaactctctaagattcgtgttggaaccgaaggtatcaactattatatatgcttcaagatttgtgatgtatttctaacatgagtgcatccatgtgagtgtaattttgtgtcgtaagatctaaatttcagtgggtgaagttatacaaatatgattccaacgcgacgcttgtagtgcttcttttccctgatttttctgcatttttcaacacgaataaaaactagtacaaagcactttgtaaaaaaaaatcgtgcatttcaaacatggcttcgctaacaaaaaagtatttccacctaaccctactttgaaacaaaacaaatcattcaaagctaatttacaggtatcggctcaattcatgcgtcatttgcaaaataagttctcgatctttaaagagatttcactgtttagacaggttttgcaacaaactggtactgttcatgaaatgctacagtggccttggtgccatcaaccggacacgtaggttgtgtgtgttcattagagttggcgccatgtgcaagaatactgaagtagcaatggctcggtttttcagacaaccactaatcaccgcactgatctagtactccctatctcctaaattataagacataagacatatattttttatacatggtatttaataatatacttggatcagtattttattttattttatgatcctaataaatataaaattaacatcacatgaaagtagttcaaaataaatttaatgatataacatatatagtacttagtatagttatagttatagttaatatgattattagttaaatctatcgagtttaatttttcttaaaaaggggtgtcgtataatttaggaagtattcttcttataatctactgctccctatcagggtttcaaatttcaaaattagggtttctaccgagggggagcgatagaaccgaaatttcagaaattttagaattttttcgtacgaatttttttgaaattttgactaattttgaatggatttgaataaaatttgaccaaattcacaaaaatttacaaaaaaaccgaaagttttgggcgagatatgaacatttcggtggggggcgaaatttcggaaatttcgaaccgaaatttcaaacactgctccccataacttgattagcttaaggattagtacacgagcaaattaacgtcagaaagtggttgttagccggaaaaaaggctcctcggattgaggtaattaggccaaaaggagacccgctcaaattccaaaatgtttggtggagtatataattagggcaactagttaacagtaattttcaaggtgcaaaatcgaacgaaatgtcgaatcgtatttattacttcagacagaaccagtctctggggtgtttgggagagaggggctcaaaaacataagtcccaggctaaagtttagcctctctcttccaaacaccctctctagctacgtgttgtccatttggaatctgttaacttcagctggcagaggtataccatacccatcattcgcgcgttacatcgtcagtttgcgtgcaatcaactcatcgtccatattacacttggacgcataatcaaaggaacataaattaattcaaaaaatttgttacgacactaaacatatactgtactacttctatgtcgatcgaactgccacgtaaggttaccatgcttattatattcgattattaatttgttgattaattaattaaagagtctggtttaattagacgtacgtgtgcacacacgttgcgactcgtgatatgtttttataaattttaatcaggcagctgctgcctacgtggcctggcacgtggcgtcgtcgccggctgcctcgctccctgctccggcgaccgttcctccgggagacccacacgtgcgcccgacgtgtacaaccgccgcgaagaaaactcgcagctaatccatgctctagttcacctcttctactctcgatctccatcaccgattcaccgatcggtcgagtagggcagccatgggcggatcaaggaacaacaatggcgggaaaacggcggaggcggcggcggcggcgagcggcacggccaacaccgtcgtggcgctcgtgctcctcctcgtcgccgcgtcggccgtcgtgttcttgctgtcgccgccgacgccggcggcgacgcggatcggccgtcacggcgacggcggcccccgccgcgagccggtggagctggccatcgggctcgccggacacgagagctggctcgacgccgtccgcgcctgggcgaagctggcctgcctgaagctccggccgccggagccgcggtaaatctcactctcatcatccactgtcatgtcaatcctactcaggtcatgtcgatgaaatagcgttattggtttttgatttctttaaacatgtttaatc

SEQ ID NO: 66753 - DNA, 6793 bp, Oryza sativa
agagagttcgaatattgatatccacttggtaccctccaagttaatacaattgggaatcaagacagtgaaggtactgaatcatgtagaagaggatacggcgtttaagacttcacatcactgttagcagtatgaagtataaactccaacatttctactggcctttgtttaaccagtgagcatctggttcatgtagggttccctgcctatgcaatctagcctgtattatagatatttttatttcctcttgatttatgtgggaaattctagtctcgtagaattaatatggtggtttctttcaacattttgggctagtttggtttggttccaaattgtgccctaccaattcattggcaattttcaatagagtttctagttgtttggattggtgccaaattttaacaacacatctcttagatagtaaaagttttggccatccgaatttggtagtgccaaaagttgcccaaactttggcactaccaagattttggtatggcaccaaaccaaacttgccctttattttatatttgatagtagtactgcctttatatgatttatacaaacttttgtcttgatatatttactgaagttattgtatttatatgacactcttttactttctttcaggtattacacttctcctactggaaggaaactgaggtcactggttgaaattgataggtacattattatgttcgatttgtcaaatttcccctttgaattctttcactgcacattttatgttgctttcctcttcagctcttatggctggacaagtggatattgtaaataaatagaatgtaattcagtatgcccatgctctaactactcaatccatgctttgcaggtacctcttggagaatccggattatgttgcacagggtgtaacattaactcaattttcattccagattcctaggcctctgcgacaggactatgtcaaaaagcgccctaagatagtgaatccaaatgatgaagcaagtgtagtaacgaccaagtccgttaagccggaagaaggtgtgtaatggcgtataaatgaactcatcataactagttagcacataatcagtattaattctcaataaaaactttccatttgcatgctgaacaattaatgggtaagtcaccagcttcgtggttcactgccacgtcccaccaccctggattattatcccgattcgtgatatgcagttgatctggttcatcatcctgatcaatggttgggtcatgaaccggatcaccatcccctatggttgctacagaaggatataatagatatggaggtggggttcaagatatgtgcccgaaactagttggcagctatagattgggtaattgacctgagccatcgacccaatattaccggattcatgtcctgcatcgcaaactatcgtgctgaaaagatacccttccgtaccacatgttttggcaagtaaaatcctgtggccgtcaaccccgtcccttgaaccgattgaactgggttcgcgttgacctgctatggcttaaaatatatctacacacacagacccccaggagattgattggttagtattttgtcattatatggatttctgatcatgtagtccagttatctaataataaataattaaaagtaaacataagaagtcaaattagtttccttaaacttgagttgcataataactgacatgtgctggctagtggcgtgtactaaaagttactatgtaacaagctcgtgtttatgttatagaatcatactacttgctagatttatctttatccagctttgttttatgaaattagcttacgcaacaggttctataacagacacgtaagtctgtcttggatgtattgtattagtcattttggttctttccaagactaacttgctagagatcggtacttcctcttttagtgaattgatcgtagaaacttattcaacaatctcttcactcttttagagagatatatttatactataaactactcgagctgcccttaatttgttactgtatgtatgtccgctgaaggttagctctatagcatgccaaacgaactgcattcaccatttgtctgatcctatatgatatttttgccatttgtctgattccatgtgatgtttttttgctttagtgagccccatagcctgggcagcaccatcggtacatcaggagggtgaagctggcgaacgagcttctcatgctgatgagccacctgaagcagaagaactggagctaacacgaaaaaggaaagcggaaagccctctgttcgaagaggcacattctaaccatgtttctgatgaaccaaaaaccaagttagaggatactcaaaatggaggcccttcagcttgaagactgcaacacagtgataccttaagctccccatccatggttttattgattctcttttgcgcttcataatttgggggccagtttttcctgtaatgcaaggccttactggcctttatatgtatcatgccacgttggtgccaggttggaggctgaatctgactcaaaatcaagttttcggacacgttacaattgttgtatccaaaagccatgttggaactcttttcaggagtgtgctttttctagtatgggcctaggtaggaaacctgccgtgtaagattagctcctctccttgttttctctttgtaagataaggaaatgttgtagggacatgtttttcttgtatgtgggtttgatcccttttattatctaagacatgccatttctgatggtgaaatttctggttgagttcgtcaggcagtcaagcatggccaaattggagcatgatccatgcccttgtagctagtaatataatttctgtggcatttttggctgagcttcttttggaagttcaaagttggcaatgctcaacaatctggctctgcagcaatacatcagcttgtcttttttcactagttctttgttggcaatatgttatcttattcacttgacaaatactccctctggattcaagtatttgtcattcctttgttggcatatgttctcttattcacttgacaaatactccctctggattgaagtatgtcactggatattatgtacttttatttaatttcgaccgcctgtcccttttacaaagtttatgtacacttcaaggtataccatattggcaaggtgttgtgccataagtacaaccatactactttcatttatcgtaaattaattgtttgttaatgatcaaagctgaaagatcaatagcgagaagtaactgaggactgagtatttttacccagcccaaattatgacacacagcattatcacgcactgatgcatgaaaactattgcatgcatgctaaacagctacacacacctcaataacagatacacagcaagctcatcaaaatcatggtatgtttatcctgaatcctcctctttaaacatgtatatgtgacaaaaatcaaatggaatgaaaatgtacactatggtacaacaagggctacaacaaatttcccaaatcccataggcatcacacacacagttgacacttccctcaaaatccgctactcagaaatacaccaatgcaaaccacagctcctcacactgatgaagaatccgttaatctgtatagctcacgaggcaacagcaatggcaatggttggtttgcattggcaatagcgattgcagtagcaagaagatgtatacaacaacacattgggtgaattctttaccgtggaattggggggaattgggggtgatctgttctagctttgttgctgctgatcgtcgggcttcttgtaggaggggttgaaggcggcctgctcggcgcagtcgcggttgtcgccggagtgctcgcggccgacgcccatgaggtcgaggtagtactggtagtgcgagatgatgacgttcatgtcgtcgatgtagcccttgccgcagatctggtcgccgtagagcacgttcatggtggcgccgaacccggggaggcgcttggcgagcgtgtcgttcttggtgggcttccagttgcccacgaacacgtcgtgcgccgacggctgcttcttcttcatcggcgtcatccaccgccacatcgccgccatgaacgccatcgtcgcgttctgctccaggtactccgggtggtggagcaggtcctcgtgtatcccgtcgcccgccgcgccatagttgtagttcctattccgaatccgaatccgaatcaatcatcaaatcaagcgatcgagatggcggcgacgaagcgaagcttaccagaagacggggatggcgccgcggccgtagtactcggcgccctcgacgcagggatactgcaggttcgtcttgtcgcaataatcctccttagggctcatctcgtggttgtagcagagcccccacgccgtcggcccgccggtcgccacaccaaatccacctgcacacacacacaaatccccatcaatggcgagcttaaaacctcaaatccaaatcaaaccatagcgaaaacgaagaagctacacacatgaggtcttggagccgacatggccgaggaaggcgcagagctccatcatctgcatctgcttgccgccggtggtgcaaaagccgaggggctcgaagagggcggcggcggtgatgaaggactggtagtcccagaagccgacggcgtgggcgacggggctgttgcgcttggagaagaggttctcgaactggtacaccttgaagaagtcggtgatggtgtcgttgcagcagtacttgctacccgagcactcccaccccttgtcgcagatcttctcgcgcgactccttcatcttcaccttccatgtccccgccgtcaggatcagcgccaccgtcccgccgatcaggatcgccgccgccgacaccagcagcgtcgtcaggattatcttgttccgagtcttcctcttcatcctcgaaaatcaaccaagaaactgcctctctctctctctctggatctcgagcgagttcgtgggggtgaccggcgatctggatcttgggggggagaatgcggcaggtggtgggggatctggtggtgggtgggggatgaaattgggggggaggagtgtgaggtaagcgaggaggaggagggagtggaagaaagcgaagtggcaactgcagatgccgacgcggcgaaggcgaagctgctggtgaaggtggtgtcggtggcgggaggaagaagagaagaggcagcaagcgagagagctccgagctggtaagacgttgccgttgtgtgtgtctcgacggctgagcattctgtctttttttttccccttttaacaactgtctggagtttttttttttttgctttttttcgcgggaaattgactgttttagggtgaaatttgggcatgattttctcatcaagattcagatttttatctctattttcgttggcacgttttttaaactacaatatgtttcatataaacagaaaacctagacaacggtatcacgttaccttttatgagatagtacctgatacctgttgtggtacgagctgtatggtacccgatacctgtgatacctgttacctggaacgtatgatacttagggcctgatatctgtgatactcatgcaagagaatagttaatatgccttatcccgttgcaacgggatcccgttttgtagcagtcctcttcatataaaaaagttttatatagaagttgccttaaaatatcaaatatattcatttatcaagtttgtaataattaaatttaattaatcatatgccgatagctttttcattttacgtgcgtcaacttaattttcatcttcgtcagttttaaatatcacctttgtgtgaatttggttaatacaaaaggaaagaatatgatttttggaatatctgtttcctcacctgactgacagtcacggttcacatgggtttgtgaataatctaatggaatcgagtggttgatgtggggtaatcaaatcatgagggctcccaacaaccaatctgatcatggttttatacttttatccggtgatggcatagccggtctgtgaggactggggaagaaggatgactagaagagagtagttcccctattccaggctggatgttatatattgcagaaatcttctcgctgtcactgtgtatcgtggaggagtatcttgcttggtcactgtcactgtgtgttctcttgcatcccagctaagcattttttaacacgataaataactgtttgttgtagaagaaaatgaaagtatagatggccttatcgcccgaggcctatggtccggtccgaagcacgccattttggtccggcccaaacatggctcggcctaactggagtcgtgcctgtgctggcctgccccgacaaccgagccgtgcctgggctgcaccctcggtacggtgggccggcccgacccggcccgatcaaataaaaaactatagggatgcaaaatagacttaaataaccatataaggtaaggcccaaagagaagaggaatacaaaatagacttattttccagccatttcacacagcccacatagttgagggatgaaaaatagactttttctgtggagcagcacgatgggctatcgtgccttcgggtcggcccgacacgatccgagtagtattgggtcgtgcctgggccgtgttggcccgactagcctcggcccaagcacgaccgggtttgggccgtgccgtgccgggcggcccagttggccatctataaatgaaagtagggaagcattattttacagtgttctctttacttccaagctcaagatttattaacactaattaatttgtttgttggaaaagaagatggaattagggaaagcctcgttacttcattaaaaaaaggctaattattaaaccaactagggactatttcatgtcatatcatt

SEQ ID NO: 66754 - DNA, 11855 bp, Oryza sativa
tcggcatatttagcgaaaaaggcatatagcctagtggttatagtgacctgagtagcacccccaagtttataagttcaaatattcataggggccaatttcaaattgggttatttaagggctagttcttcttcattcgataggctaattttctatttaaaaaagctggatatatccggttggatatagaagccggctaaaaaatacatttctctaaataaaaaaaataaaaagtttatgtaattattaattattttattataattattttattattaaaatactttaaacgtacttatacaaaatttttaaataagataaattggtgaaacatgtgtttaaacgttaacctttaaaaaacgaagggattatgtatatattttgcaactagtacatgtatacatgttgtgttgcttgtgtgttttttgggccagtgagaaagtggcgtggtgctgttcgaggaacggcgcggcggtcgaggtgtgtattctcacggcggcgtgtgtgtgccaaggtacgatctgcgcagcccggcggcggtgaaggcggcggcgaaggaggccctggagatgggcaaggtggcggtggagcacgccgcagagtcggcggcgacggcggcggaggaggcagtggggaagaccacggtgaagctcaagaggaagttgtcgccgccgacatcgccggcgggggggcgcctcgacgaagacctgtgaccctgtgttctgtactgtaagtgtgacgtgttgaaaatgtgcatgcttttaagttttgagtaaattccctgtgtacccctgaaaactcactcaatgccttccatatccctgaaatttacccgatcccttctatgcccctgaaatttcagtttgatccctttcatgcccctaccgttacattttccattatttcactgttacgtttggttgcaaatgtcttttttgcccttgatgctttaggtttaaatgtaagcttcaaaaacaattgaaaattttgtttgattgcacagcatgtgcattttataaaactaatgagactaaataattagtgcagaaaattttgacataaattttgaaaataaaataaatgtaataaattaaaatttttatttgaaattttaataggataatagatttttttatctggagcatttataaaaaaaatgttgtgaacattggtagtcctatctttatttgaatgctcctcatttttatgacttttttataaaacaaataaatatgtattttttattttattatctaaaactattttttgggataaataatgcattgcacaacaaactcataagtataatagtctcatgcgagaagcttttatatttttaataatgtaattcatgaatttctttgttcatccaaggttaaaatggtcatttttatagaaaatagacggtcaactgacgggaggggtatgcaagggatcaaaatcaaaatttggaggtatacaaggaagtaaggaaaattcagaggtatagaagggattaggtaaaatttcaggggtatacaagggattttctctttagtttttctgtacccatgtgaattacagtacgatgtgttagcgtcttgtgatggatgatgatgcttggaagttggaaggtggattggagttggacgtattcggcttcagtactttggtttacaatctgcaaaagcaagcataataaaaatgatagaggaacaaacgcactgtttagggcccgtatagttccccaaatttttttcttaaaaacataacatcaaatcaaatctttggatacatacatgaagcattaaatatagataaaaggaaaaactaattgcacagttatgagggaaatcgcgagactaattttttaagcctaattagtccgtaattagctataagtgctatgtttagggcccgtttagtttcccaaatttttttcttaaaaacataacatcaaatcaaatctttggatacatacatgaagcattaaatatagataaaaagaaaaactaattgcacagttatgagggaaatcgcgagactaattttttaagcctaattagtccataattagctataagtgctacagtaacctacatgtgctaatgacggcttaattagtctcaacagattcgtctcgcggtttccaggtgagttctgaaattagttttttcattcgtgttcgaaaaccccttccaacatccggtcaaacgtccaatgtgacacccaaaaatttccttttccccaactaaacacacccttatcttgaatggtgatgggtgctaatcaaccgactaacaatataattatggcgtgtatgtacccaaaaaagtgacagaaatgacgtattatactattttttgaaggataatatagtacaatataattatgacgtattgtactataggagcatttctaaagcagaggaacaggtattgcagtacataccaggacagttgtcttccaatgcatagcaaaggttttaacttcaaaccaggctaaccagcggcaagcaaatggttcagatgcggcttaactacagcataatttcctaatttcctcacctaaatatgtagagagaaagagagattctctcctaggaaactagaaaaactcttctgggagtaattactgcttactactactagtaagtatgcatacaggtgagacacaggagaatatacagaacaaatttgatagtgttgagatgatgaggtcttgggaatggccaccactcattccgggcagatgcttctgaaaatgggcagcctgcgtccattgctttgaccataaagagtttgaattatcaactcttcatcctcctcaattggctctgcctgcgcagatgctggctgagctgaaggtgttgttgcttcatcaggttttggtgttgaaagctctgccctggctgcttggatgacagtatcttcccgtgatcgaatgtcagcaggtggcttgttggggatgcctcgagctgtggcagtaggatgatcggcacttggctgccatggggagaagagagaactgatgtcgttgaagtcttgataacctggagcacctgtctgcccgcccgcctattcagaagggaaaatggtaaaaagccatttattgtcaacagcgtgcaaaataatggtgttagcaatacaagtgccctgaaacaatgatgtttgtaaaccatatagcgtgctaccaatagatttaattgaacaatgaagctgaagaaacatgccaaccatttcatagaacaaatcaggtaatggatgatgaaaagaatagcatagtataaataactggagataatgtgtcctgtatcacaaatcccgacttatcaattacactgaaaaagaaattgtttctaagctcgtaaaacataaggcatccgttaagaaaaatgagaaggaaaaatcccacggtgaagcttaacagcagggctagatttaaaaagttacactggcaagtcgtcattacacatatctgtcgaaaactgtagtagtagttctatttgtataattgtaatgttctctggtcagcaacaaggacaactagtggtgagcaagtatgcaagtgcacaaggaagctaaaagaaaactggattgaaaattgttccttcacttcaagaagattagacaacacatgtctatagtgatgaacaagaaatgcaagtgcacaagctaacagaaaactggatcgaaaattgtttatccacttcaagaagattagacaacacacgtctataggataaatcatgactgtctgattctgatccctatctggatagcaagaacgattacaaaaggtaacatgacagttatgcactatttctcactattgaaacagagggttacttaagcacaaacagaattctcccactctttttctaaaaattctagtagtacactatatttctgaaatgactgaaaatgttaacaggacattacaagcacacatctcacaaaggcatgcaccacctagaatgaatgttatgtatgctaaccggttatcgccttattaaatgcataatcaaatcccatcatacagaataatgaaaacaacaacatctactttaattaatctatcaacgccacaattaaacataaacagttacatgttaattaatctgatgcaaaagatgtattggagacacaaatgccattaagggtgtggcctacatgtaccatacaacatttatgtagaacagtactaaaattagttgacctgatgtactatagtaatctgtttcctgttttctatctcatcaatcactacttcacagttggacttaaaatcgtactacatctgtaatgaagcatgaattgcctgcagaagcatatacacttctatcctaagctcctaatgatccagagttcggcaccagtttttttcttttctcctcccatttaagatagaaggaatgaaatatccgaatcatggaatcaacaataaagctactgcaatgccaaatcatggcattaacaaagatactagagtacatcagtgatcagtcgtgatttttttgcaaccaaatcagatcgtcatatttttatccgattgacccgaaatgcgagcgaaactggatctcgagagcaaatacagtgcgtacctgtcgcttggagtcataccgacaacctccagcaaccaccacgtcgccggccggcggcggcgggtacaccggcgcggactgcggcgagtagacgaggaggcggtggtccaggtcggtggtggccgcggaggagaagcaggcgcggcggtagcggaggagcgagtcgtcgagcccgaggtccatcccgcccgacgacgacgcggagccggagtacggggagacgccgtccacgccggcggcgacggcgtcgaaggccggcgtgaggtaggccctcagcgacggcgacgagaagcggcgctgctgccgccgccgcgccgccgactcggccatccacctgcttccggccggcgaggcggcgacgaaatcgaggtccatcacgacgcccccccccccccccccctcccccaatccttcgcctgagcagcaaaattagggtctctagtgttaaatcctcgagacggcgaaatttaaggaagagaaaatttcggatggggaaatttcaaatatcgaaccgaaaattagggtcactagtgttgaaaaaaaaacttgaaaaaataatccccaattttctctcgatggcgcatgcggccaatcaggcggttactagctcgcgattaatacgcaagtccaaataatattggtttcctgtggatttcttcgattggggaatcgaataaatttttttttaaaaaaacggcacaaatcgtcagcgaaatggcgtcatcacatcaggatagcacaagtaaagcacacatatactattcgtaaaatccaaaaacctcgaacaacagatcaggatctaaaaaacaaaaaaaaaaccttcagaaacgataaaattccggacacgttcgaacctctcccacacaaaagcgatcatcaatccaacaaagaaaaaaaagtaccaaatagcaagctttgattaaacaagcaccgaaaaaaaaaatccccaccctcccaaaaaaaaaatcgttagaatactattcgagaagtcgcagaagagattcaaacattcaaaactcgacggagagtgactcactcgatccgagggaccgaggcggagaggtcggctcacctttgcggccgtggaagcttcctccggtggcgctcgcggccggaaggtcacggtgacgccaccattgctgcgtgctcgctcgctcgggcgggaagtgaagacgaactaggaggaaaatacgaaggagaaaggaggagagcgaggtgggggtagaggatatgtacacgtggcccctacgtctcctcggattccgttattttggaccagggaggcaaggcagtagtggtccgttgttttgggcctggaagcattggttgggccgagcccatctcttggttggtttgggctggttggtattccttttggtttcggccttttctttcctctctttcttttctttaactgtattctcacaaaaggatagatttgactgttcggaaaagaggatatgcttgagttcatccgaaaacatcacaatttcttcatacgtcagttgttggcttaggccccatttgatttcgatttattgggtagattattgtcacagattatttaggagtacttgattataagaataaattaaatattttaataaataaaattaacaaatagcttaagacaagtggggttctttttttttattttgaaagacaagtggttcatataatatactagtagaagaaagtttattatttttaacatacatttttttaaaaaaaattgaagagcaaataatccattttaataatcgttgggcttaatcaaatgcagctcatactattatattgcaccatggaaaaggatggatgcacatccctagacaagtatcacatagaagaatgtatattgaaactggagtactggacaacacagtgagcatcaataaggtaacttcccaacatcagggagcacatacaatactagtagtacctaatatcacctcgccgtataggatcagccacatttgttcagtcagaaggaaactgttaaatcacactacacaccaaaccaatatattccgtacaacatagaaaggttacaagagttaattacacaaagaatagtacttattctatattttggatacaagctgtaaactctttggtacaccatcgccccttttaattcctgtatgatgctactacaacaccgccaatgcaatatgtacaaccaaacaaactatgagactcttaaaacaattgagatctcatatacaaacagctaaacttggatatgagatatccaaacttgatgcaaataggagtatgtcaaagaacctcctaacacacgctgaatagtaggcatgctgagggggcatgcatggcaggcttgggtttagatcccaggcacaccaataatgcaggaaaaaaaactgaaatatacttataacagtttcataggctattaaggagagcccttttgcaagaaggctgctgagaagtgtctggcctcgaccctggcgaggtcaactcaagcacagacagcaaaaaattcctctcctggaaattcaaataaatataaatgtaaatatatttgtcatatggttttttcaggtaagtattatatgttcgatatgaaccggccatatcatatgtcaagcagttgaaagcttacactagcagtaaattttggagtcggcatgtcatctgcgtacggcaggaatgttgggactgtatgagcaggcgaagtgaattcgatacatgaaggattgttacatttgacaacctcgcgtaacttctcagaagctggtgtttctgcatttgcttcaactggggtagttgtctgagcaggggaggctaattgaatacactgaagcctgttatgttcgagaacctcgctaagattctccgatgctgctatttctgcatctgttttagcttgaataactgtgtgtacaggagagctgtattccacacattgaagcaagctatcttcgatagcagcctcagtcaagttttcagatgttggtatgtcttcacctggtttagcttaaagaatttagttcattttctatatgtggtttaaagagcattttaccaaagtaataattaagagcataggttaccagggcacggttccatattattgtcttctgtgctcttatcatttgggcagtcctccattttattgtcaggaaccatttgtgatgtaacttccatgctagtttgtgaagaattttgcttgttctccacatcaatctgttcggtctgctccctgtttgcacagtaatggtagatagtgtcaacaactgagaaaatagatttaaccaaaatgatgaccagatgatgattattaccttaaatcctggtcttcttcctcttcattctcataggggtctacaattaaatcgtcaagatcctctaggagtgaagccattcccgacatactgctctctgacatgtcattatcatctttcttatccaaatgatgctgtagttgctgaaacaggcatagcacagtttatttcaaatagagtacaaggctgcaagcctaagttccaaatttagaacaagttggtgctgtcatacctgccaggcttcgtccatgctttggcttgtattttcagtatttattttcgttgctagggagcaaagcaagtcggctcgctgcaataaagtagcaatttttggatcatccttgttcaaaaaattaccctcatgcttaacgcctgcaattatgcacatagctgtgattaaagctgggacaagacaaatacatcaaactcaaatgcacattatagaggaaaacaggcttacaattctgttcccccgcaaataattgttttgctgcagttttagcaacaagattttgggtatccattgtattcatattatcttgattgttttgataaacaattgcaagaggctgtcgagaatcttgtgtgctcttgtcttgtccaactaatctcatatttggtgtcatattctctttgaaatcagaattacatggcctagttgcagaagagaaaaatgtaagttgcttcgcatgcttaatagaaaatagtgatgctagtgttatgtgtacctcatctgcttaataggtggtgcagagccacttgcaccagatgtgagacacccagtttgtaccaatgccctctttgaacttgtactggaacataatgatccattttccttgaatagctcgtcatccttggcccgccttttgcatagagtagaaaaccgattcttcactgcattatcagttctgttgtggacaaacaaacaaaaaacatgtcagatattttattacatgtatttttttcatcttgcagtaaactgcataatacaagaaacccacctgcctgagacaacctttgctatttcagtccatttgttcccaagaactttttgagcctgcatgacaattccaagtagagaagaatacatgattcaatcttgttaaggaatccatggtagaaacaaataattatgaaaacaaccacaaatctatgcagaacaggtggtttagggtttccagtatgcggagttccaagtctgtcagagcataaaacttgcagccaaaataataagaagaaaaatatgacattgcaaaactaatcaatgcgcaagcccatctagacttctcttatatatacaaaaatataaatcctatctcctgctatttacaaaagaatcccattcttttcccaaaaatctgaaaagctgcatacgtacatgctcaattccatgggcatagcaatatgcctggcctgttgtctcactgaggaagtaaccgaccgcatatttgccaattcagaaatctaaagtttggcccaaaagttacatcacaaatggttcctaataataaaatcaaagtgtctgccaaaattcccaaattcatgaaactgacgcatatttgccaaatcagaaatctaagtgttttatgcagcaattcctaacttcagggaaattcagtgtctggaccaaataattaaaatgtcacaatatcaatatcccacctcacacaatagcaagtcctcttctctggaccaccctcctttcttgcactccgagttcaaataattgtaccatctgcagcagtaaccaagcaaagaaaaaatgaacagggcggcatgcatatttcgtaaaaaattcgaacgaaattccaataaaaccactcttttagtcagaggatggcgaggtacactgtacacaccttctcctgcactgtctggccgtcttgtccttgaattgtgccgctataattgtccagctaccgaaaggaaaaggaaaaacagtgtaaaatatggtgattaaatctagaaaaaaaaagtcaattgagatgggaagtgggaagaattcatacttatcagttccatgaagcgcaatttgagtacgaagcacatcatcctcctaacaggaagaaaggtgcaaacatcagaaaaacaatttggtctaaaagttaaacaaaaaatcgcagacgcactcccaaggaaaggttcgacagcatctgaagctaacaattataattatattataattataattaattataattatgtaggcacaagttcttggaaatgcaatacacttttcaaaaagaagaaagggacacatattcaaacttcgactattctcgatgctcacaaatatcaccttagaccaaaaaaaataggcaggagtcgaatcaaaccaaagtccatttagatagattatgcctaactatgtgaaaaatctactgttcgttaggcaaaaagaaggggaataattgctagaggcgtcgagaactaattcgacccccatgttctaggcatcgaaatcgagcgggaaaggcacaaattccaggaagtgtgatgcacttttccattatctaaaaggtacacagattcaaatttcaattatcctcaatgctcacgaagaatattgccttaaaccatagaattaggtgagaggaacccaaccaaaatcttgaaaagtagacacaaattcaaactccaattattctcaatcctcacgaatatcgcctaaaaccacaaaaattaggcgcgaggagcccaaccaaagtccatttcgataggtcatgcctaattacgtgaaaaatccactgcatattagcccccaaaaaaataaagaaggggaatgattgctacaggagtggaaccccaaaatttcaggcaaccaaatcgagcaggaaagcgcaaacgcacccaaaaaaaaaactcccaaaatccagaaacacacgactcgatagaccacgacaactcgtacgcacctcggtgctccaactcacgatgtggcggtccttcttggccgccgacgccgacggcgcttcggcggaggcggcggcggcgggtggggtcagatcgggtccggtcgccatggtccgggatcccgcatgttccgcgcacggatcccggcaggccgaggtaggcagccggcgggcggcgggcggcggcgagccggggccggctagggtttggggaaatgggcgcgagtggagggaatttttgaaccgtggattcgagaggaagacgacgacgacgaccgagttgggttgggttgggtggagaggaggaaacgagagagagggggggtggagtgtgagatgggggtaaagggaattttttgtgcggaagcggaggtggaggggtttttaaagttggtggggggccatatggctgttttgggagaagatgatgacgacgactcgactccctacagaatggcggcaccggcacgtgcaggtttttgaggatggggcaaagggaacggtaaagaatggcagttgtactggtttgtaaaatcaggttacggtttgtaaaatcacgcttctgataggcaacaatggattgcttcctaaaatgatttgtatatggagtaggtgattatcttaaaaatatgtagtaatgattttaatttttttttggaaaggttattaatgggtctattcggcaatgctgctatgcagctgtaacggctgcgctgtacagccagccttatatactttctctatcatgcactgtagcacagctgctgcacagcagctgcaatttagctgcagcgaacaaacccaatagtcttttgtcatttgagagatactcataagattcataccggtggtcgaataatgatatcctaaacccctactaatatattcaagccgtataaaaggaggctatagttgtatttcttgtatactctacctcaatatctattagaattacatatttcctacttcctccattttaggttatataagacgttttgactttagtcaaaatcaaattgtttcaagtttgactaaatttatagacaaatatagtaa

SEQ ID NO: 66755 - DNA, 26642 bp, Oryza sativa
tatacacgagtaaaatcaaacgcacatatacagtcacattataggcaatggaaggacaatcatcatcactacattatgcatgataattaggagtacaatgcaaaagtgcatcatatatactctcttcgtccttaaatatttgacgtcgttgactttttgaacatacttgaccgtttgtcttattaaaaaaattaagtaattattaattattttcctatcatttgattcattgttaaatatatttttatatatacatatagttttacatatttttttaaaaaattgaataagacaaacggtcaaatatatttaaaaaagtcaatggcgttaaatattttgggacggagggagtagtgtgtgtgtgtgtgtgtgtgtgtgtgtgtgtgtgtgtgtgtatatatatatatatatatatatatatatatatatatatatatatatatatatatatatatatatatatataatgcacgtatacgtaatatattctatctcaggtatattcaggtaggatattttgggacggagggagtagtatatatatataatgcacgtatacataatatactctatctcaggtatattcaggtaggttaattatgaacatatacgtactgccagcagtgttgtaccagctatgtacatgtgtttttgtacgtagagtacgtagcatgtctaggttggccgagttggcttcgtgtctgccacgtacgtactttaatttgtaattataccggccacagacagctcaaaaaattaatcactaatttctagctatgcatgggtgtgtttgagaggaggtttaatttgcaatttttttttttgcccattcaatgagttatttaaaaagataacattgtttcaattcccaactggattaactatattgagttctggagtgaaggttacacacatgatacatccattcttattatatttttctgggtttcctcaaagtaatcggtattatcaaatggctaaaatttctccgagttttggctatcattggccaaaaccacacctcatcctaatctcgctatatatgttttgctactaacaattggtcctcatcaatgatttatagagaggaagagcccaagtggacgcctgagtcctgaccagcctgagagctagctctgccgtgcttgcctataatttctcctcaccggacagatgctatggccctcttcttttctccaacaaaaatcagataaaattttggatacttatgacatattttttgaactgctaaacggtgtttcgtgtaaaaaatttctatatgaaagttgctctaaaatatcaaattaatctattttcaagttttgaataattaaaactcaatcaatcatacgttaataccccatcttttttgtaaaatacttaatcttaatctttatcttaatcttcatattagtgtatatgttacctaacctattcattgcttttaccttccgactatggcccgatttagatccatgggtaattttttagccctccctcaaatagcccaaaagtttcaaacatgtgagctatttcagggctatttggaaataacctaccaaaaaaactatcctcctcaaggggtgctaattggggctatttcggatggacccactgaaaaaaagtgccttctctcttcatggaaaagtgcattaaatgctaaatagctctcaaaataacccttggatccaaacaacttaattagggctattttattaaagggttatttccttgtgctaaaaaatagctctcaaaataactcttgactagttctccaaacatgccctgtatatcattgcgccgtcacagagagtggtaaagcctgggcttggccagcatgagcggcttcacatcccctgtctttgggcattacggcaaagtttgctgttcctccatcccaaacgtccattccatacctacagctagattttgctggtccatacatatatcacctcaaaaaccgtcttcttctcaaaggaagacctcttagacgtcatggttgtgtgacccactgtagttcaattttgttgaatgtgaccatcatgaatagctgaatcttcaagctagactttattatccacaatacaagatcattagggattatatgtgtgtgcgtttaacaaatgtatcaatttttttcccagtagacatggaacaaatgagtctgatatcaaaggcaactctagcaagcgtttaatcaacgatgtgtatttcgttacgttttgctggagaaggaaagcaatttcttaattgggagggccagcaaaatccatctgtaggtatggaatggacgcttgtgattgacgaacggtaaactttgttgttatgcccaaaggcaggagatgcgaacccagcacgggcaagtacgtgcctaggctccgcctcatgaagcagcaggatatatgataagttattttactgcttaattaacctgctatagtgatagttctaaattctaatggagtgctttatctattatttttatacttaaattgtttgcactctgttgcttgaaattaaagttaaagcggtaggattatattctctaccaccattgttagacttacctaggctcaagaaaatttttggatattcacatatactatattattggattatgacacatgcacatgagctaaatcgttaggagatccagatcgaggtaggatcgattaaatatttatatattaaaagaaaatttgaaaaagttaaccgcgaaaggattgacttacaagtttacaagcagcgctagtactcctcaagaattctgagacagatcaaatatataaacccgtccaattaatgcaggcattcgtccaaattaaacttccatttttgaacggttcgtgaattcaaatcttttcaaatatggcatataggagtaacatgcatgtcaaattgcactaacacaattacatgatgagtttatagtacgagcactttgtgtacaggagtatatatatatacgatatgatatctagagtacatatatttttgctagttagatatatagcctcttcaattcacagccgcaggtccagccgtgcgtacgtacatgcgcattaacattaatgaaataattactcgcttcgccgagccaaataaaaagggtttaaaagtgaacagtaatttcgatactactccatccgtccttaaatatacggggttttaggacacatcctatataatatgtgggagggagggagtatttgctatatattcgatatggcagcacccagcgcccgcaccatccgcggccctttcagttttccgatcgattatgggtatagtactaaaacaacgaacagaaaattaacgagatatacggtagtgattgctttcgatatagtattaattatctccgttccatattgattatagattagcgtgctttttgaaagaatgaagtgaaattagataagagataattatagttagttgagaataaaaaaacaggtggaaaagtatctatatactcacttcgtcccaaaatatatataagaaattttagatggatgcaacatatcgtacgacaatgaatctgctcctaaatagatatggaggtaacaaagttgatgatatatatatatatatatatatatatatatatatatatatatatatatatatataaaacatctatctattatataataaaagtccattaaacttcctacaaacgcttctaagccgtcacgtggcatcctacaaatactcctaagtcgtcacgtggcactataatttagagaattctccagtggtccagccattaattttcattaaattagtggacccattatttaccaccattagatttatcaaaaaaaaatttcctaaccccaaaccgggcccaccatggacatgtacgtattactatatattccctccattccaaattaatctatatatagttttataaggttactcctaaatgatctacatatttgtattcatttattaagtctattcgttatttgtgcattagagtaaatggacattgatgcatgcatccatgcacacaagtatttataacccacatgtaatatattgatttgctattggctagaaaatagtggggatggtgcatgcatcgagtttgttgctagagtaaatatagtatgagagagttattagcttttcttggctttggtaaacctattaaatatataaatcgatttggaatggagggagtatatgtatacgtacaacttttttaaggatagtacgtacgtacgtactttcaccccttcttccctcaatttcttatatttttgcacatatttattctcctattatcatactttattagctagaaaaaaaaacttttgtgctgaacaattcaacaactataacatctaaatcataccacaaatttttaatccaccgttgacaataaagtttaactggcctacttaccgataaaattatggttcaggctcatcttgaggagcacgactatatcacgggaatttagagaattctctagccattgattttcattaaattaatggaccaattatttaccaccattagatttataaaaaaaattcctaaccccaaaccgggtccaccatggacatgtacgtattactatatgtatacgtacatttctttaaggatagtacgtacgtacgtacttgcaccccttcttccctcgatttcttatatttttgcacacatttattctcctattatcatactttattagctagaaaaaaaacttttgtgctgaacaattcaacaactataacatctaaatcataccacaaatttttaatccaccgttgacaataaagtttaactggcctacttgccgataaaattatggtccacgctcatcttgaggagcacgactatatcacgggacccatgaataaggcattagcgaaaactccttagcggcaatagtcggcttcacccgatcgtcagaggagtattcatatataagtttaattgttttatccaattaattggtagaagtggtatttttaaatatttatatataaatgtggacatctgtgagacatgggtatttgggtatgatgttgtcggtgacatggggccgggagtatcgtgactagaggcttgggtagccgcggtcacccacgtggcctgaccccctcgggggggtcgggcccgagggtgacgtggccacccctccctctgtctccccgaggggtcgggccgctcccgtttcggccccgagggctggggcgccccgaccccctgtggttttggcgccacgtgtgtgggttaggtgagcacagcggggctcacctaaccgcatttatagcgggttggacgagcgcgccacgccgcatttaatgcggcgcagcgcacgcttatccggtccgtgaacagtcgcggcgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagcatggcaaggaagtcgctggccattgaatgaaggttgaaacgggcgtccaccggagagctgacaagcggagcagaagacgtgcgctgtgcttgtcagaggtcacttccggttgtagactagccctcattgtaaaaagaatgtttcttttcttaggcagctagaggcccatgtggtgacccctaaccagataaaaaggaggcccaggcctaagaggaggagataactctggccactcggttctagagtctgaactctctctcgctgtcgagctctctgtattccttcacacacagatccaccagaacacaggagtagggtgttacgcttctcagcggcccaaacctgtctacgtcgcccgtgtcttgtgcgattcttctcgctgacattccttagatcgagggcgaagaacctcacttagcgcccccggccgaaccggcaaaggggggcctgcgcggtctcccggtgaggagccccaagctccgtcagatgtggatattaacttttttatggtattaataatgtatttggtttattttttatagagctgcaattccatctatgaaaaagaaaatgaaaataagttgtggtgaatgctgaatttatatataaccggaataaagtgatttttgattcgatatgatagccattttgatcatttagtacatatcaatggtctatttcttatagtgaatatgatgagataatgcttcttttagtattgtttttatagacaataaataaattgcccgcgcatcgcacgggcttccgtcctagttgtaataatagccagtgagatctacatatatattgagtactccctccttttcaagttataagacgttttaactttggttaaagtcaaactgctttaaatttgatcaagtttgtagaaaaagtagtaacgtttttaacctaagacaaatttattatgaaaatatattcaattattgatttgatgaaactaatttagtattataaatattattatatttgtctataaacttagttaaattacaaacttagtcaaatttgaaacagtcatcttataacctaaaaggatggagtatataatacatggagtagcttatctttatctttacctattataaaagtttaagatgtttttgccaaaaaattttcgtacgttgtccgattccctcctcgcgatcttttttttttgcgatttttccgtgttattttcctgtccaactccctccccgttcccactcgtgtcgcgccacagcgccagtaccacataaggcggatgttgcacaaattcaaatacgtgtggcgccggtaccacataaagcggatgttgcacaaattcaaataccgatacaaaatccaatcggacattgaatctagagaaaaagaaaacgaaacaagaagattaaaaaaaccgcacaaataaaaaaatcgcacaaaaaaagcccacgaccggctcaaatcgatccaattttcttcattgagtacttcaatacccattcccaaattgaagatgaatatatgaacaacaaacaataatccccataaccttatttcaagatatgaacaacacatacaaatccttaagattaaaaaaacatgaataaacatgaacaaatcacatgagtaatttattatcatcgccatcatcactgcttctgcttctggtgtgggaggaagaacaggagggggcggcgtcaccatcgcacctcccagatcggcccatctccgacctccaacactaatggatcagacaagccaccgccaccagaggaaagtagaggagaagaagggtatttgtcgcacctgcagcccgttgtcgccgtcagctcgctaccatggcggtcgtcgccggttgatgccgtagccggtggcgggaggagtccgcaagaccgagtcgccatcgccgccgcctcgagtcgcctcgcccttgccgggaagggtgagtgcaggaagaggaggagatggagtagaagaggatggatctaggacgccggaccgccgccgcctcccttcccactggatccggcagaggggagggcgccgcccctgcccaccgcctcccctcccaccggaagggagggcgccgccgcttgccaccacccgtcaacatcgagccctcccgcggccccatggcgagggagaggaggcgagggacagagaggcgtcgctgcgcggaaggagagccgccgacgccgaggagtagcttgccggcgctgctccccggctcgttgcgcaccgctgctcctgctctctaggcatcattgccgcgggacggcgggtcgtgtgtagagggagagaggaggcgtggagaatgagagaggagaggagaggatgtgtggctggcgacaggagagagacggggaaagagagagagagagtaaacgagagagggtggatagagataatgttctttgactagaaacagtcacgatattttctaagtaacgtactgtaccagcttctgtttttcttatactccgtttcgaaatgtttgacaccgttgactttttaagcacatgtttgaccgttcgtcttattcaaaaacttttgtaaaatatgtagaattataagcctacataaaaatatatttaacaataaatcaaatgattggaaaagaattaataattacttaaattttttaaataagacgaacggtcaaacatgtgctaaaaaatcaatagtgtcaaacatttcgaaacggagggagtactaaaatggaatctatgacctagatatgctattgattgaattgaattccgctgaaaaattacagtgggctgagatacacatatatacttagtgttgttctctttaattattattttctactagcgaaaagactcgtgagttataacgggtgaaaaaatatttaatcataatatacgtttttcatgcataaccatgtcaataacaatgtttgtatggatcgtttgcagctgagacaataaaaaaattagaacatcttcaatgtaatctcgcatgtttttatttaattttttttacctacgatggaaatattttttttctcgcatatttttttattatttatagaagacagaaaacattattttaacgctttttctgactttttttcttacgtattttttaaccgtttttattttctcatgctttttttaagttgtagaatgaaaacttctcttttgagtagttatattagattagagatagagaaagatatatactgtctacaaaaacgaatagaaatcggacttcttttccacacttttttttccaccttttttcacacgtgattttttagtttatacgagccattttttcgtcactttcttaggaaatcggacaaacttttttttacatgtttttgtggtttttttatttttcgccttttacaaaatcagacttttttccatttttatgggaatcggatctagcttttttttaaaactttttttcacctttataggaatcagatttctttttcggttcggatctacgtttttttttgccacttagtggaaccagaatttttttagttgtttttcgctattttttttctcagattttttcctttttagggggaatcggatctacggttttttttcaccacctttttaggggagtcggactttttttttgttgttttttttgctattttttttattttgacggacgaaggaaacgttttgaaattttttaagtagtagaaattgctgacaccaaaatcaccaaaacttttctactattataaaaattgaagataattttaccagtactctggtacgtcattcgtgtataagttgatttttaaccgtattgaaaaatacagttcgttcgcttttgaaaatatagatctatatttgagtcgggttttaatttcgttcgcttttgaaaatacataagaagtcgtataagaaatctcttgaaaaaaaactcgcgtgctaacttaacatgatttaatctcttgaaaagaaaaacttgcatgacatgattttctagaaaagtatatatccaagcaaattctcacagtaaacaataataagattataatagccttcacccgttgcaacgcactggcatttgttttaatatagctcatattcagactatatgtttgcacagtagatgtttattgattcttacgtacacagtacgtacatacgtatgtgcgtacgtgcatgtacgtacggtacgcatgctcttcaatggcaggcaacgcatgtaatatgtatatatatatccggcgcctgctcgatctctcgtactgaaattaatttaacctcgacgtaagtacgcgtactgtttattacttgggcgcatatatgatggctcgtaattagttagtggtggtaagtgtcaaagtacactcctgtcagtagtgtacgtagtagtaaatccaccgtgtgtatattaactccagtgttaattgtgctatcacttgtggagaaagagtttatagtcccggttggcaaccctctgtacgaatccgggattaaaaatgtccatatttagtcaaaaatacatcttttgtcccggttaatgtaaccaactgggactaaaggcttttttcttttttttcttttctcacgttcaatatctccaaatcattataaaaataacaaataacaaatcacaccacacaacacaaataacagatagcatgaatcacatatagttcacatatcacatatcgccccatatcatttacaaatcacagatcacatcacaaatcgcagatcgaacagatcacagatcgcataaattatagtcattcacatcacattaagaaggaaaaaaaagaaaaaaaagagtaaaatttcccatgctggccaccgccggggcagccctccgcggccctccgtgcctccgccgcttgctgccgccggggcggccctccgcgcattcaccgccgggcttccgtgcggggcagccgccgctgccggccgccgccgccaggaagacatgggagaggggaaggggaggaggagaaggacgaagaggagaaggagtgaggaggagaactaatggaggagaagaaaagctaaggataagactgaggagggacagacagatcgacgcgccaagagataaacatcgcgccggcttggagtgatttttagtcctagttggtataaacaaccggaactaaaaatccaaccgggactaaaaataattggggcttgacacgacctgacaacttcttcaaccgggactaaaaatgatcttaccaaccgggactaaagattaaaaaataccccttagcttttaaaccgggactaaagaaactttttagtctcggtttttattgaaaccgggactattgtgaaatttggccgaccgaccaaaaatagtttttccacccgtgtaccatacatggacaccatccatgtatactccattattattattaagctttggccagcagtttgtagcctacctacctcttcgtaattaatttcatactctaaatttagttaattacttattagagggcgtgcttattccgttcgtttctgattaacatatagattttaccttaattttcattagtatattttttaaattgctaaatggcatatttcgtatgaaaatttaaaatatcatataaatctcgtttttaagtttgtagttaaaacttaattaaatatgtactaatgactttcttattttacatgcatgttagtacttaatcttcatattcagtattaccgaatggggtctcagaggtgcctatattgtcttttattatatatatacatggctcatgttgtattatacttcatgatgttcgttaacatatagcagtattttccaccgtcaactagcttactgaccgcgggggggggggggggggggagattaatgtcagtaagatatacacatataaatcgttcgtgatttttatatgacactctctaattaattttctatataaggattatatacttatctctactactctaaaagataggtttgtccatccacccctatcatctgttctattcaaggcattccctctctcaccatgcatataggtcacatggaaatcaatatgggtgcagctaaaaattgtcacacactatgatcatattcaatctatgatcgtagattcgtagtgtgttatatctataatcctgttacaaatcacgacagacaccttagtcttagtaatttatttaaataatataaaccattacaaaatgactacttttactcggtcattcggtgattgattagttaatcgactatagatacaaagcaatcagtttgattaacttttaaccgcagtcatcaaaacaccgacactataataggagggtttttacttgtaagttttattcaggagaaatgtgagtggccggaggagttcagcttggaagctagcttctgtgttccaagaaccatacagaagacgaaatattcgccgcgtacttaaacttttcttaaaattttcttttaccacccaactttttattaatactccctgtcgattgatatatatttattttatctttgatttgactgcacacggattattactagtactgccattagttcccctcctagagcaagcaacattgtccctcatttcggtcccacattttggagaccttgcatggtgatggaagatacacgtacatttgctcctcccttttttttaatagaaaacgttattgatttttcaataagacgaatgatcaaacgtgtgacaaagagtcatcgacattatctattaaaaaacaaatgtagtatttaattactactagaaaccaggaaattacatgcattttcgaatgaatttgttcatttctcatgaaaatccttcaaaattcctcctttctaattaagcttctatatgaaatatttaacatgatttttttagaaagtgtactgattaattgatctataacaaataaaagccattttgttttactccaaagctctttggtctatgtcttcaaaattcctcctttctaattaagcttctatatgaaatatttaacatgatttttttagaaagtgtactgattaattgatctataacaaataaaagccattttgttttactccaaagttctttggtctatgtctatatatctctactaatataaaaattgaagatgcttttgccggtattttggtacatcatctatattaatttgagtcagtttttaagttatttcacttttggaaatagagatccgtgtatgagttggattttaagttcgtttgcttttaaaaatacaaaagaagtcgtataagaaatttctttaaaaaacttgtatgctaacttgaaaggaaagtcagacttctaattgaagctcatgattttctaaaaaaaaatccaaatgaattctcatggtgaatttcatcctagctaaaccgtataacaataataagattaaaatagcattcacctgttgtaacgcacatacattttttctagttaatatataaatgacaaactaaaatatatatgcacgcatgtacaatactactaattggagtacctttgtagctgtgttgatcggtagcataagccagacacacacatatatgcatccctacatatacgaggcatacagaaattatagaggctatacgaactatagtactatcgacaatataaatatatgaatgtaaattgagaaggtgatagcctctactctctgcctcaaaataaataaataaaatatagaattaatgtgacgtattctaatactataaatttaaacagaaatactaagatatatcacatccccgtattaggttaatttatttattttgagagggaaggagtttcttagctggttaattaattactagtagatattactatatccctaatccatggccattaatttacatcatagtagtattgatcatgacaatcgtccttaaaaaaaaatattgactgttacccttacgtgcagtacattgacaagtacatgcatatcatgtattataattattgggtcatcaatcaattatatcgatcgatctcattactctctctctctctctctctctctctctctctctatagatttgtttttgtgaggtctctatctcagaatctgtttcatcccgtaaaattatatacgctagtaagtagcctgcatatatgatgcattattcccaaatcatatacagagatggtggactgatgcacatgggtacgtgtaaactaattaagccttctagctaggtccttaatcaattaccatgggggaactgatgacaaatgaaagagaaaatcttatcagatcaggtctttttagtcagggaggtgtgtgacctcatgactggacacggagagatcttagtcagaaaaattcaccaatgtgtaaactcagccagtcattctttagctaataaggctcgttatgaagctggcttaaaagtttggttagagaataactgtgacgagttactacatcttgtaagagttgatttaaatcctgaataaagatctccccttttacccgaaaaaaaaatatcaaggtgctagccatcttagatatattaattatatattttatttttttctgtttgcatcaattggtgtaggtatggaaggcgcaaaaattaattactctactgaataaatgtccagattttttttcttggtaatcatcagctgggttgaaagttgaaattaacaaacactctatagctagcaacgagacgatctctgaggctccctatttcaatatttgttggctagctagcttgctttcatatacataaatttgtctgccaatgaaatgaaactacagttcgatcaactacttgctgttgtacgtgcaaaagatcgatatatatgtatcacacatcacgtcggtcgatcgagagcgatgtgcatcttgaaaattgattgatccaccatagctagatggacggagcaataatgggtgacaatcataaaggagaaaattccatcgatctatagcacaaacatcttatcagtaccaatatatagaattgagatctagtgcagtcctaactgtgacagcaagttaggaactacacatcatctcagccatccattttttcaatgaacggtctagatctgatgctatagtattgctgctacagtagttatacagtttttttagacgtgaacagtattttgtagattttggaccctcagatttgcatcaaaaggtcctagtgtgactgcttaggttacagtcacactaggtactgcaccggatccaaatcccaatatataaataccataaaattcccccacctttcaaaaaatacgatatgtatcacacatcatgttgatgatctattgattgagagtgatatacatattgaattgaagtgcgatgtaatgtccatgtatcgctccttgtctttctagctgataataaaaattcaggtgggaaaactctttccttcgatgatatattgtaattgattgatcgacggtagctatggactcatggatggatcaatataatgggtcacgataaaacgtgtgcctcgcaacaacggaagtagcatcgaattgctccaacttccatagcttcctcacagactccatagatatgatagcacgtactccctctgtcccataaaaaacgaatctagaatcagatgtaacatattctagtacaataaatctgagcatatgtatatccagattcgtagtactaggatgtatcacatccgatactagattggtttttaagggacggagagagtacatctgtggagtagcaagctaggatgacgtgacggcactcacttgatattactttttcctccgtctgcgactttaggatcggatttatgtatttcaaaccctgttttaacattgtcaatatatattatatgtactaccttcatattttaatatatgacgtcgttgatttttttatttagaccattcatcttatttaaaatttttgtgcaaatataaaaatatttaaatcatgcttaaagaacatttgatgataaatcaagtcataataaaataaataatacttacataattttttcaataagatgaatggttaaacgtatcttattaaaaaagttaataatgtcatgcattagaaaatagagggagtaattaataaagtttacacaaactattggaaacatataaggttgattgttactggatttatcatgactgaagtaacatattttcagactctgtcgattgatgtcgcaattaaactctacttgtatttctttcggttcgagtctgagagagtatgcacctgataattaaactaatgaataagtgcatgaaattatggaattacttgccccaggtggggttttaagtagtatattatagtgacaacatggttgtttaaaacattatcccaatgacaacaaccatggaatgattgagatgagaaatatgattaattttaattagttagcactactgtactagcatagcaaatttgaagggaaaaagtccacttagactcccttaattgttcaccgaatctaattcgtgaatcttaactagaaaaccgggtaagacgactccccgaattagtgaaactagtccaatttgactcctccggcggtattggaggttggttttgctgacgtggcgctgatgtggcggtgctaacccggatttcatgccacgtgacgcttacgtggcattagagttaaaacaaatatctatgggacctatttgtcattcaaccaaaaattattgtgggacccaccggcccacaaagcatcatttctccatcctttcttcctcctccctctctctcccttctctcttttctctccccattctctctctcccttccaaatcggcggcggcggcggccgggggccatggcggcggcgaggttggggtcatcgacggggagaggcgaggacgcggttgagcatgagcccggcgccctcgatgagggcgaggagcatcccgcccatgagcgcggagcggccggcggtgttgaggccctggcgcatggagaggaagccgctagtggcggcgccggcgatgatggagttccacagatcctccttctggtgcatgaagaccttggtgcagtcgaaggcggagaagaggtcgccccacaccgcgaagctgtcgcccacccgccgcgttcatcagcacggcctgcgcgccgccaacgaggcgctcgccgttgggggagttgtaggtgcccttgaggaagtggaagagggagcccctaactgtgcccatcccgaaaggcctgcccacgtcgtcggctgcacgggtcagaccgggcgccgcattagagggggcggagtgggagcagcggcgggccggcttggagacgggataggcggtggcgcggccgtcaccggcacgccgccgtcaccgctctagccctcgcccgcgcgccgccgtcgccactctggcccccggccgcctccaccgccgatctggaagggagagagagaatggagagagaaaagagagaagggagagagagggaggaggaagaaaggatgaaggatgacatgtgggccccacgtgtcagtgggtcccacaataattttgtgttgaatgacatatgagtcccatatatattttttttaactctaataccacgtaagcgccacgtggcatgaaaaccgggttagcaccgccacatcagcgccacgtcagcaaaaccaccctccaataccgccggaggagtcaaattgcactggtttcactaattcggagagtcgtcttacccggttttctagttaagggtcacgaattagattaggtgaataattaagggagtctaagtggactttttccaatttgaagcgctgatatcaaagttgctcaaagtgtacaagcatgttgccaatgaattatgggccgtgattttatatctaactgggctttaatttggtgttgggcttcaatttagcttcagaggttgggccacttccagatttttaataagtaaactgtactttaaaaaaaaaaacaagcaataccatgccagatggcagcatttttttttccagaaggtacactaatttaatctgctgctgcctaacctttgaattcaaattagaagcaattccactcaattccacccccattcattcaaaagtggcttaaagagttggtttgaattgtggcctaaataggccttaccaaattttgtcaatgctaaattttgacaagttttgacataactaattttggtaaggaaaatcgtgtttggattaaagttaaaatagcctaagtttatactattgaaatgacttattttcttaggcatgtcactaaacactattgaaattacgaaatattagtaaatctaatttaggcttcaaaccaaaccagcccaagccgcaaaagtggacaatttgccatcttcaattcggtatctcttcacttcatccatttgcccttccaacttccaacatccaaggcatattccacttggagctggacccactgacagtgggccccacctcgtcagtgacctactctccattaattacgctaactcctcacgtcgtctcgcccgcaaaatgcttctcttcctcctcttcctcctcgccgccggcgaggccgcggcggcggcggcggccaccacgctcaccgcgacgccggcgaagctcacccagtccgaccgcgagatcacgatccggtggtcgggcctcccggacccggacggcctcgactacgtcggcatctactcgccgccgacctcctccgaccgcgacttcctcggctacctcttcctcaacggctcggccacctggcgcacgggcaccggcgagctcaccctcccgcgcctccccaacctgcgcgcgccctaccagttccgcctcttccgctggcccgcgagggagtactcctaccaccacatcgaccacgacgggaacccgctcccccacggccgccaccgcgtcgccgcctccggtgaggtcgccttcgactccccctcccgccccgaccaggtgcacctctcgttcgccgacggggtcgacgagatgcgggtcatgttcgtctgcggcgacggcgggaggagggtggtgaggtacgggccggcgaaggaggagggggagggctggaaggaggtggccgcggaggtgaggacgtacgagcagaagcacatgtgcgactcgccggcgaactcctccgtcgggtggagggatccagggttcgtcttcgatggactcatgaagggattggagcccgggaggaggtacttctacaaggtcaatcacttgcctctgctttgaattgattgttaattactacactataaagatgaatttctttgtagcgacttcacttctgctaattatatgtgttcagcctgcaattgcaatttgggatttagggtagtattgtaggcacatgaaaatttaggattcgagtcttgagagtgatctaaagctccttttttatttcggatccagggattgaattttgttgatttagcgagtatgacttatagtacgttttgacctacgaattcagtttgaggtgaagatggctgaatcatcaaacttttagagatactaacttgagcatgagcacccgctttggaaattatgtttgattatcccctttttagaactgaagttggttatagtactacactaaagatgaatttttatgtagcgatttaacttctgctttatatgtgttcagcctacaattgcaatttgggatttagggtagtactgtaggcacatgaaaatttagtgctcgagcccaagagtgagctggagctgtgttttttgggctccagggattgaattttgttgatttagtgatcgtgacttgtagtaagttttggcctataaattcagtttgaggtgaagatggctgatgcatcaaacttttagaggtaattactggagcatgagcacccacctcggaaactatctttgattattccctttttagaactgaagttggttgaagtttttgtctcaacatttcatgggttattacatgactcgattggcaatactttctttaaggaggagtttagagatcagttatgtcatctgaaaatcatgattttcttttttctgactagctactaagcttctaccaatcaaacatgcttcagttctttcctgcagttagaatacaactgtatgtgaattgaggtttaggatttcagttacaagggatttcactcaaatttgttgttgctctatcttaagctttggttgttatgtgacttccttcttaactgtttgcttcatttgagtgacatatgcattgcttagttgctcttatggatcatgattggatttttacggatgctccatttaagcactgtagttcatactatttttgaatgttgggtgagttcttaaaagacctgatgagataccttttaggcagaatttcaaacgccagtttttgtttttgttggttggtactcattattttcaaaattctggttttctagtacttctctaaaatcagttttggttgtaagtacctttgttatctatttgcctttttgttctattattattatgtatggaaagcatgtatgctatacttttgatgaatgatgattaataagatagctgtggttatgcgacttacttcttcactgtttgcttcattgagtggcatgtgtattgtttaattgctctatgaattataattggatttttactggtgctccatttgagcactgtaggttataatatttcttaaagtttggtgattccttaaaagacctgatgagtataccttttggacagaaattcaaacgccatttttcttttgttggttggtacgcattattttcaaaattcaggttttctagtactttttaaaatcagtttttttaagtgcctatgttatctatttacctctttgttctattattattgtgtatatggaaagcatacatgctatactattgatgaatgatgattaataatatttgaatttttatttgcttctttttgctgacacaaatgaattgtcattttctttttctttttttttttgggggggggagggaattagataaaaaatttctcttatttcagagtttcagctttgacttcagaattttctccccaaattagcttaatttagacttaccaaattaaacaagaccgagccatgttgtgtttttaactgccatcagtttcatgtttaatcccctctaaaagatgtacaagcttttggacaatggcttctagagcaagtaggcccagtaaaatatgctagggtgctattgatgctaggcccagtaaaataatagtgagtaactgagtagtgacacttgagcatgttttgtatatgccttttgttgttcaatttgattgactgggcttttctgcataggttggtagcaactcttcaggatggagcgatacgtacagcttcatttcacgtgacaacgaagccaatgaaactattgcatttctctttggtgacatgggcacttatataccatataacacctatgtccgcacgcaagatgaaagcttgtcgactgtaaagtggatacttcgtgatattcaagcccttggagataagcctgcatttatttcacacattggggacatcagctatgctagaggttatgcttgggtatgggatcacttcttcaaccagattgagcctattgctgccaataccccataccatgtctgcataggaaatcatgaatatgattggccattgcaaccttggaaaccttggtgggcaactggtatatatggaacagatggtggaggtgaatgtggcataccttacagcgtaaagttcagaatgcctggcaattcttttgtgcctactggcaatggagctcccgacacccgaaatctttactactccttcgattcaggggttgtgcattttgtttacatgtcaactgagactaattttgttcagggcagtgaccaatacaacttcataaaagctgacctagagaaggtcaaccgaagtagaactcctttcattgtgtttcagggccaccggccaatgtatacatcaagcaatgaagctagggattttgctcatagacagcagatgctccagaacctggaaccactcttggtaacatacaaagtgacccttgcactctggggacatgtccacaggtacgagaggttctgccccatgaaaaacttccaatgtgtcaacatgtcatcaagcttcgtataccctggtgcccctgttcatcttgtgatcgggatgggtggtcaagattatcaaccattctggcagccaaggaaggatcaccctgatgtacctgtctatccgcagcctgagaggtctatgtaccgtggtggggagtttggatacacaaaacttgtagctacaaaggagaagttgacactaacgtacatcggcaaccatgatgggcaagtccatgatatggtggagatattctctgggcaagtatctaataacaatggtgttcctgaggtgatcgatgatacaaagctcagcacaggggtcagcaccaaactgaaaatccctctgttctccttggaaattgtaggcagcgtgatgtttgcactggttctgggtttctctcttggatttctgatcagaaggaagaaagaagctgcacagtggaccccagtgaagaacgaggagacctaaaatcacacactgtatctaatgcaaatgcaaatggtttttgatcaacaacctgtttataggatcgtgccccatttcttggggctctacagtgttgtactatagtgcatagagtattgtaacatgtgctgtgtcaatcgtgggcattgtagagtttgatcagcatatctgttgccgtgattctacgatacataaaggtttcaataagtgacattacgttcacatcaattggttggtatgagtggttaacctgttccataacgtaatgcacgattcattgtttcatctgtgtttttctgtttgggactgaatcgagtaacagagaaaatgtatcatgcagcaatttacaaaatcagtttaactgtataagcatttttacaccctgttatttaacgcccccattgtttggtttatttatggaataagcgaaacgacatatttgtaaacgagaaataatttgtgaatataacttttatatacatgttcttagcaacctactctctcggcttcacaatgtaagtcattctaatatttcccatattcatgaatatatatatatatatattcattaatattaatatgaacgtggaaaatgctaaaatgacttacattgtgaaacggaagaagtaaaagcaaaggctggaaaataaatttcgatgaaaaaaaatcttaaaatcagctacaaatttaatgttaaaaattcaaattttggctgataagcataaacggaaatatgtgtacgtcacgatgtaaaggtatcatctttattctgaatgatgatgattcatgatgtaaaggtatcatctttattctgaataaaaaatgatgaatagatttgacaccgattcaggtaggccaagaggtatccccggattggattgtgatcaaatgcagtagctactaggactgcacggtaactactgcacacaatctgagccctctatatcaaaatctaacggacaaaacggatttggcacagtaaaatcagaacagtacctttccacattaaatcactacagtgttttgctacagtgctcggatatatctgggacgtccattttagatcatgcgatgctagtttgactgcttattttgcagtcccactggctactgcacctgaatcggatccccccggattgggatcctctgactttactcagagagctatagtaccgtgactttgggagtatttctagccgtccgatccacagcgaacggacaagatcgatcgctagttcgctacagcgaatcggtgaatagtaattctgaacagtattttgcactgtttgctacagtaaaactacaaatcactattccgcactgtagcgacaggctcattttactgtgcatgtctgccgttcgcttcaaaagtcagaggagccgcttcccccatttgcacactgtgaggaccatgtctgcactatacgagcaggtacaacagaacaacagactataagccaactatgagtatattttaaagaggtaaaagaagagaaagaaaagcatcaggctacagatatatctgtagctagctacagtatggactccaaaacataatgtatgtatagcagatgagactaaatattaatagtatagtaagagctagtagtgggctatactattaaacttgctctactaccatccatttataaaaaaaaatatctatatgttcagatgagcacgccattgaatttggagttggagagactgtccatgttgaatccaatcatgtcgtcggatcggagctccaagaaggtgtgtgtcgtcggcgccgggatggcggggctggcggccgcgcgcgagctgcggcgggaaggcctcgacgtgacggtgctcgagcagctcgccggcgtcggcgggcagtggctgtacgacgcggcgaccgacgccggcgacccgctcggcatggccggcgtgcacagcagcgtgttcgcctcgctccgtatcaacggcccgagggagtccatcggcttctccgacttcccgttccgccccaccaacgacgccggcggcgacgcgcggcggtaccccgtccacggcgagctcctcaggtacatcagggacttctgcgacgcgttcggcctcatggacgccgtcaggctcaacaccacggtcacgcgcgtcgccatggcaccgccgcggcgcgacggctcgctgcggtgggcggtgaggagcaagcgccacggcgaggcggagacggaggaggtgttcgacgccgtcgtggtggccatcgggcactactcgcagccaaggctcccgaccgtcgacgggatggataggtggaggaggaaacagctccattcccactcgtaccgcgtcccggactccttcgccggcgaggtcgtcgtcatcgttgggtgcagcgtgagcggcgcagagctcgcgcttgagctccgccgcgtcgccaaggaggtccacctcagcaccaagtcgacggaggagaccatcacgtcggcgatgtccaaaagtgtcgccaggtacgaaaacctccacctgagaccacaggtcgaacacctgcgcgaggacgggactgtggtgttcgacgacggctcgttcgtcgtcgccgacgccatcatctactgcaccgggtacaactactcgttcccgttcctggacacgaacgggaaggtcaccgtcgacgacaaccgcgtcgggccgctgtacgagcacgtgttcccgccggagctggcgccgtcgctgtcgttcgtgggcatcccagccaaggtgcttctgccggtgttcatcgaggtgcaggcgaggtgggtggcgcaggtgctgtccgggcggaggacgctgccgtcgcaggaggagatgcagcgcgccgtcgaggagcacacccgcggcatggaggccgccgggttgccgaagcggtggacgcatgacatgttcttgaacctggaacgctgcgacgactacggcgagcgcatctgcggcttcccgcggatggaacagtggaagaaggagatctttgtgtcatccctctccgacatggtcgacgacatcgagaacttccgcgacggctaccacgacagcgacctcgtccgcgacgccctgcgccggcacggttggactcccgccgaggaggacgacgacgcccacaaataaaagcacttggattggactccaataaattcaggttaagatgaagcaaaccaaataaatacacgacaattcaacaaaaaaaatgctggcctgtctgtctcaagaggatttttcattgtactaaaaactgaacctttttattttcggaattgctataaatatgccgccatctttcttctcggattacattcgattttctcaccatacaattagtttagagatatgtgcgtgtccgaagactgataatgccatcgttaagtgctgatactgtacgtttatgtgcatcccagtctctagttatcgctggccattactgttgtagcagggggtgaacaccatcccctatactcggccaaaaactcgcatgatgaggaaagtgtttttgagctttgctcaaatcaaattctaatatgtagccgtttctgaccaagaatttgcattcgcccaatagggcctgttccaaggaaaatgtgttcgaacaagattacttgctcgaattggcatcactaaaggcattgtgtttgagcaggttctttggctaagacaagtgaagtgacgaggagctaaaagatgggagagtattcaagtccaggcacaagtgttcgactcgagcaatcgaagttgaggaaaagtaccatccagcaaagcatatattttagaaaagtgttatgggaaccacgtcaactgctctcaccagttagcatcaaatgttacttggggaccactaaaatgttttaatatgcccctaaggtcataaactttataagggtaatatgataacttcatgtaagcctgcaatagcaaactagtgaatcttgggtacatgataacttcctacggtcatattgactttgtaccatctgtaaagttcctttctgttagatgaaatgtgttgttgtataggactttaattacaaacgcgcgtgcgttgcaaacggtgattactatgtacaattaaaatgtgattactatgtacaattaaaattatataactccactggtggagaaaccatctttggtcggtccggcaaaatccataatagtcccggatccaaaaagaaccggaactaaagattgtttttagtcccggttataaaaattttgatctttagtcccagttcatcccctgtcaaatgtgtgtcaggaggccgaggatctttagtcccggttggtgtaaataaccgggactaaagatcaccactttagtcacggctggtactaccaaccgggactaaagatcaagatgatgtttagtctcggttgggagtaccaaccgggactaaaattaaacacgtagtatataattcctatcccttatcctctcctccacagttacaacgtagacagatcgaatctcaccccctctcctcagatctatcctctctaactctcttctccaactcctcccctcatcctctcctcccccttcctcctcccattcc

SEQ ID NO: 66756 - DNA, 18573 bp, Oryza sativa
ctcctggtaacatgcatggatgaaacagtctctatgatctgcacacatatcgatcagaccacgtccaagattacaagttgttcatacaacatgtccagttattcatctgataatctctcaccgtagctgttgctgcaattaagtggtaatttcatatccctgcagatctctcttccatctatctgaatatctcttgtgtagaagagaaattaacaaaccctgcatatgtatatgcaactatgcaagatctgatcccaaaatctaattaacaatttaccaatccatggccgtagctagcctcaactgatcacacatggaaccgtgtgaaaaccacaaaacaaacaaaatgaagatggcaaaaaaacacggatctatgtaatattccatggatctacaactacctaggctacatacatatatatatgccaatccacactgtttaatttaactttggcgtttgatgatgatgagcgatgcgtgcatgcatgcagttgatcatgaacgcagcggcagattcatctctcgaccatgttagtataggagtacacaacactagctggtggcggccactggagtgcgtgccgcgaagttggcgatggtcggccggcggtgcatcatcggagacctcgccggcgccgccgctgctgcctcggcggaagccggcgccgccgacgaacggaggcgatggcggcgcgccaccgcctgcagcgcctcgtccatgtccatctgctcctgcctgcagtcgtcgctgcagaacgctgcatcccctctacacatgcaaattaatcaagatcaattccttgttgaactttgaacacacaaaatttctgtgaaatttattaaggatatatatcaattgatttgcgaactgaattacctgtacatgaagatgtcgcggtcgccggcgatgctgctcttgcagaggaagcacgactcgaggaagtggagacggcggccgccgccgccgccgccggcaccgggcttcacgcggtagaacctcgacgccacctccacatacctctcctcctcctccatcgccggcggcgagccaccaccggcgatctcttccatctctaatcaactgcacgtcgtagctaatcaaccatgcaaccagctctagctagcttattaatttagctagctagacatggtgatctcttcctgtcttgtatcgatcgaacttgcacatatgtgtgtgtgtgtcagtgtattaaatcgttaatggtcctctcctggtagctagcgagtttgttggcagatggaggccaaatgcaatgaaagatgtgtgcatatatatgggtatatatgagcattttgtttggcacatagctgattcgagggccgaaggtttgagagaaaaccgtgggtggagtagcaaatgggcccttggaacctattggctggggctggatgtgtgcgagtgaccttggcctaggggggactaacctactctgcaactgcacccaacttgcagaaatatcatttatatatgtattcatataaatatcacaacatcaattaataatgcaaaagtaatcactctcctgtgcgtggaaaatggaaccagattactgattagcagtgttattaaagtattttctgggtcagtcatgcgagctctgcaggtgcttaacgacaaattaagcttttataaactctgcctttgatccttgcgatagaaaaatgttttgtaccacatcggccagcgaggcggcatgggcacggcatatagccgttctcatgcggcatccgtttgtacgaccagggcccatcaccatctctcgctgcatttacagtttttttgggccaaatgtagtgatccatcttttggcccatataattcaacaaagagaggcccatgtgattccactgccccatgagaagcgctgcgcgatgcattcgcagatttgggccgtaagttgggccacggctatcattttgggccaaatttggatcgcagaccagaccattggtagcgatcgcattttgggccagatttgggttagtatgttttgggctccaatttcaatttcgatttgaattgcaatttcgattttactatagttaaaacttcgtcatatgtaaatatatatagcatcattgtaattacacggtaactttcatataatttaatccgttaaatcgtagattcattttaagattcgtgcaagcgagaaaggaaaaaaaaatcatagtgtccgtacgtacgggtgagggctgctcgcttcatgaaaatagtgggtttgccgtacaatttttaaaagctacatataagtacgttatatgcaatttataatacaattacattataattatagactatattttacatctataaaatttttaaagaaaattttgtccacacatatacaggtagcgtgtgacgtgtgcgtctccgactcctccggccggtccatcgcatcacagccacacatcacgccgtagtaggattagccaagccaagcgataagccactcatttcgtcgccgtgtcccgcgtggctcgccgccatggacgccgccgtctccctccacctccacggggcgctcccgctccccgcctcgcgcgcgctccaccatctcaacccggcctcctccgccgccgccgccgcctcggccaagcagcatcagcagccgcgcgcgcgcctagctgtcacgaccgcgcggcccagcagcaggacacgcgcgcgcgccgcggcggcgtcggcgccgccagttccccctgtcgttcatcagcagcaccgcctgtcgtccagccgcgcggcgacggggtacgcggcggcgctggccgacgcgtcgctccgagccgggacgctggccagtgccgcccgccacgcgcgcgcgctgctcgtctcggacgccgccgccgccgtcgacgttgctgaggattcgcgggtggtcgcgctggtgaggatgctcgtcggcaagggcaaggccgccatggtcgccgacgtcatggccgagttcgtcgccatctgcgaccgcctcctcctcctccccgcgcgcccccacgccgccacctcttactaaagaattacattactctgtcagactctgctacgctgcaattaaacctcgcatgttcagaattgctgcttgttcattgcaacacttgcatattgccaattcatttctcagtaaaatatcagcttaaatctctactcttttttttttgtcgggccatacatgctacgtcccaaaatatagtaatctaggatcggattggatatatctcaatgctacgaattctagattgatgtattttagaacgaatggagtaatttacataatgttattcctgaatcatcatacatcatgtaccatgaccttcaattctaaatactacctccgttccaaaataaatacagccgtggatatttgtgcccaacgtttgaccgtccgtcttatttgaaaaatttgtgaaaaaattgaaaatatttagtcacacgtaaaatattattcacgttttatcatctaatagcaataaaaatactaattataaaaaattttcaaataagacgaacggtcaaatgttgaatgtgaatagtgcataactgcacttattttgggacggagagagtatgttgtactgtggttctgcagttcttctgctgcaaaaccgctgccaacctctaaataattcagggaccttgatctttattgcacagaaaaaatttgaagctagcaagctgtttcatctgtcacagccttggggtttataaatgagttcacataataaaaaggacaatcatatattggtttggatgatgcactagccacattatgcataatgccaaactcataattctcaatagaataattgagtcataaagttgtggttgtgcaaccaactgaaacaggaaagcagaggaacgtgagacgccatgggagattgacactgccgcagcgtgatggaaggtacgtagtagcagttgagaacctgtactgtatattaattgagcagttgaatgatgttaacgcacacgtaatccatctctgcaatgtactacatattgattgagcagttgagctataagaatatatatatacagtagcgtagcatgagctgcatatccctgatttcattggattaacttttgtgcttctgtaagacttgacaaatggagtatcttttagttgtatacatacgctgctcatacactattgatcctatgaaaactgacataaggcatgattcatgaagcacattacaagcactaattgatggatatatgtatgtacgcgagtgcaagttcatgaaaggaacgatcaatcttgaaagagtaacagcagtgctccctttgcttgtgacacactactagcttagctattagcacgtactcaggtactctacaaatgaatgatgaaagggagagtacatatatacaggagcaagagagccacaacctgtctaccattagtaattagtaattaacccccatgactgacagccaacaggaactgatcttttcaatcttgttaagttaattgatttgccgcctccgatcgaatccattaagaaattaatggaaagacaatatacatccacagtaggagcaagatcaaccactctcctctacatctccaatctccatacgccagcatcttaattactctacaataatcaatcaatatcaacgcatgcataccgcatacgtgatctcagaagaaaggtacagctccatataagcacacaatacctcgctcagctgtgcatagtttgcatattttgatcaatcaatcaagctaagcaagctagtgattagtccattgatagatatcgatggaggaggaggattatgtgttcaaggtggtggtgatcggggactcggcggtggggaagacgcagctgctggggcggttcacaaaggacgagttcttcatcgactccaagtcgaccatcggcatcgagttccagacgcggacggtggagatcggcgggaagcgggtgaaggcccagatctgggacaccgcggggcaggagaggtaccgcgccgtcaccagcgcctactaccgcggcgccctcggcgccatgctcgtctacgacgtcaccagccgccggagcttccaccacgccgcccgctggctccacgacctccgcgcccacgccgacaactccatcgtcgtcatgctcatcggcaacaaggccgacctctcccacgcccgcgccgtcgccgccgacgaggccgccgccttcgccgaggaccagggcctcttcttctccgaggcgtcggcgctcagcggggacaacgtcgaggaggccttcctcggcctcctccgggagatccatgccatcgtctcgcggaggtcgctgctggagatggacggcatcaacggcgacgccgccgccaacgccaacgccgcgctcatgctcaggggcaccaagctctcgctctccgacgagctctccatcatggagaccagcgccatcaagagagtgagcaggtgctcatgctcttaattacttactttagacgtcatcggctcatcgccatcgagagagtactcatgctcttgacatcatcatcatcatcgcaagttcataatatacatggatgacagatcttactgcagaagctgagacatcttggtttccaagacacataattgaagggaaaagtatatattaattcagctcttgggtgacaagcaagcgttagtttcatctcatcgtgtatctatttcaagtcacagcagagtgctccgacaaaaaaacaagattgtttgtaaaccatgcaagcgggcctttcttttcttcgttatgtatagagtctaccctaaagtagtttaattaaattaaaatacaaggtgatgataacaaatttcacagaaccatagaatcctgactcgggccatataattctgaatttaacttataacatcagtgcaaagcattgccagctgccattaacttcaaaaaccagcgcagcctcgcgacgctaaatgaatccatacaaaccctgaatcttgcaagctgcattagaaaacctaacgatatcgaggtaatgcctgcgcttactcctttggattttcatgagatctagcaaaaggattagattaaggtgaagatggctcttgcggttccgactgactgttctgaactattcgagacatcagcttagatatctcaaaaattgcgctctgtacctgatcgtcttctgaatcagagggccgaatccacaccggtgactgcaaccccgtagatgttccattcgcggcccttttcccctttctagacgttgataaagctttctccagatccgattgcctcaagggtcttggtttctgaaccagcaatcaggaggcaagatagtcagaaccaacatgtaatgggcaataatcaatctgatgttgtttcagttattactgtatcattaaagtccaactagaaactgtaaatgaaatttgaccatgaaatccaattaaacagaatcagcggctatgctggcacaagtggattcatgcatgaggtttgccgttcgcaaggtcaactggtgtagacaaacattacccaaaggaagtaataatgaactaattaatggtggtagtaatactaaaaaaaatcagcagtgaacacagtaagcaacaagaaggaatgaatactcacatctgcttttcgcccatctttctcattgttcaacagctccctgatagggtagaatgctgcttgcttgcacagttctagaatgtctgatccagtaaatccctcgcatagaccggcgatgtaatcgtaattaatgttaggctcgacattttctcccttcaatacaaccctaagtatcttgcttctttcactctgaacaggaatcccaatttcaaatatctgagtaaagcgcctgaggatagcctcatctagctcagagggtctgttagtagcagcaaggaccataacacgggcattttctgcaaagccatataaataaatcataagatgttgcacaggagtaaccaggaaacttgtttgctagttacaaaataagttgctccctatgtttgaagagactatgtctggcaccctaaataataagacatgatcaaaacaaattacgacagttgatacatcgatttctatttcttgagagagaagccatgtgacggtccgtgtattgtaaaaaaaaaatcgttttctcatgtccagcttagacataattagttatttcaagaaaaaaacaaaagctaaaaagattggaaaaaggtccaactcaattaatttcgttgaagtttatatgtgttgatttcaccaatttgacattatattcagattgcatggtaactctatacactaacggtctgccactttgggtgcatggttatcacaagcaattgatcagattacaacaatgcccataatagcagggatatgtggtaactggaataattattagtactaacttccagttcgaaattctaaattgtaacaattgtttccccttatgaaccactgccacctgtgcctgcaggcagcgattttcaaactttcttataaaaaatcaccccaattaacaatattgtgcacaatacatcattgtatgtttgtaagataacctatctaacaattaacttacataacttacatatgtttgaactaatgtgcaaggtttaagaagaatattctgtgctgaatgccaacaatgaaatatgaatttgttcagacttcaacgtaacaaagcattaagcatgttgatattctaacataagaaaacttgagcataaaattgaaggttatgagagataaatttatatataggttggaaatgggctcaagtttgatacaacacggaagtaaagctttggacagcactgtttagcaagaatccatatgcgatgcaagaaacccgaactaaatagcatatcgatgtcacaatgcacagtggaatgtcatgcggcatcataagcgagctgcatagtgcacttgtgtgttgcaacatactttttctcttaggtaatggagcacactgaacagtattccagactatacatggtctttttgatatatcttatatctactaatataaaaatcgaatgtagatataagtccgcgttgtggggaatcaggggcatattgagagaacgagtaacatggaattctagaaccaaccctcgtggccgccaacccaaatattcaaagtggcaaaggtatatcattacataataaagagaataggatatttgcatagttactagcaatttggacatggaatatgttcatgtataagtttgaagcagagtgtgtacttacgatcagtggtgaagccatcccagagggacatgaactcagtcttcatattagtcatagcttcgtggtccgttgtccgtcgctggcccaagaaactatcgacctcgtcgataaagataatagccggctgcagcttgtgtgcgagactaaatacagcagacactgcaagatgtttcataaatcagcagcgataacaacaaacaaatgaaaaggagcggcagttaaaccgaaggatttgcgcgcggagctgaccgagcttctgggcgtcgccgaaccacttgctcatgaggttggaaatcctgacattgatgaagacggcgcctgactccttggcgatggccttggcgagcatggtcttgccggtgccgggggggccgtagaggaggacgcccttctgcgggctgaggagcttgccgaaggtgaagagctcggggcggcggagggggaggatgacgagctcgtagagcgcctgcttgacgtggtcgaggccgccgatggaatcgaactcgacgtcgatgtggtcggggttgatgacatcgcaagcaatcacatcctagggtagagtgagattgcataggtgagagaggagaaccctagaatcgaatcgatggattggggattgggggtggaaacaatcgaacctcgtagggggtggtggagacgagggggcggccgaggcgcttggcgatctccttcttgtgctggagggccttctgggaggcggcgcggttggggtcgagctggcggaggccggcgaagaggacgaggcagctgagggcggcgctggcggcgtagagcaccagctcctgcacgaaccgcgacgactccgacgacctcatccaatccaatccaacccaatccaatccaatctgcgggcggcggccggcggcgagggagggaggagggagaggttctccccccacacaccggatggatctgcggccgccggagccggagcgggaggaggggaatcgatgggatgggaaaagaggaaaaggaagaggaagagacgaagggggattagtcggtttatcgggaaggcgtcttggggaaggggtttgtgttgcctttgcctctcctccgatgcttctggtctctcgtctgtttgccgcccctcaaccttcacggaaacgagtcgccttgggccattggattggattacgattacacctgtccttttttttctcgaaggaagatcacacttggtctcttattccgtggtagattaatagttaattaattgtatgtatccttttttttatcagaaatacaacaaaatggtagtactccctccatccacaaaagttacacctatttcacatttgatttttttttcaaataagttgttcctatttgtagtctttatgcattcaagacttaaatgaagagataaattaaatgttttattagaacccaaggagtcatctaaatacttattagttgcatgcttgtattcactccttaattttgtaacattcaaggtgatttaatttctccttagtcttggtgttaaaagtaatatgtgtaacttttgtggatggaaggagtattacaattcaacgagacaacttacatcatattgaatctgatatctatatggtatcatatttggtatcgaatgtattagatcggtatctacgatatcgtgctgacatcaactattccgttacaaaccgttctgaagtctttctcttattttatacttctattttatgaataggacagtcaaaagtttagactcgtagtattatatgcatatataatagtctattcaagtatttttgtacatttactatatattttaggagaatagagtattatgtccttactaatactactctcatgtaacataatagaggtgtgcagagtatattttgtttgtggtcttataaaaatttggcaaggataaaacttgaaaattatgctcccaagttcagattttctacaggaataacatcagttcgagcgattttgaagggagaaaaaaaaatacagtgtcagagatgacactgggccggccgacgacaaagatgcagatgtgctccacgtcggcccaatatggccgtacaaccgaataaacagaggcccatgtccgctcacgccatctccaggacatcccgatgggctgattgggccgtttgatctccaactgcaccggcctagccagcaacggcccattaaacgccaagcataatcagccgtacagcatatgctgcatctgtgtggcgtgtaacattggagaactaggaacataaagctcatgctactgccatagcaataagtagcatgatagagcagcatatacattttctggacaggaacgaaaagaacaacaaaaacagaatcctaagttagttaggactcccttcgtcccattttaagtttatccataattattttccgtgtataactttgaccgtccgtcttatttattttttttaaaaaaaatttagaaaaacataagtcacatataaagtactattcatattttattatctcataacaacaaaaatactaactataatttttttaaaataagatggatgattaaagttgggcacggaaagttgcacttaaaatgtgacgaagggagtagtacaaatttcccatatatatatatatctagctactgcctagctagtagcttattcgatatgcgattattggtctacttaattaattggtccagtacaatgctgatcgaattgaattgaacttttaaccacaaaccgttatggaatcatataatcattcaagctagctatagctagagtacatatgacattactgatcgcgtactgcattcgatactcgcgaagacgaagaagaagaaaagagaggaaatcatcatcttgccaattggtcgatcgagaataaaaacggacagacgcccagacaggccatgcaatgcgacatgcactctccaaaaaagcagttcgatgtcatgtatgtaaggacaaacagctagcagaccaggggaagaaccccatcatttgcgtccatctagctagctaaccctttgattgccagccagccaattaactgcctagctcttgatttcttgagaaaataaacaccatcaattaatattaattgttgctttctgaaaacaggttttgctgctttctgaaaacatgttttgttttgcatgcatgtatgtaatgatcattaattgcaatattaattccacgctctctcttctgaaagaaagaaaaacaagaatgtcacattttcagtaaaggaattcgctatacacgatatatagactgaaagtctctgaaacccaactcctgctgagaactgaagaattaaactactgtttaattaatttatcgcggattttaatagggcgtaggattgcaacctctctgatatagtacacgtctgtgatcgatctatttcagggtctttgcattccttttgagacgaagctagcgcatgcagctgaaacattgctaaactgaaaaggaattgtcaagtcagccagcagagcatatataatgcccgtttttttttcctgaggtactagtatcaagcgatgcatgcgttcgtgatgcggcgaaagcaagaatctggtgccgaatggagtacagattctactccattatgatcatacacagcctcctgcatgcaagaaattcacctgtaaccatccatgcactgagtctgatcgatgcatacatttcaggcaaattaaagtgtggcagcagcagcagcagcacgtagcagcatgcatggcatccagtgcaagggaagaaggagatcgatggacgagtgactcgtgagagcagctggcctagctctgaatgaatatactactggatatatctgcagcatgctgccatgagaggagatagctagctctgaaacgaatatatttttttgcacacatatcagtatatatatatgctcgtgtgtgagcagtgcaaggtatggcagtttggcatcagagcgagcttggcatctgcatcaggggggctgcgtcgcatgcgttgaagtggcaatggcgccgcggccagctcgccggccggccagccggcgcagcagcgcaggcatggggcttcgtcctgcgtcgtggtcacatccatcaacttatcgatcgatcagtctctctgacggaaaaacaaatttgctttgcatttgccattgcgtattcccgtttctctgcatctgcatgcctcgtccgagaagaaagcgatagagattgcgctttactactccatgtgtgtgtcttctctccttttggtccacgaaaccacgaatatatttctggagtacaaaagaaaaaacatgagaaaaattggcagtaagatcatgcaatacccggccaggccaggccatggccatggcgtcctgcccctcctcgtcctgtcttttactgcttcgtcttctttccaaccaggcacaggcccagccggcccccccccccccccccccaaacacacccaaatactcttctctttctctctctctctctctctctctctctctctctctctctctctcaatcatgtccttcatcataaactctgcatttaaacttgtgtctcaactctgaagaaacagtagagggatggatgaaaagctagagaaatggatgaaaagaaaaggctgcactaactttctcaagtgtatagtatgtgagtcatgggtgcatgttccctctctcttgctagctgctgccatggatggacctcatggtgatcttttttcctctgaaacctttttcttggcctgtctgacagggtgggggtcaggcatggggttagagcttgaaaatgtgcactgattacatatagcctttttctctaggattaggaaaggtttatatgtgtagactgtagagtagagatgccttttttgaatcttgaccatcgattgcgtggcggtcagcaatcatccatcccccaaacaaatgaccacaagcttctaagctagctaatcctatggttgatgcaaacaggcgatagtgataacatttctttcttggcttttcttaattacaagtggtatacatactcaagattagtctcaagtaagtgctccattcatggagttttataagacatatatattttaatcgtagaaagtcattctttattgattttcaccaataattcgtcgaattgtaaagtacatttactttataaaaactatgctggtagattcatatttcaaaatactttcacaaatttggctctaaagctattaggagaacattttatgaaaaattaaaaccaaatcttgatgttgaagactttttaaaaataaaatgtttcttatagttaaaaatcaagaaaccaccattgatcatgtgggcaaaggtatatatccatgcatcatatatctcgtgtatgtttgaaagtgatgatggatgatgaactatagatgaaattaagtgtttcacaattattcgagggctcaaacgaacgaatggaagattagaaagccaacaagttatttttttaaaaaaaatctaagaaatattgttaaagaaaaaaattgcaaaaaaaaatcacactgtttaattatttggagctaggaagcatgcacatgataatctagtggtataatcagaaaagaatagggtcatatatagtgttgacaaatctctttaattgtgttattgagggagttctagttcctacaaaatccatatgagaaatccaatttcagacatgcctaattaataattccatcagttgtaaatttcaacacattaggtttgtaaataatggaatagtagacaagagaagagaaagtagaatggaaaatgcatggatggtaggccggcttgggggtgggtaggtgaagatagcaattcttgtgggcagaggtccactctaactgccccaattaaaagaccattgatcccctcctccccaagcagccacagacacagccaccacactagctttggacacctctacctagctccatctgcaaccatatgcatctccaccctctccatttggaaccagaaaaccatggcttctcctgcatgctcactactcatccctacacagaaagctctagctgctgctagtttcattctagtaatgatacaaatatcaagagaaaaagtgagagtcaaatagaggtgtgaggtgaggaagatgctgcaggtagaagaagctgagagaaagatatgatcaagcaagcaagcaagcaagcaaaagttatctagctaaagagggagccttttcattttgaggggaatgttgtctggctcggggctacttttaatttctctctcttttgatatcttcttttctcgatctcctagcttgatcttttgatctctcaaatcgatcttaagaaaaagatcagtcaaagagatgagagtagatgtctgtagatctcggaccaggctctgatgaatcccctaatgatttttatcaaaatcataagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcaggaccaggcttcattccccccaaacagaagggctcccatgcatatcgatcatgagctagcttattaccccctgcttttgcctcttccaaatctgatgaactgggtaagttaactgaatattgcttaactaatcagctttttgtttcatctgatggatagataggaggagtagatcttggtggcatgaactgcatgagatgcagattggtgtaatgatggggggaaagactgcatgactgtacaattgcacacttatcagagctacttgggatctcttctcttctcttctctctctgcaataattagcctttgatgagatgaagggtgatgaggaaaaggctgtcatcattaaaggcctttgttccatgcagatcctatccttcatggttggaactagctagtctgtattcatcaggtacaaataccttgcttaatctttcttctttcatatgtatgttcatctgatctttacctttgcttgggtatcacaactcttagctagcttgactgatctaaaaaatgcttttttttttatagtttttggtgatctatttttcatcttcgtttttcttcatgttctaccttgcctggtaggataatgaaacatgaagtacatatatcatgctctgtagtacactccgggagaaatatatggatatttacttcctgttaatttgttgcttggagtagatctagagagaaaaaccaactctttgcactgtgcgtggattctttacctttttctccttcaatttttgtctctctccaaataatgttgcattgggacatattaatttgattccagtttaagggaattaataggtagctagcagatttccatttatactttggtcactgaggttaattaattaattgcctataaattgttccgataactgattcacactgttcaagagaaaaggcaagctagattcatattcttcagagtaatgctccggtgcaatctacttgcagtattctactccaagtagaataatcttgaccgtttattttaaagagcaggtaagtaatctcctaatatcgtttaggggtaattttggcatgggatgttttcttctgttcgcatcgtatcaggtctgaactccgttgcacgcagtcacctcgctattcctcccccggcctagccgccttgtccgccccctccgtcgccatccgtattccccgccgtcgccgccttgtccgcttcctcagtcgcatcgtccgtctgggagcggacgagtgtggtggcgtccgagcaagtgacgatcttgagcaggagttctggcggtagtaaaaattccagcctaggcttcggcggcagcgtcacgcacgcacgcaatgtcatttgcttggcagcgtcgtctcggctcattcgtcttcttgccgtttccgatcactgtgttgtttcatggattacatggatcgattaagatcttgcacgaccaactccgacgaggatgacatggtgatcgatctatggatcggaaaacaataataccccttcgcgaattatttttcctagacaaaaacacccctccacatttcacttccactaattctggtaggagtaaaactagatcttaaccctacaattaaatatgatcaagggcctagattactttttactccgagtagaaagcaccagagtaggactctattcttcattcatggtcaaatcatgacaagggtttgagatcagcagagcagatatatctttattaatttttggtggtaactatatataatttcagctaaaccggccaagtagttaattactgtgcctttttttttctcttctgtttactttatgatccagtagctaccataaatgctgtagaaagaatatactgcaaagggcacgtagatttttaccttctaataaatgaaatggaactgcgggaaactattctaaactctcgagtggatgtcttctcgttgtgcatatatacgagatcatgatcttaccaaacaataacaagttcatatataagatgtgcatttctatgacaatatatatactacatattgattttttatattaatttgcaagctacattcatgctgatcatgatgatgagatttaattttgttcattcaattcttagaacactaatcaaaagtaaacatcggacttttgattaatctgaaaacttaaatattatcgatatagctacagtatatgtttgtcagggcactagctagctgattctcgatcagctagctgcaggggagtatatttgacaccagtgcattggtgttggtgtaaaccttgttgttatgtatcaactctgagttgtttcctgtttgaagccttgagctctagcttccccatacagtactacacccattattttttgtgtcgagatgctcatacattgagttatgtagtgcgtgctgcatgtacaaaatggtgtttccagtgatcccaaatccctaaagattctcttgttatgttgtacattgtctttgattgctatagtagctcttaagttttaattactccttttttataattctttcaggatctctcatgttcaaatgttttcagaaaaaggaacctcccttttgcctctctgttggcagttttgctctcctttttttcttcagactgttagctgtactagtgaacatgtatata

SEQ ID NO: 66757 - DNA, 4067 bp, Oryza sativa
gtagacgacgactgacaggtgggccccacctgtcagcgacagcgagggcgcgcgcggctgcggcggactgggccggctgggccgaggagagagaagagagattttgggcggactttgggcccaaagccaaaagaggactttttaaaacctttttcaattaaaattatttcttaaatgcaattccatttattaaaaatactttcttagctcaaataaatcccagaaaaatctaggaattatagaattaagcaaagtatttaatgaaattttatctgggcccattttatattggaatttattaattaaaattagattttcttttcaagactttttaaaattatttctaaaaattccatttaaacaacaatttataaattttgaattttcaggtgtgacaccgggcaaatattgtgaacgctgatctgaacgcagccttagatgcatttttagcctaaacaaagcaaatgataatttgctttccacaaacataaatacacattggcatatgtgaaataaaagtgtgttttgattattatttcatgatgaacaattggcacgagagataattggttatgatatttagaaatatatggtgatgaagtggttttggggctgggcagactgggcaaatattgtgaacagatatctgacgatgaacaagtttttctgctggagtggaccggtcagacaggacccttgctaagcgagcgtagctcaactggttaggtttcttttagtggaaccaatccacccgagttcaaatcctagatttgatacgagtggttgcatttatgctaattattctttgtttctcaaaagaaaaaaaaattacaaaggcaccctgtaaacaaacctcaaaataatagtatgactaacctcaatattccgagtaaacaagagtaaagcaagtacattgcatctcaactattagttgatggagacgttggtcagttcaacatcatcttctctattaccacatgtatatatcaaacactaatttcttggtgcacaaaaaagtacactattttgctccgacataatgaaaataatttcctgttgcagtgtgggtgaactgcaatgggacatcaattgtgcagacatatatacacaatgcatgaaaatgtaaaataagtttcggttactgttgtaatgttactttaatcagaacatgtcatccaactttcaaaagaaaacatgatttctaaatgatttggatttttcccatccccaaggcttagtccgaaatagctgctcagaaaatccataactcatgtttatagatcacattagagactacctatatatgtatttttatatatgtatttgttgacaaattttcactactatgaaaaccgtttttgtaaacgggcaaaacgtatttccacagacgatggcatggaagaaaaggtctgcaaaaaacacaattttcgcatgtggacacttgagccggccgcatgcgaaaaggataaatcacgaaaaaaataaaaattccaaaaattgaaaaatatacccaccgccggtccgccgtcgtcctcctgtcctcatcctccagctatcgctgtcgttctcaagccgccgctgacgccggtggatctgggcagggagggcggcggccggcggatccaggcgggggagggtcgccgccggtagatcggggcgggggagggcagccgccggcagatctgggctggggagggccaccgccgtggccttcgcccagcgccgctgccggaatctgcgtcgcagggtggcatcgctaactcctggccgcccgcactgcagcggagcccactcccagcacttcctcatcggccgcgctgcccgccgctcctggccgtgaatgcagcggcggcgcccgctcccggtgccttcttgtcggcctcgccacccgtgatagaagtgagagaggagaggaagagaaaggccttcgttagttgctagacaaaaacttttcaccacgtcacgtcgaatatttggacacatgcatggagtattacatatagacaaaaaaaactaattacacagattacgtgtaaattgcgagacgaatcttttaagcctaattgcgcaatgatttgacattgcggtgctacagtaaacatttgctaatgatcgattaattaggcttcataaatttgtctcgcagtttacgagcagaatgtgtaatttgttttgttattagacaacgtttaatacttcaaacgtgtgtccatatatccgatgtgatacgcaaaaacttttcacccctgaacgaaacagggccaaagagagggagagaagagaatgaaagagagatagaggtgaaggaagagagggtggaaaatatcagaggggagagagaggagaggatgaaaggtgaaaaattttgaagcggtgaggaggaaaatttttttgctagcggacccttaaaagatctgcatgcaaaaataaattttcgtatgcggacctttaagaggcccgcacgcgataataggctcatttttatttgcagccccttaagaggctcgtctaagaaaatagatttttgcatgcgggtctattaagtagccgtatgtgaaaatggaggtcatttttgcagacgccgccaagggtcctcgtacagaaagtttgttgttgtagttgtgaatttctttcaaaaatttgacagatataaattatagtataattgtggtgtaattttattttaacttacatgcaattatatttgcacatgtaactacaatatatcatgtgcaaccggtaaatattttactcatggatatacccaatatataaatacacatgtactacaggtaaatgcagcatattaattaattgaacacggtgtgtgttataatattcatatagaccggcaactaatacttttattttacatcatgaagtgatgaaacacgcggatgggatttagaagtagatgggggtttcagaagtggggtaggatagacagattttagtattgtctataacaaacacacatagatttagtgatcaatggatatgatagtataacatatccagctaataattggctagatatttttattaacttggaagcatctagtaaatatcatgttagtataggtacatatatgtaaacatatcagtagcattagagcccactcgagcacaacagtagcgatccatgagaacatcaggattgggtatttgcaagctaatgcaggtttctgaccaacgtacaacttcttgtcatcaacaaactttataactggacgcggccgaatccttgaaatgtgccacgcactactagaaaaaatatttttcatggcggtactctatttgttttactggcggttatataagaaatctgcttgtgaaattgtaactaagagatggagagtttaggaccgccagtgaaaatgaattgtcgctagcgtttgcttaaagtccgcttgaaaaaatacctatgtttttacaagcgatctcttaaaagacagccagtcaaaatactgattttcgctggcggttactaggcagcatcgtccttaaaaaaaatccccgcacattaaaaaaaatcaccgtgcgcgtttcccttaaaaaaaattgccgcccacctccttatccatccactcgcttctcctcctcctcctttttttctggttcctctccatccaaatccatccactactctcctctcctcctcccaccccaccggcagcggcggctcacgtaggcagcggcggcggccccgacggcagcactcggcggcacggggcggcgggggagggggtggctcggctgcggcacggggtggcggtgctcggctgcagcggtgcaggggagggggtggctcagcagcggcgcggtgacaggcggccggcaaactgcgatggcccacgcctcctctccctccccccccccccccggtctcccaccggccttccttcgctgctggccgccacgacaacgggggaggctggatccaccgccgtgacgatgggggtggccagatccaccaccgcggcgacggggagaccggatcagccgccgcagtgaccgtggacgccgaatcagccgccgcgacaatgggggaggccggcggggagggc

SEQ ID NO: 66758 - DNA, 2100 bp, Oryza sativa
ataacttatgcttcactattatttaatgatggcttaatgatagctcatgatggttaatcatgattggttaagtaattaatttgccaactaaaacctgataatggtgggttgtgagcatatggttttgatggttgtgctcatgacaattaaggaccggttcacgattttcggttgtgaaacatttaccgtgccatccacaaaccagcgtgggcaacggctttactttctgtatagtatggttcatagtagagcaccagactgtgaagtggcggagataagcccaccggggtcgctggggagtccataccttgtttataagggggtgattatgatccgggaacggtgcactgctttgaattgtgttatgcaggaggtattgtcacaatctctattcgggtacttgttaagtatcgcgacgcatggttgacatgatgttgaggttgtgtcttgtgggtacagtggtacacctctggctagagtttaaactattcgaatagccgtacccgcggttatgggcgggtctaacaatgtctttcgtgattagtttcacacctctcaccgtaataaataatgttgtaattggtaataacttgtttagctcctggtttggaatggtatattcctggtttggagatagaactgtgcagccgggattggttgttcagaatggttgggcctatgcaacacgggtgtgttgtatagtgttgatttaatattgtttaattactcaactgttttactattttctcaattgcttattaaatgctgtttatgcaaatgagactatactatgccatcctttgttatcctgtgcacttgcatatttgctgcgtggcttgctgagtatgtcatatactcaccttgcaatcattcatcagaggaggagttctacagtgatgctaatggtgtggatgattaggtgtagccctggtcaagctacctgtgaagaggagtcgcctgcgctgtttcttttattttccgctgctcagaactttattgattgagaggaactatctacctctgtaatgacattttattcgcttattaattagagtaataattgtactctattatcaatttgttattgtgtgcctcggctgattcctggacgagggtttacatacatgtaagcgtttagaattttggatagaaattccgggcgtgacaactcactggcagcacctctggccagctggccgccagcgaaaactattttttgtagtagtcacaacagttcagattggttcactagctcaggatagctcatctgtaataggcgggaagccttatctgtgtcggcgaggggtactgtcacgaaccaaaggttattaatgtgaaaagtcatatgtgtcgggtcagccaccatcacggacgaccgtcatccttatcgggcctaaataaaagacccaaactcatctatgacgggtcatagttaagacccgtcacggataagagttatccgtgatgtttcaagctcctacttccaagaactgacttttttgtccccaagagtgatgtctggcttgccgccgatctcgaccgggtcgctgccattgacttgtctacggctatgttccgagctttgagtgacaacatcaggtgttggcgtcagaacccgacatcgtcaatagcctcgtgcgtcgtcttaccggtggtaagccctttttctcatttatactttgtttggcccaaattcttactcgcaaaatgacgctttattgcctgctgccggtttactggatatgatgcaatgctcactaacattctaccttcctgcacagttattatatcttgacaacatactcccaccaacagacgttggtctcgatctagtgttcacccctcgtatacacgtgtatactaaggagattgtcgatcggctggttagtgcggatcaggaagctggaggggatggcacgcccccgttttgcaacctccctgtaagtgtttcacattccttcttccccattttcctttccattaataaaaattcatgtgctcacatacactggggccggcgtacgcgggtatttttaatgatcactaaatttgtacactaaaacccaatcataaagttatcatgagggctcctgaacaatg

SEQ ID NO: 66759 - DNA, 6585 bp, Oryza sativa
cccaggaaaggaaaaaaggggcacggcctgcggaaggaaaaggggaattggcccgggaccggcccaaaaggaagagagaaggttttaatttgtttttcattttatttaattgattcaatgaactttgtgccattaaaattatttcttgagctccgaaaattcacggaaaattccggagagtatattagggcataaagaatattacaaaatattctcggccaatgatttttaaaggaaattttaatttcctccataatttcacttgattaaattgatttatcttttatttaatttctagacaatgcattattaaatgatttttaatcctgaccgaaaatcggggcgttacaaatctaccccccttacaggaatctcgtcctgagattctgggatggctagaaagaaaactggttgtgcgggcagtctgaccgatctgactgatctgcacactgcactgtttttttttctgtttcggattgactgattgactgattgctcgatggaccaaacctgcataactgaactgatcagcatcgaccattctgttcttttgcttcaaacaactgaactgactggcctcattggattagatccctggagttctggtacccaacacgaccaattaactgatcaaacctatacgagtgatctagctggattcaaccctgctgtcccattgcttcccaaaactgaactgattggttctgcttgaactgacccaaactagggctgcggatgcttgtgaaactctcttatcttgggctgaaccgttgatactagcaatttgataacctgacagttcaccaagctggctagagaaggatggagttgttcctaaaacttatctctggcattcgtaaatcattgacccttaattcgcttgggctgctcttgacatgaacggtaagtattctaagaagctgcttgatcaatctttcgtctgaactgcaactgtccctgatgttgcttctctaagcggagttgttgaactagcctcacgggtgtaccttagaattcaatcggatgccctgagatcggtgtaactctgttgacaccttgcaactgacttattcaagtactacccgaattgttgcactaggttgaaccttcaactgaaacagcgatgaggtgagccaaagctcatctctacgacctaccccccttacaggagtagtcatacttttcacctaactaggaacaattgaactgctggccttggaaaaaaaaccaacacttctctgattttaaaaagagtcctggctttgaagactgaaaacttcgtcgatcaatcaacatgaaacaatgacggtgcactttcctcccgacaagatttgaaacttaacttcgttgatgataggaaattccatacagaggaactctcatttagctcataaacatactgactcatgactaacattcccaatcagttctactgctggcataaccgtcctgcttctagcctgacctcggtgccgtatgcctggacagattgcatagtcgacattctttgaagcacacactgaccacttaatggatcaaactcaagagtccttctcatgacataaccccacacgtcgattattattatttttttgctgactcttcctagattgatgaactgtaaaccctgtaactgctttcccaaaaatattgtaatctgcgcgactgccagaagctgactttgatgctgccgagagtttctgttctctagtcataacaacttcgctttcaaattttcggtaaagatgatccgttgaaaggggattctctgccatataccctgcttgactacacatttttgaacttgactctgtatacttctgacccatgtattagaacaatttgtttttttcaacttctgggaaacctcatgaggattttctggaatttatagcggttgccttgaactatggaaaccattcttgtttcgtaatcacaccactagggtgtaattgccgcttaccattctctaacggtttccaagggtagagattccttgtatgatgttacttccgaatatttttttcgttactccttacacttgaatacccttgatactgcctttggatagatttcatagtgtcgagcgccatggatccaaccattgtcacttcattggttaatcctttctttactggctcacaaacaggttttggagcagaacaaaagtgcgatgagttagaagggaaattcttgggtttcttgtaacttgcagatacacatgttaacttccttttgcatactcaaaggtgaaaagaagagaaccgcttgactcctactctattcaatattcccttttcaactatatcactggattgggacttctatgcacaaggaaggtatttcaacaccaaaggcctgtgcacaattgttgactcttgctgacagaactgctgatcagtagcacatttacccattgtaattctgacatggttgacttgtccttttgttggttactagctgaagctcccacaagaacaaaactttgacggatgacgttcctaaggcaaacatcaatcctcttggtagctgaaaggaacgaaaccttctcactgtcggtgcaactcttctgttaattacttgccagacatctgagttggagtagcatgagatgcatggctgatgttgataaccacattgaagtctaatgcttgagacattgactgcagtcgatgctgaagaattgagctgtctctctacagtaaaagtagatcaccgattccctaacattgattgcccttctaatgctgattttgtagccttgaagcggttgctagcgaaacaatagaatctttatcggtgcctttaatgacaattcagcaagatggaaactttactatcaagtgactattggaagcactcctctttctagtgtcattggactggatctgaccacttcatataggaactgatgtaacttgaggaggcaaaggcgttctaaccatgttgctgacttgatgagactgacgctttggcgctgaacaaccttttgggagatgataggtcttccaacagttggaaacaatggtggactatctttcttgttctcgagagtagacccttactgaggtggtgtcccggctcgaggcgattgagacacttctcacttgatggatctttgatgtgcactcttcctgctgtgcatgctcccaactgaaaccagagcaaataactcataaccttggtgacaatgttattactatcattgtgggttgccgcgacagatggagctggtggaagggcggaagtattgcttctgttgttactgactgccataagttgacgaacatgttgcaaagttgtcctttggtctcattgccttagctagtaccaaactcagttgattatccttgagcacatggtatattccctctcacaagaatcgtgcgtcctttctctgccaaagactggactgaggtgtaccatagtttttgtaagcaagcgggcctggacctttcttctctcctgggcacggtgccctattgttggtcgttttgacaaataagtccaacgggtgattgaacacttggcaagaaactacccttgaaacccataccttctgtaggtatcacttgttgctcctaggattagtggtggcttggctgtgctggtctgctgaagacttggtggcgtactgtctgaggttgcaggttgtaacgctccgcttttcgtgagacattaaaaactaattcggcaaaatcctaattgcgaaaattttcgttctttgtgtcagagtctaagtcgtgccaggatctcaattcaatcctgttgttccctctcatcgaaatcaaaattctccacctcgaaattcctccttcgactcaaatctccaaatcaaattccgaaattcaatcgcatcctttgaatcctcggcaaatactcgctcccaattcccaaaaatatcaaaccctaccttgagtcttccttgattcctccctgaaccctcgagttcgaatatcgaatttgaatctaaatacaaactccaattctctccaaattagctttccctgcaaaagtctattttacctccctcgggtgttgtgggccgttttccccccttagcccacctccctctttcagccgtttctcctccctcagcctcgcacgtgcgttgcacgcgccgagccgagccgagagagagctctctcgctctctcgttctttctctctcccatcttcactctctctctctgctctctcccctcccggcgccgattcccgccgctgcctctgaattccgccgctccctcgcattgcgcacgcgctcgcccgcgcgtggcagaccgcccggtcgccgccgcgtcagccctggccgcctgcgccgcgtagccgcccatgccgcctgccgctcgcccccaccctgtgcgcgcgtgcgtccaagacgtggaggcagcgcgactttttgcctcacgcgctctcctctccctctcccattccccgtttcggcaagaacagagctcccttttccccctcctttttccattttgcacgacaccgcctgtgacggcttgccgccgcttggaccatgggtgtgaccgcaagctcctctccttgacttcctctcccgggagtcggttcgttcccctcgaagctcttcacccggccacctataaaaccagagcccctcccctcgaatcctcctctcgtttcactaaacataaacgccgcactattgttgttgctcgctccgctctcgccgtcgccgttcgtcgccaagcaccggggaggccggtgcgtgcgaggacgcgtgacgcgggactccgagcaccccccttcttccccttccccggcctgagaacggagaactcactcccgcgccgtcggccactcgtcaccgtgccgtcccgactcggtagtgactccctccgttctccttcatcgttctccctcgccctctctagcttgcgtggtagctctactagcccctcgaacgcgcgtagacgccgccccgagctccgccgccgctcggcatggcctcgctgccattgccgcccgcttccggaggccgccgccgtcgctagccctcctcggtgctcctccgccccatccgatgccggaaacggatttcttaaccccggacatgctcccaccgccttgaattgaatccccgtcacccctccgccgtttcccccttttctcgccgccggcgtgcgccgccgcgattcgtcgtcgtcggcccctctccgaaggatccgagccgttggctcaacccctctcatgcttccctttgtaccgatgaactccctctcgatcgaatcgccgcgtcgtgctccggtgaaaccccgcgcgtcggccaccgttggttggagctcctgttcttcttcctcctctcgcccggcccgcgtggctgccacgtaggcgccacatcggcgccacctcgacgcgaccgggtcaaagctgacctcggtcagccgcctttctccgtcccccaccctcgcgcgcggtggaatcggtccaccgggccctctctttcccccgcgccccctctgttgggccgcctccccgtggccgcgcccggcccaatggctcggccgagcctccttcaaccctttgggccgcaccaatgccacccgagataagtccaaatcacatccctcacccctttaattttccaagggatttaataaatctttttcctttgttccataaataaaattctttattccaaaattccatgaatcatttttctttggtcccgcacgtcagtgactgtcaataatattcttgagaatattatttctataaattccataaaccatttctcgtcttccagaaattccaattaaacttccaaaattcatatcttcccaaccgctcttccgattgactccgttcaacttccagtaattccgtaaaattgagatctatttaatggcactattatttagtctaaatagggtctttttcttggtcttttgtttaggtttttgtttgtttgcgtatagttgcggttaccggattttcgccgatcgcgggttttctcgaagattcgtgaagctccgtgaagaccttgagcaaggcaagtcaccctttgaccaattgctcctataattggaaaatcattattattttgtttgcaacttgcattattagagtcacacacttaacttgcttggcctcggtttgcgtgccaaaccgacggacctacccagtagtcgcactaattcctataggttgtactaccctgattccttgtcgctccacccttttggtacttcggtatctgtgctctttgagcgcgtataccaaatatcccacatacactgttgattgtcgaaaaattgggaaatgggtttgagaagccttgaaaacccgacctgtggtgtcggtgtgtttaaaaataaaatgtattgtgaaaactcgcgatgcaggggttgtgcctgcgtggcactgtcccgtattcgcatataaggaccgattcctgtgggaaattcatcaagcataacaaagtgcaaccacaaggtggaatgggacaccctagctaagtaactagtcggttcagggaaacctcgcatgccaatagttggggaacgccggggcggggtcggttggagccaacccgggttcctggtaaggcaagaacgcg

SEQ ID NO: 66760 - DNA, 4072 bp, Oryza sativa
  unsure (1)..(4072): unsure at all n locations
aatttgttttgattccctggttattggagtaatgttgtggttagaccgtattaggaactagagatctatgtctcaagctatcttgacctatcattctcgatgtaaaattcccgtgatagtcaatgtggacgtaaaatgcaccttcaatttgtgtgatgcacaaccataggatcaccttcgatgtcacctaggacatcaaggtcgtcctccgccgtagcaccaactattggaactcgttggtaacgaaaatctttcttactatcatgtcttaggcagggcaaggcaatcagggcacacacttgcgcctgtgaagtgacctccattgatatcgtgcatagtaggctttggtttaattgtgtaatatccacagagcctagcccatttctccacagccctctacttgtgaatttactctcgttcctcgcgatgaggaccccatgccaatttgctcccctctagctattacactcttcaattgtccaacttgcaagttgcgagtctttctactctaaactctgaactctgaagtctggaatccccttcacactttcacactttcacagccattgcgtctagcatcctgataataagttttctagtttttttttcttttgggattcactgttacattctattttttttttctgttttaaggatctggtttagggtaagaaagggctgaaagaaaaaggaaaaaatatattgctaatttatttgattattcaaagaaacatctatatatataaaaatctttacggtgtcattaagacaagtaactgaatcaaacagggctcttagctcaatcatacttggcttagtgacatttgcagattcatctctgtttcttgagcaattgggctgtgaaatgctcgccccagaaatggaacttttaaccacagacatatgcttattcctcttcgtctttttttggcgataactattttattttagggagcagaaagcgagcaaatcatctacgagattcccttcgggcacctaggagattccctgcgagcgattgtacgaaagtgacgaaggaaggaccacgagattccgtgggcgctacgaacgcgacgaacggccgagaaaagaaagagtagccgtttcgaaatttggtgacaataactggttttttttttgcgcaataagaggattaggcttgtgctgggttaattagcatgtgggctgatcagtaagagccagtactccctccgtccaaaaaaaaaagacaaaccctggtttccgtgctcaatgtttgaccgttcgtcttatttgaaaaaattataaaaaaaattaaaaagacaagtcatgcataaaatattaatcatgttttatcatctaacaacaataaaaatacgaattatagacggagggagtaccacactgccacagtagggctctgctgctgtctactgtgtattgttgctgcagagtggccgtagctacagccagccagttgaaacttgcagatatcatttcgaggttttctaaagcttatggtaataatggtatatgtggggctggtttgctttatgacctaaaattgaccttactaatttttgtcaatgtcaaatttttgtaagttttggcatggctaatcttggcaaggtaaagttgtgtttggactgaagccaaagcagtttcatttcattattgaaatggcctatttttttaggcatgccaaaatttggtttcaaaccaaatagacactaaacactattgaaattgtcaaatattggcaatgccaatttaggccacaaatcaaaccagcccatggttttttttactccctccgtcatataaaaaaccaacctagtaccagatgtgacacatactaatactatgaatctagacatacatatgtccagattcgtagttctagaatatgtcacatccaattctagattcgttttttataggacggagggagtacttacctactagattattgaaatgtgttctttgttatacgtttctaaaaatacatttttaccaaacaaagtttcactgtatttttcaatcagttggtttaagttatttgttaattttatctctaaaacatatctttataaccaaatcgataatccgatgcaataatccatttaataatcaaacttttcgttaccaataatttggtaaggccaggaacgcagctcattctaaatgccacctaaactaccggggctttcacacacctcacgcactcgacactttggaacagaagacaatagtgcatcgcaggtaaagaaaacgtgaacacacctcacacacacaaaatggatatcctagtctggccaaatttttggatgatctcatcgagcatttttatagatatttattttcgaatatcttatccacatctactcatcagcctaatacactcaaaagttaaatggacattatctatctagaaatatcttttccaccaaacacaccataagatgaacagatccacgtcagaaccagttgcatccaacagaagcctactcagcatccacgtcccagtgaagacagttaaaggcgtagctcccccgaaaaaacaattaaaggcatatctttatatactcatgatagacatacagcgttcaagacacttttataatattatactacctcagtcgctttgtcttatttcttagttaatttttttaagtttaattaagtttaaagaaaaatatagtaatattttcaagttaaattaacatactagtgaaactaagttggtgttatagatgttacttttttttataaacttaaataaaattaaagaagtttgaatagaaaaaaaaatcaaaacatcatataatatgaaaaaagagtaagattttaaatatttatatatttttaaaaggaaaaaaagatagcaatcaacgaaacgacgacactaccggtttaccacgccgcccacgcttcgccagggccatttcgtctttaaatacggacactagaccagaggcctacctgtaacctgttcgtccagctccaaagtctcaggcgcacgcgcactgacagcagcagacagggcgagcatggcggcggcggcgaacaacggcggcgagggcggcgacggcttcgacgtgatcgtggtgggggccgggatcatgggcagctgcgcggcgtacgcggcgtcgacccgcggcggcgcgcgcggatcctcctggagcggttcgacctgctccaccaccggggctcgtcgcacggcgagtcccgcaccatccgcgccacgtacccgcaggcgcactacccgcccatggtccgcctcgccgcgcgcctttgggacgacgcccagcgcgacgccggctaccgcgtgctcaccccgacgccgcacctcgacatgggcccccgcgccgaccccgcgctccgcgcctccatcgtgaacggcgccgccaccgaggtcgcctccgacgcggcggcgccgtggccgtggtccggggtgttcaggctgcccgaggggtggacggcggcgacgagcgagatcggcggcgtgatgaaggcgaccaaggcggtggccatgttccagtcgctcgccgccaagaacggcgccgtcgtgcgggacaggacggaggttgtcggcatcgccaagcaaggtaagacaccgatcgatcaagctagagcttagcttagcttagctatgtcgtcgtcgtcgtcgtcttcctctcgcccaaccaaccaaccaaccaatctcgttggaagtatccgggtagctcttgcatgattgcaactttgcttgcatcacgtgatcagtcgctgccaaccaaaatgccagcggcaaccaccatgcgagagctgagtgagctcctgctccttgcgggaccattgttcttgttgaatagtaccgcaggagagaagataaatattgaacacattgtactgagtcttagagacccggtatacataagagatacatatataaatatggggaaaatatgtagtgcaaaccacatatgtagtggaagcttggaaactactgttggatcgagcaatagacgtccgagattcgtccacggggatcctctagagtcgaaaggcggngcaccaagattgnggttgttcattntcaaanggacgcgcg

SEQ ID NO: 66761 - DNA, 33916 bp, Oryza sativa
  unsure (1)..(33916): unsure at all n locations
cgcgcgattaagccttgagaatcncttcctcgcnngccngcangncgactttagaggatccccgttaaaatttaactcgcagatcattcatgagttaaaattttactcatggtaacgtagacgaatctcgaatgtccattgctcgatccagcggtagtttccaagtttttactacatatgtggtttgcactacatattttcccataaacatgggaggagtccacataaatcaatcctattataatatgactttaactactggtcgttgttcagtctggacaatattggaacaggtagccaaaaattagagggagggggttcctaatggatcgctattattggtagttaattaatatttgaacaaattaagcaatagttaatgccgtttactccatcaaaattcctcccattctaattttgtcactcggaaaatcaattcctcccattccaattttcctcctatcaactaactaattttcctccatccaaattaatgcgtgattttccatcttgtgttcttatctcatctcaatggtttacacatgtgcatatagtttccccccaatcttctactctcatatcaatactgtactatgagaatcaaaatattcgtgctagtattgagagtgtgtcaccatgacggtaacactactgatctcttttaacatgaataaatattcaatgtaatttttattgccgtaggaaaaacgtctatcttaaagtttacaatttactataccttcatagctactactatagaaacggagtcgtcctcctttcgttctctcctcccactgctcgtgcccagcacaacataagagcataaaaggaacaaccattagatcacattcttaacctattctcagccatataaacccgttgcaatgttcagtcatgttactagtatatagtacaaaaagaaaaaaaaattaaatttagggcctaaacctaacattaagcgtgcatcacccaacttccaggcacggccttggctctatattcccaagtcagacaagggtgaaaacaagaaatgtattgtctcattatttaataaataaataaatctggttagcatctttgttattgcattattacaaagcatgtgtcagcttattgtacttttaattagaactgaacgtctgttttaattttatagcccccctattgcccacatgacataaactcagataggtcagtacaagattctagtcaagtagctatttttttctcttaaaaaacttatttttagtttttttattcaaactgcaaaacctatatatgtgtcaattaacaaagttcttgatttggttggacatgcatcaggaaaactatattttaaaaaagaaactcgtcttttataaagattgggtaccagcaatccgttattgcactaaaaaaacatttttcatgggtttaatttccattccatttttatttatgcccttcagaatcatatatactagcttgcacataatgttagtgaaatccattagctgatttagaagtgaaaaatcttttactccattagcatatcaaacacttaatttgatcaggagacggatcgatcgtggtgaagacatcgagcggcgaggagttccatggcgccaagtgcatcatcacggtgggcgcctgggccagcaagctggtgaggtcggtcgccggcgtcgacctgccggtgcagccgctgcacacgctcatctgctactggcgggcgaggcccggccgcgagcacgagctcacgccggagtccggcttcccgacgttcgccagctacggcgacccgtacatctacagcacgccgtcgatggagttcccggggctgatcaaggtggccgcccacggcggcccgccgtgcgacccggaccgccgggactggctcgccggcgccggcgccggcctggtcgagccggtggcgcggtggatcgacgaggtcatgccgggccacgtcgacaccgccggcgggccggtcatccggcagccgtgcatgtactccatgacccccgacgaggacttcatcatcgacttcgtcggcggggagctcgggaaggacgtcgtggtcggcgccgggttctccggccatggcttcaagatggggcccgccgtcgggaggatcctcgccgagatggccttggacggcgaggccaggacggcggcggaggccggagtagagctccggcatttcaggattgggcgtttcgaggacaatccagagggaaatctcgcggaaaataaggtcaaaaattaggtcctcacaggtatggtcgcctgcgaaaattggtgcaacgtgtgaaatgtggttatcagtagggggtttgtttaccgtaaatctattgaacattgtatttcataacttctatgtgtgctttatactcttggatattggtagattgtaataatttgcatcttctctgtccttgtgtataagattcaaaataaagttgttctgttgcatttcttcatctttttgcaaaacacaaaatgttcctcattttgatcttcactttttttttcctcgggagagaatcacactagtgctgttttttttttccctcgggagagaatcacactagtgctgttcctattcccagtcctattcatggtagatatgccgttggtgaattgaaagagacttgggtgttcgccattgtcggattcaggcagtacacgccgcaaacctcacaaagttaatcctttggaaacaaagggttattttggaggaattttgaagggattcaattctatagaaaattttctcatgtgatcctttggataaaagaaatagctatctaaaaatcctatgaaattcctttgggttcactctaaacatacataggggatttgtaggaatttcaacataaggtccaacccgtctctatctttctctcttctaattcctgtatttcctatgctccgttcaaacagttacatttttatatttcaaatgctcttttaatccataggattagagatgatagctccaatactatattttttttattgttcctacattttaagaattctgcattccaaatgggccctctgagcatgaggaatatgctaggatttgaatagctccaaaacgttgagtctttctaaatacgtcacgtcttgctgcaactatttcttagttttaatcatgcatgttgcatggtgaagaattatcacttacatctagctataacaacatgtgttacatgctagctgatgggtctcattcccatgactcatgagtgatgagtgcgtcaagtcatgtgctgagaaagtgacaattcacttgttgtttttgttaaacaatcaaagagatgggcacaatatctttgtatcttttcagtctgatgtaatggtgcaagtcctaaaaaatcagtagtgacaatcgaattgagccacacttcggttgcttgtcctcattaggtggcatcgatatcgcacaagtgaattaatgcctatcgatctgatctgaagacttggctgttttcaatttgcacaggtcatgttcttgatcttatcatttgatagattgtcgcatagtgcgttgtcatcttgatactatccaacactccatctgtatggagtatctggtgagacagtgatgctttagctttcgcagtacaaagctgtctctgttattgatgactggtacagtaggttcaagactgaagaacaacaggctagtggagatgatgaaatttggagtgatggattgttggtgtaattttcagaaggaaaaatcaggccggtcctgtgcacagtgggcacttggcaccattgacttgacctggacttggacttgttttttttttttttgcagggactggacttggacttgttaaagttcagcgtaatcaaatcagtttgggctgtgtttagttcacaccaaaattgaaagttttgttgaaattgaaacgatgtaacggaaaagttggaagtttgtgtgtataggaaagttttaatgtgatggaaaagttggaagtttgaagaattattttggaacaacacacggcgcaaatgtctagctgaaattcagtaaattcagttgacgaagtacatgcatgtgtctcgtcaatgtgaatatttctgaaattctgtccatgactactaatgtttctactatctagcaatatatttagatcttctgaacttgagtacaaagaatagaaaattaatgaatttaatcactgctaatatacacgaagaataggactaatctctgaacttctcgatcaactgatctctgacaagccttcttgatcgtgaactcgtaatctcttctttggtgcagttaattactactaggagatgacttccattaatggtgtgctcaaatttcccaattcttcatgcttcactgtcagatcagaaaaggaagacgagcagtagtagtagcagtagcagtagcagaagccatggctgggtgcatcgtgtgctcgccgacgacgccgtcatcgtctcaggctcatgtgctcctccaccgccgttgtagtatatcggcggtctactgccgccgccgccgccgccgccgccgcggtaagccggcggcgcatttccgccatcgccgtcgatgatctgtgctccgaggaacacggcgtccgacttattgatcctgcagcaagaatcacacagctattaaaatttcaggaatttcgatcccctcgaccagaaattatttcggctaaatttttgtttgggtaagacaattttcattcagatttaaccaaaatttgccctaatgtaacctttttggtccgaaattttcagaaaaccctgcaatttccgaaatttcgcttcaatgggtaaatctcagcaattccacttctatcggtaggttttccacagttcccaaaattcatgcaatttccgatatttcacttccattggtaaatgtccgcaatttccgaaatttcacttctatcggtaagtttccagtccctgaaccaaaacctgtccaagtgctaacttttttcaatccaaacatttcccgaaatttcgcttctatcggtgtatttccgcaagtttgaaaaattctcctggatctatcggtaacctgtccaagtgttaacttttttcagtcctagaatttcccgaaatttcgcttctatccgattttttttcgcaatctccgaaatttcacttctatcggaattttctatcggtgaatttccgcaatttcgaaaaattctcttagatctatcggtaaatttcagaaatttctcttctgtcgtaaatttcggaaatttggcttccgtagctgcatgcgtacccggaggtagggaggcagaaggcgatggtgtagtcgtaggcggccttgcaggtgaaggtggaggtggagtcgtcgtacgcgtagctgtaggcgcgcgggcacgccgtcttgaagatggccgagtacgccgtcggccggcacgccgccggcgtcccgtactccccggcgcagcagtacctgtcctgcccgaacgcctcacacgcgctcctgcacgcgatcgccccgccgccggcgcacttcacctgcaacttcctcggacacgctgcacacatcgtcgtcgtcagctccggcaatggcgaagtggcggcggcgtggcgcgcgttcgtgcgtgcacttacagcggttgaggtcggccatgcagccggtggcgttgcaggcggcggcggcgccagggatggcgacgacggggaggttgtagccgtcgacgaggctcacgtcgtagaagtcctcgccgccgcccctcccgagggtgacctcgaacagcgtcgccggcggcgcggcgccggcgccgcggcactccacgcgcccgccgcagtcgcccgtctggcacacgccggcgccgtcggcgtcgaacacgcaccccgtccgcgcccatatcctccccgaccaccccgccggcgccgccagctgcgccgtctgccccgggtcaagccggaaccccgtcgtcgacagctgtggcgtgccggcgccggcgagcgtccccggccatatcgggtgcgaacaatagttcgctatagtgaacgtcatcgccatggaactgcacgaccaagaagccgccattgccaccacaagaagccatagcttgcaagctcttggctctcccatggctcctatggctcaaaatttgggaattgatgttgataggaagaagattgagcagggaaggggaagaagacattgagagaattcttgcaagatttaaaggtgcaagtgccatgatgcattgcatttttgcatgtttgcatgcaaagaaagctttttcttggtgtgcttggtttagcatgttgcacggatggggtggcctaggaaagaagaaataccttttgggatgatgcaagcttatgatggtgacatgatcttagcatcaagagaggtgaatcttctgatgcttgtgctaatgcagataccttaattactagtcaaacatgctatgttttgaatactctgtagtctgtacacagtctgaacatttggacagagtacatgtttgtgagtttgagcaaccgggaaaatggaaatgtacagaatacttttcttatttggatacagaaaaaagacttgagctgaactctattacagtattagaatcagtagtcaggataacagcatgaagattctgaatttgctatcatatccatgcgctgcaagcctgcaattctcattatccttcttttttcttagtctttatttgggtttgatttactgctcgagtagctgctatctcagaacattagttcgctacatgtagttctgaacacttcaacctatcggtaagcttgtaaaatttatgatccatttttgcgtcagacatgctcttcaattccaatttataaaatcaaggtgcaagactgcaaattcattttgtctacaaaaatgtcatgtgttttgtaaaaagcgtacgatccatttcatacaagattctttcaggaggcaatcatgcctttggaggaaaactgcaaggaaggaatcatacaagaaaactatcaacatgaacaaccggcacaaagatcaatgaagatgacaaaagatgcacctttttgcagttccataaaatcaaataaccttgcaaccagaccagataaagaatctattctgatttgattgcacaaaaaggaataatcaagctggaattgtgacgcttatggtagctctctgtatattgcctacctttcaagatacccttgactgaacaaaacatgtgtgaactgtaagctagtccatgagaactcagaaaaaaatccatttcagaaagggttgagaacagctaactcatagtgcagcactacgaccttgtaaattattagaacccaatggaagattacatgattaggaagtttccatattgtacagtactcatgatcttatcagaggcacaacaaacaagtggagacctactgcagcatcactcctctgacacaggttcctcagcaccaccttcgggaacattggagtcatcaacaaccgtgacaccctcaagatccaaggggcgcccagtcatcggatgaattgggcgcctatcacgaggtccaccctttcgagccatagctagcattggaggtggaggcagaagcccagctcgaaaaaggatgcgctgcacaggatctgatggctgagcaccaacagacagccagtacctgcaacagaagtataattgtatgctgttacatggccttgcaagggagggaaggacatcatagcattcttctagcaattaactcaaagaaagaaatattgggaagatcagactcttgactctcgacaaggtgggcaatgaacactggcaactagacaatacaggatcaaagatactagttctgctattgatgaaactaagcaccatgcttgaaatgtctgaaactttatatctgtaattttcttccctgttacggatactgttaagcaaatctcatatgcttaaaatctctaaatccttttctgctatggatggatgccagtaagcacatctacaagctacaaaattcagaacccttgaatccatcattttctacccagagaatggaaggcacggatggttggaaggtacatggtaattggcaatacaattaaatagtacacagaagcaataacagcaccccaactcctggaacgaagatcgcattacaatgataactgaatcagtccattttgcctatcaaacaatcagtttccatcaaagaatcaggctgctatagcaatgtcagtcctagactagcatcagcaaaagctccagcacgccaatttttctccagaggaaatactagaacacatcaaacactccaaattacgagcataagcaaatgaaactcacttgaccctgtcgaatttcagccccatcctcttgccaccatccttccctgcaatcagcaacagaaagcacatactcctccatcatccatcaggcattcaatcacaagcttacagccaaattctcacgcacgtacagaaatgtttcacactctactaatccctctccaatctgatccgattcaccatttcaccaagacgttgaggccaacgccaaccaacggggcaaagacaacactcgagaacaagccgatccaggaggagcacgagggggggatatggaggaggagggctcaccggggagcgggttgtagtagccgaggacctcgaggtgcttgccgtcgcgcggggagcggctgtcggcggccatcacccggtagaacggccggttccggcagccgaaccgcgccagccggatccgcaccaccatgctcgcctcccctcgcgcctcctcctcctccgccgccgccgccgccgccttcccttccccttctccggctcgggtcgcgtcgtgttcactcctgtgggagcaagggttttggatttggattctggagaaacccaacaaaaaaagaagaaaaaaaactcagcgggctttacctctgtgatgggcctgatgtcccatagagtatgggccttccagctagagcttgttcacacgagacttctttctgggctttagcccatgggccaaactccggcccacttatggttatacttggttaggctcctgaatggttattagccatttaagctgacttatgcattggccaatcaataattcaatagtagctccatccattcagtgatgaacaaaattaacacgataaaagctcacataaactgtctgtaaaattaatgaaaaaaatcaatagtctgtttggacaatgtgcaggaatactgaaattgcacaagaatcggcccaaaagaagggaactgacaaggccagaattcatttgtagttctctgctcttaacacatttgataacctaactaatggaaatcaggaagccctggtctgtgttttgctgaagtctggaggcctggagaatatagcttgttgctcactcagtcacacccaattgatcattgtcatggttggtagacgaatgctttttcctgcacaaaagatggaagcacacatgctgaactttgcccaagaatgagtgcagtaagaatggaattggaagagaaggatgaggcacaaaaaactgaacaagcaaaaggcttacttgtttgtattggcatcgctctctaacaaaaccgaattggcaatggtattttgttgtctaacagacacaaaaagatccgtactggcatatggcatgctttttctcacctaagagcacctaaaagtgaaacaacctgcatgtaaagtcattttcttgctatgacaaacagctaaggaatctgtgtcaaaacaaaaaaactgattactcctttagggattagcatcactgaaatcatgagagaataaaatgatgtcttacattcaatgaactgatgcatcaaggaccttgtacctgtagaagtaggacccttcagattaggctgctccatgtttgaagaataaaactgtgatttagtcatccaaatgcattcatacatgttaaagaaggcaaaatcttttccatcacatacttttcctagcattagcatgaacaaacaattactgcgaacgtcaagaaagtaacagaggttcaaaaatgatataaataaattagtagatgatgcctaaaaataaaaacgataaagaaacaaaattttatatgcatgtcaggttgagagaaactctaaatgaggaagatgtattggtatgtctaggtagtttatttacccttctccctttcttttctccaactcccaatgtttaactaagatagtctatctcgcattattccacaggcatctattgccacccataattttatgtcccatttggtaagaaaaatgattgattgctgaacccagaagtactgaattgaattattgctagacaggttacttgtgctgccaacaatgtccatattgagtactctctactatgctactgctagatgtgaaaaaatatatatactcacacgttttccttgaatgtcttaaaaagcaaagagaaagtacacaaataatacaccaggaatacgaatagaaagagatgccataaaaaatatatgttctctggaacttcagtaatgatcctgtaaaatcaataatcatgaaagctacccctgtgatgcattcatccagaagaaaactagatactccacattgaaacttccaaatggctagccaatgtgaatttcataattttatatctctgttagtttctgtgtgcatatatgaatacttagctaacaaatcttggcagtggagtaaggatgtcgacaacaagcgattgcgtgcctaagcttcttacaaacaactttgatggcaatggttactctgatctggtcgttgtttggacgctgacgttaatgattttgcaagtttatcagtaacccaaattgacgcgattctatcaatcagtcacccagagtagttacgggtcaatctctctcacgtatcagtgatgtgtgattgatctgttcaacttcaaagagcacaaatgaagcccgttcctactttttgttttactccatggacggcttgcgcacggagtttaataataatgtggtcacaaacatgagtacatgactgccatgcaatttcatattatgaagtgcttgacaagtaaatatcattttcatcacaaaaggttctttgatgatatacattggaacttatgctgtgcattttgcagtgaatcggggagcataagaaagacaaacctgcattatggcagtaatacagggagcacaaaaagggaccacaaccttcactaccagaatacatgagtcatttggattaaattggggagcatataagggataaatctacattattgcagtaaaccagggagcataaaggggacaaaccttcattatcaatagatgagtcatttgggttgtgctgtgcacttctctcccttggataataccattgaataatatgcgtgtcagcaaagaaataaaagttttctcctaatttattagatttttcatcacattctcaactgcagtgcttcacatgggacacatgcaggagatgctttagtccataacatttatagttcacaagagaaaaaaaacaatcaagctctagaaaagagagtacaaacttaattataatttctgaacgagtagacaccgaccctcttctcttaattagaaaaggaactttaacaccaatctttgttttgcattagtttgaaatagcattccattttttctagccacaagcttcataatacttttgtttcttttagaaatataatgctcctagttctgtattgctttatttgtaaaacaaggaatattaagaaacatgaatgtgacataaaaggcattcacaaaatccttcttcagcgcaagtttttttaagagcatgcaaattgtgaaaacaagatcatattttctgagcccagaaaacatcagaacaaaatggaatactctatctattttaaaccactgcagaatcagatcacatctaatcaaggcgacatttctagttcacttgtcaaaaagtttaaatctggtagtaatcccagaacaggtgaattatcacattatatgcattttcttgtctggaaccagggacctagcacttaatcaaagaaatttgattacctatcttggagcaaaagtagaaaaataaattacttgaccaactagtatactagaacatcaaacatagaagaacaaactccgggctgcagcaacaatcataactccatatccagctttagttataacgtcaattcaacaacctacattaacacaggtgttttcttgcactgcattgttagggaaagaatacaggttgctacttcattggcaaagcataaatcagttgtgcataacaaactggttccaccaacagaagtaaacatgtacatattaccttattaggaagtgagtctttgctgtaaatctgcacctcaccctctagacaaaccaaaatgctgtctccagattacccagcacagaagtgcagtacacagctagctagcaagaagtgatcatgaagctgaagacagaatagagatttagttgcaactcaatcattagaccactaacatgagtacatggcacctcaaattagtattcatttgcaggctactttttgttggtgtattaaatccattttttttccttctgactaactcataagtacagtgttgatttagcaaattacatacagagaatttacaacctctatacataacagtagaaagatgtaggtaacaatcatgatatcaatgctgtggcatcatgataatctgcagcagtaaaaagtaggctctttacttgaacactttcccagagattagaattaataacttggaacttcatagcgattaccattaaggcttcaaattttatcccagtcagtagcaggagtacctgtttcttcttgtttgaacagaagaaagaaccatttgattagctgaaaatagttcagaatgccaaaattgggtattggtaggaaaggaaaccggtttccttgtccttactgtactactccttctgtcccgaaatatagctacctttgtacctttgtttgaactacaaaggcaactatattttgggacggagggagtatgtgcttagtaatgagatctaggcatatctttgtaaaatgccatctgttgctagaggcctagaagcatcggagacaagcaagctagcactttgttacagtgatatgtttctttaatatacacggaaaatacactctacaactccacctgtcaccaaaagaaaaaatattacgatcagttacctatcatgatatcttcctgcttgtcatctacaaataaaattttccatcttcatggcagcatcatgttggattaagtaaaaggattatacgttaaccttccatctataatatagttcaacgtctgcgatcatctgtaactctacgcttctacagagacactactgattacgatggatacagcaatgtgaacatgatctttgaagtttgcagcctgttaatcttttcagattaataaaacataaattagatgagggaggtagaagctacctttcaaaactgtagtaacaaatagtttttccagttttataacactacatctttactgtgttagttaaaacttatttcttgtactcaaccaccattaacttctcacgttcagggaaaacacaaaattatagtagcttcctgtgttctaaaatttcagatggctgggaaaaacagttcatgatgttgaatgaaaggaaataatctgcagattaatgccatcagacacattttcaaaacatttaagtgaaatgctcataaaatccattcctggtcatgttatcgtctatgtcagtttgaatcaactttgcaagcattcctatcatccaaagaggtcagctggaaatgtaacatcctgaccgccttttaggtgtgcgttttcaaagaaacatatccatgcattgaaagaattgtaatttttttggctgtggagaaaaacagagggtggtagaaagctccagtgtactttcctccagcaaatgaagtgcttcacaagttatgaatgattcactgaagccaaactaactaatgtcaaatggttggtttgccagatatgaactttcgctaacgacaattttgttagcaacagcatcaatatcataggatgctgttcaaaataattgctcaactaggctaatacctgtacttcaaacatttctgtttctgaactaaaaataattatgtgatttgagagccgttaaaccgcccattcggaaagctgaatcccaaggttcttggccttcaccttcacattcttccccatcactactgataccgagacacaacaacctgaaatgtagtccatcgtaagcagggacggatctaacttgggccatggtggttcagttggaaaacccccaaattcttttggggaacaaacaaactgttacttgtagtagtagagaagctagggtttaacgcaagcatatccgatacaagagagagagatgcggatgctcaccgggatgtggctgaagcagcaggacgacggcgcccctgttcctgctcctgctctgctcgctcgggagatggaaatcggcgcaggcggtgggcgaactcgctggagcggagacgagacgggagttttttcttcttttcttttttttctttacgctgagtttttttaaagaaaaaggaaattgcgcataattaaatgagtcaggggtactgtttgctattaccagtgatttgctctgcgtcgtaggttggtccagccgacggtccgcaaacgatctgtagtgtcatattttttttcttggcttatgcttttatttattagccaaaatttgaatttttaatcttagatttgaagttgattttagggggttttttatcatattttattttccaatctttgcttttagatcgttaagaacacgtatataaaagttttattcacaaattatttttcctttgcaaatatgccatttggtttattcccccagtaagccaaacaacggggcgctcgtctaactgattcaattttgatcatggacagaaaaaatgcatctaaatttgaacttttttggaaaaaggaaagtttttccaaataaatgtgaaattttaagaaaaatgcatctaattttttgttaacggataaagattgctcggattcgggtaaactaaaataaatgtacaaataaattactcgtcgttttagctttgtcataagtaaattgatgattaaagattagatatatttaatttaggagagaagtaaaacaagtaatttagaatggagggagtatcattttcatccagccaacctttggtctggtctttcgtgaaaaaaaaaatccttctcaatgcaacatggacacaccttgcatgattgttcaacgcaagatccttgactccatgcaaagttagcatagagctttcatgacgcaatggaagggaaataagcacaccactgcagtttagaaatcagatgaaatgaaatgttctgctagtatttatgacgctttaacattaacctttgaattaaccataaaaaaaactgacggacagaatgaaatctgacaagagcacagtgaatcagtgatatcttccaaaatggtcactagtacaacagcataactcatcaagtagtttgttgtgacacttgacctacactagttcttgcatacatctgtagtccattctctctgaaacagttatcatttttgtcatatggtgcatgcaagctatctcccatgtatattctacttccaaacatttctatcattaggagcagattaatgcaaaccgcaagcaagttgtcaagtgtttgtacgattgacagtgaggttacagcacatgcatgacacatccttaattaggagaggcaaaaagaagattaacccacaagaaacctgacataaacttgtgagattaagcaaaaataaacataagctctgaagaaaacacattgctgccagtcaggcttccaacaacaaccacgatatgatctctatcagagtcactgcatctgcagctaattaagcctctctcgagcgaactgtcaattcctgaacttgctttcacaaatcagccgtgtaaaccttaccctgaagaaatacatttttcaaaaatctcaaatcacctgagcagttcttgacttcttcatcccactatttcagctatcatctctctttctcagtggcccagtttgattgttctgaatagatgaataaatgacagattttctaattgtgtgatgaattttgagggtacgaatgaataaaattaactagtgcaaagtttaaagttatctttaaaaagtatttgaagcaatttatatatagaaagtttttataaaattcacactatttaagagattggatagtgtgccggcccgtgataatctatagtctgtttgtgaaaaaaaatgatgacctataaattctacaaaataatcttgtcagaacaagctcaagaaacataagacacaatcaaaatctttaccattcagtaaacatactctgtcactgaaacagtcatcagatattcacatatgtatcagtgtctcccaaataaagtggagtacatagaaaatgaaaggatgaaacatgacaaaactggtcagtagcaggagccagcccaagagggcaatttgaacggtcaacatgaacaagaaccctagatttaggaaataatattaaagaacaaactgtttttagggaataatttgggtactgtgacctggtgagtgatgatcaagaatcagattatttatctgaacctctgcctcggccacaagtgattaaattgctgtagtccttttagtcaagattgcatgatcctactgtcattgtcgtgatatccacaagacctggctcaatatggattacaggacaaggcaaagttcctgcaaaatggacagtacacaccattgttttctgctgccaacaattgcctacttgcctgtcactgtttgcaccagtgagcacgcactggtgcacctttcgttttggaattgaaggatgagattacaaaaatctgttgatttaaaatatctcacttttcaaaataaatttgctagctaatcctttctctaagcaacctgtaacagtcttcaggggaaatttatatggttatatatatgttcagatcatgcttgcgaatcacacaaactaattaagaagcactgctgattccctgtattgataaaaatgggatctttgaattggcaaactgatgtgatacatgtattacattaagtttttgaaaaggtcaccggccggggtattacatcaggtaatcaaagggaaacaaaccattcggccatcttgttaattacatcaaaaatcaaaccactccaatttctcacaatctggcctccaggagtgtatgatcattgttcgtttatcacgcccaaaaatcaaaatatatagctaaaattgtggatattccgatcaaaccttagctctagacgaggaagcacgcgaaaatacagttaattggttctgcatatatcaatacaagcattaattaaattaaaaagacaacaagaataacaacagaagttacaaaaccagacacaaattaaggatcatttgatgcatcatctctgtatgatccatggctctgaacagctagattacacactggcataaacactgtttgccccccaaaattattctacgagttggttgggattagaggagacccagccccggcgccccggcctgcctgaccgactgcctgccttcttgcctagcccccgggtcaaaggggcgcggtgggcccatctgacgtgggacccacacggccccccgggccccacccgcacgtgtcctgttttgctgagtcacgcacgctactactgtctactgtgttcatgctgttcgtcgctacgtacgatgactactcgtcggtgtgaactccacattagctgattaattgtgtgtcatatactatgtaaattagctcgatcgatcgatagatagttttgctgcgtgcgaccagcgatcgcccacggaatcagaagcagcggattaattatctgtctcctcttgagtggtaattaacgcggtttaatggtaatatagtcgatccgtttgatggtttctatcgtttgacttcagaaatcttcagagagaacttaacgcaggcaggttgctgccgtacgtgcctgtactacatacaaatacaatgaaattatgcaaaaacactagttcaacaccgaagataacaactaagccccatatgatatataacaattactacctttcgtctcaaatatagaaacttactccttttatgattttataatatagtaatctataagtatcatatgtatatgtgtgctacaaacctgaatatgaaaagtgtccaaattcattataatagaatgtgtcacacacgatactcatagattacttatattataagagcgtaaaaggagtaagttgaaatagcacacacgatactcatagattacttatattataagagcgtaaaaggagtaagttgaaagaagagctgaagaagcacagtaaaacctactttcctggacatttagagtactgtcatcattcacacattgatcatttcttcattatatttctattctcctattctcctagtcgaatagcaactcggtcgcgttgccgtgataggcgatagcttaattttgtccacatagctgaagagaccacaccgtcaactactgttgcatgcggcgacgacgacgacgaccacgccgccgggctagctagctaggctagcaaacggccggcgaggcgaggcgagcgagcgcacgcgtacgtggaaattacaagctgacaaaaggccgatcgcttgtagctgacgacgcccggttggtacgagcgtcaccaacacatttccgagcctccccttctttgtctccctcttatatcatcatccttctccttcgcccttactttcatggaaaaaaaaaacaattaatccgatcaaaattaaagcccaaaagttgagatagctagctagctcatcaggagagagtgagagacaatatccagcttgctaggtagctagctgccgtttgcgtgttcttctttaatttcttcgtcgcataatctgtctcgtctctgataaactttttatcttctttttttgggtggtcatgcatgctgcggccaattcgttcttgaattcgttagctactccattccatatatagattcgatcttgtcctagctagatacctagctgctgctgctgcttcttcttcttccttggtgttgaatttggttcagccgctgctagctatagctttgcgcggtgttcgtagggttagggtttttgctgtgtgttcgacgatggctatgggaatggaaggatcgggaggaggagggtcggcgaaaaagaaagaggagagcttgccgccggggttcaggttccacccgacggacgaggagctcatcacctactacctgcggcagaagatcgccgacggcggcttcacggcgagggccatcgccgaggtcgatctcaacaagtgcgagccatgggatctcccaggtaattaattaattaattaaacaaacatgtgtttgcatgcatgatcttgtgaaattttatatgctcctacttaatatctccccttctctggctctctctcctcgatcttactcacttagcttgctttcgctgtggattagcttttgtgttcatatgatcatattgaataattcatttttttcctgcaatatatgaatagtttgtactacatatattcagaagtgcatgtttgttgttggctatgcatgtatatgcatgcctagtccttttttcatgattttgagcatatatttcttacctatccttgccctgccagaggtaattagtcgcgtctagatttcaaacatgcatatatggtgcaagtttttcaatagctaatccaaaagtctaagctcttaaaactactacatgtgtgatcctaaaagaaaactatgggatggatttcaagttttctatggtattccttttttttttccttactgagtcttgcttgcttaaaacatgtgaatatgatatcattggtgatataatatcttggtggtacacatgcatatataacatattcaatcccccttctctcccttcccttctattagtgtgagtacgtatatctataatctatatttgcatcgtctttgttctcttcttttttaaaaaaaaactttcctgcaagagttggtggttaatttggaacacataaacttcttattgttatttctaggggtcttatattagaagctatcttaattctatgttctttataaaaaaaagtaaaatatcaacagaaattacaaaccaaagctctagcttcagcactgtatgtgcatatgcatcgtccttactctcatatatatatgtaggagatgtttatgaggttctgaatgttcaaatatgtggtcacattttttcacacttacacattcacaatctatatgttctatgtattaattttctctaataaatgtgctccagagaaggcaaaaatgggagagaaggaatggtacttctttagcctaagggatcgaaagtacccaactggcgtgcgcacaaaccgagcaactaatgctggttattggaaaacaacgggaaaggataaggaaatcttcactggacaaccaccagcaacaccggagttagttggaatgaagaaaaccctagtgttctacaaaggaagggctccaagaggtgagaaaaccaattgggtcatgcatgagtaccgactccactccaaatcaatccccaaatcaaacaaggtaaacaattcaattgatagtattttcaaactcactactatacacatgcttcactaaatttacttgtattaattgaaatgtttttgtgatgcatcattttgtttatactcattatatgacaggatgagtgggtcgtctgtcgcatatttgccaagactgccggcgtcaagaaatacccctccaacaatgctcattcccgatcccaccacccatacacactagacatggtcccacctctcctcccagctctattgcaacaagacccatttggtcgtggacaccacccttacatgaaccccgttgacatggcggaactctcccggtttgctagaggtacgccggggttgcacccacacatccaaccacaccccggttacatcaacccggctgcgccttttacactatcaggccttaacctcaaccttggatcctcgccagccatgcctccaccaccaccaccgccaccacaatccatcctccaagcgatgtcgatgccgatgaaccaaccaagaagtactacaaaccaggttatggtaacagagcaaatgattccaggactagccaatggtgtcatcccacagggaacagatggaggttttaccacggatgttgttgttggaggcactggcatcagataccagaatttggatgtagagcagctggtggagaggtactggcctggtagttaccaaatgtagtcctgaaggaaatgcttggggtactgccaagcaattgttggtctattatgtaggaagacataattatttgagctaccttaatttagtctatggatattgtatgattacttagctaatgttgtacccttgctttttagtttctcagttctcttgtacctctagattttgttttggttgtaacttgtcagattgtagaaactagaggactgtttgtttgacctgattgcttgtacatacaccttatatattagtgatcagatcatggatagtgctccgctgtgagattgtgaggggtataggcacatagacaaccaaagtttaaggctagttcgatttggaggaatttcacgggaattttggagaaatcgacctgttttctgtgaaaatcctataaaattcctacgttccgggattaatcaagatgatgcaaggatggaagaggattattcgaccagtatgtgcacgctagctgattgcattattgttactcgagagtttacgtactctttggcagtaaattaatcaatatgatgccaggatggacgtgcaagatagatttgtacagaatgggcataataagttagcgcaaccaatttcaatcatcaaacgtctgaaaagctcacgtatgtacgtacgtgcatgaggaactagtctcagaagaagaagtagcagtatacagcactaaatcagggcatgccatgacatgacataaaactatcagagagctgacacggattcattcatgaattgcgtcttcatgtagcaaggaggaagagaaaattaagaagaacagaaacaaaaaaaaaacctggagtaaaacaaagctgtacaaacttcagtgcagaaacaaatctgagatctcgagtggcaatggcggcaacaaagaactagcaaggtagcacagcagttgaaacttattaacaaggaagcaaacgattccagactgagcggtggagttctgttcgcccggtgtgcctgcagttcctgactgacttaaatttctcgccgggccccggcgtacggaagaccttgccggcggcggggggcgccggcgttgaagggggtcacgacggcggggagcggcggcgacgtgcttggagagagagacggatggggcggttcaccaaaccaggcgaacgacttgttaggggccgtttagtgtgacgcatcctacttgggccgaaatatgttggcccaatttcggatctccaccgctggtagtggatccatattcgggtgggctcaaagcctcaaaactctggcgagccaaactgggatgggccaactggatcattcagtggtactattacggaataagttcaccgaaggtctcccaacttaacagcgatgttttttgagctctcttaaccacaaaaccagaaatgtttacctctaaacttactaaaatcgttcactcaaggtcctataacagtatatatggatggtttcgctgacgtggcatcctagtcagtatttttctaaaagtacgtggggcctacatgtcagctgcacattttttttcttctcttttctctcctctctttctcttcttcggtgagagaggccggccgcaggcggagcggtgcacgcagatgcgggtggcgcatctgagggcgagcgcggcggcggcccgagcagtggagcgcgagcgtggcggcgggcgagcgcggttgctgccaaaaaagcggagggcgagcgcggcggcggaacggtggagggcgagcgtggcacacgattaactgcatgatgcatgcacactgtgcagtatgaacatgaccgattgatttaatttggggtacctcctcggtacgtgctgttgctatcggtgaagcagacgtcgccggtcctttggtcgacgtcgaggccgttgtggaagttagaacggcacgccggcggcctccgtcgtcaccacctcggctagcccgcctcgcaccggcgccctcaggaggcccaggtacgcgtcagccacgtacaggtcgccggaggcgtggtggaactacagccccagcggccggtcggccgcccgcacacgctctccggcaccaccagcttcttctccggcgagcaaacaccgacgctcctagtggtgaacaaatcgtcagtgcatacagcagcggcggagggagaggaggcagccggcgacggcgagctcggcggcggcgagctcaccttccgacacatcgcatacagcgccacgagcgccagactggccgaggcgtagaaggccagcagcggcgcggtctttatcccgtaggcgtgcgcggcgcgagcgggaaggaaggcggatgcgcggcggcagcaggaaatgacacaggagaggagctcggcgtcggggcgaacgaccgcggaggtggagaagagggagagggcctcccgggggcggcccgtggcgggagagcgcggaaagggtggtggtgtaggacgagtaggcgaggaagggagagagggtcgacggggagagcgtgtcacttgccggcgacagggcccgaggtcgagcacccggcgcgttcgaatatctctgccgctgagcttgccgtggcgccggacgccacctatcctctcccgctgctgctgtcacattggccgcctctctccctctcccgccgctgccgtccccgctccgccgccggacacctctccccttctgttgccacgcctgctcgagagaacctggagagaagagaagccaaaagaaaaaaaaagagagaaatgtgatacccacaccattttctcacttacatgtgagccccacatattaattttaattatttttgctgactaaaatgtcacgtcagcgaaaccaggcttctatactgtcttgggaccttttatgcacggttttacatagttcaggggtacacatttctggttttatggtcaaggaacctcagaaaatctcggtgtaaagttgagggacggccggtgaacttattcctactattactctttggcagcaaaaaaaaaaaaagaggatcgacgtgagaagtagattagatctgacagccagattaatcatcatgtctccagagcttacatgcataaagaaccaacaaaagtagtagcaactagcaagctccacatccgtgcatcccatgcatatcagaaagaaatcaatcacagcctcgacgctgaattctgtctgttaaacatgaagaagtacaatactacagtttcagtaagtgagagcccagaaaacgaggcagggattacacaaccacacacaagctctaaggaaaacgcatgaacaaaaactagaagacatgaccaataaaatgaataagcacatacagcctccatgtccactaaatcctactcagcgaagggcagatcgacagttacagaaccgcaattacaactaggtccatacatggggggcaaaaatacatagttcttgtgtgatctagtgtaactcgttaataatacaaaccaatgcttagcgatggcccgggatatcctactctgtatgccatccgagatctgcacaaatgcacagtacaaatcaatgtcaagccaatagcagaagcctataataatctgtttaggcctttataaacctcactctggtctagcttttagttcgaagtcatactgacatttgtaacaaaaatccgttcaagcatactttctttttataccgtatgaattgagaagagactctgtaacttcagagaaaacgggcaagcatatggttcgattgatccaagattccatgccacaagcagtatatcgcgagctagagcacattacatgaatcggattttaccacttaaataggaacaaagggtgcagtaccttctccaactacaatgtggcagaccagacatgaccaaaatccaacatatatggtctatttgtcagcatgccggcgtttgtgtttccgatggccatggttagcattaacattccgtgtggctttcttcttcttcttggagctacaaggaaatgaaaatattaagcttaaataacaaataaaaaacagatatactagctgataagcaaatagaaaacagaaataccaaccagaatgtttcaaccaggacattgtaaaaaacataaatgggcataatcagcaaagcagaagcctgcaaaggtagttaagacattatattatggcctttcatacttaaaaccacttgaagcacagttctattagtgccctaccaggtaccaggccaactcttcagtcgcaaattcttttgtcaattcatgttggtgcaggtagtccaagacagttgcttgagcctggaaaaagaacatatctgagattccggaatatatcttgaaaccgatatgtagtgtaccacacagaagaaatggtattccatgcatctaccaaacagtacacaatatatactgtatgcaaagagaacagacagaatgaggtttgagtatcacgacactgttttgtccaatcaattagctaaggaaattttggaagaacttgcacaaaggaacatcacactatggaggtgattttatccaagtacttgtgttacatccatagcatgaccaacaccaagcatcaaccaccagaaataatagaatttggagcatttataagcattaaaatgaagaactctcaagaggtaagacctcagcagtcactagggaaaatgcaccgaatcactattattacaacaatacaaaaggtgtgttccacacagtcttattctccagtaggataaaaaaaaacatatggaactatggaagttacttgacatgctactaattaagatcaatcacagctaccctaagaagcaaagagtttctgaattcaaaagcaatgggggaagtatggcagaagcataaagtatgtaaaccaataagctgcaatgcataggaaaaaatggaagggaaaaaagaaataacaatcacctgttgatgataagctgtagccttctcaagaaaatttccatatatatggactgctctttttgtataaggcttcaaataaattctaattttctcgacatgtggcttagtggccttagcaacttgatcaatgtaaggtttggatactttcttggcttcctgaaaaaagacgcaatcatctgattataaatcaatgattatatatactctaaaaaagaagctgcctcctatcctatcataatcaaactgcctcctggcatgtacaactgtgaattcttgaaacggcaggaccttagatgtacctggaagtagggatcagcaatcttatgtgctttcacaacatgaggtaagacaacatccttagatgcttgatagagctctatagattttgctgagaccttttgcacataaggctctgcgtttgtcttcatggtaacccatttttccttgataacaggtatccatttcttcaaaaggtaaatgccattgttagtgaaagatgatcaaagagtcaaaaacttaacagacttgtgatgctatatcacgtgataacatcaagagttgtccataaatacgtgtgattaatgcaatttttaaaatatctcagttttactctgcaaccaatttcttgaactgcagtatcaggaacaggtaataatattaccgtcttggcagcttctacatgtggctcggcccatttctttgcctgaactgatttctctgatgcctgcagtgatttagttcacagaatataaacgactgcataaatgacataattgacattttcaatgtttaactaaagtaatatgctcggtagcaccttctgcaataaactgttaacagcaggtttcccatgttcattccagtgacttaacatcatttcctgcacaagtcaatgactgatgagaacaagcaaactaagaagagatatttatactttatcatcagttataccttagcacgagctgtgtgtgtcactaaccaaggtggcaaccaagctccatgaacctgcataagtattaactggtagttcagtacgacacttattgcagtgatcagactgaaagtagtaggtgacttccatgtaacaatgggaagattacttttgtctcatttattctacagatgtaataggggctctaccctgttaatctaaggaaaacaatagaaatattacactcattatatgctcaatcatcatctaacagtcaggagttcctaattctcaggtaccaaatcatacatgatacattcataataaggttcagtggttagaagagtattgcgacgcacaattccgtcagaatttaacagctgagatgaccaactaggctgcattttgaacatattgttcaaaagtcaccggtacccctcaagtccagtttaacattggtttggatggcatgtcaagtttgcggagtaaatagctagggcagcctaaagtctgagtaatgttatcttactggcatagaacaaatctaaatcaaaacagatagcagatgcagaagaagaatatttacctctttcagctgatttaattgtgttgttgtttctaactgcaccctcataagctcctcctaagaacatgagaagcaaagactgaagagaatggcaccaagaaactatatcagagtaatcgcatcgatacaaacctctgcaactttaagagcatgttcagtcttctgaatcctacgcttttgctcatcacttgtcttttggagctattaagaacagtataatataaagataaggagaactgtaaccaaaaaagagaggtgctgtaaatatattaagaacaattaaaatataataacgttattcaacagataattaaaagatcatgaagggatatacccatgtttccaccaaaactttttaacaggagagcgaaagaaatgaaaacatacaggctcatctagcctgtatttgaagttacttcatgaagtactccatcaacttttggcaataccgtgctagagaaatatcaccttaagttttcacaggaatgcattgcaattcaagatattcagcaaatgcacgtgtgcaaattttctttgcggaaataaagaaatttaaaaccattgcagtaggaataaaaaatcagggcagctgcatacttactttctccagcttagcattcagctcttgcaccttcttatctgcatcaccagccctagcctccacagttgatttcttgctattttgtgcttcaatatccttcttcagtttttcaatctggaagaggttgaatcagaaaacacagtatcctaattgtcacactagaaatctggacaaatcatgcttccgctacctgcttctcaagctcaatagcccgggcattggccttgcctgcctgctcctctgcagctaaagatctctttgtctgtatatgacatggaaaaggactataatcacttcaagagtgtaaaaaaaatgcttcaaaagtattatcttttgtcaatagatacctcaagtgaagttatctcactctgcagggtagcaattttctttgacttctcctcaataagcttttccagcttctggatgccgtcatccttgctcttcaactcctgggtctgttttgttatgctcgactctgcaggatgaaaataatcaagctcttctacactaaactgatgtcttttggaagaatcatgcggcatgcatgctttaaatgacctagtcgaaagatcatatgattcaggctttataagaaagcccgaaaggaggtccatatagaattaccagaaattgatacaatccactctcaagtcacaacttatcgagactcggtaactaaatatgcatctgctagggacatgctggtagctaacttcttcagacttactggattccctaatagcagaagcttcctcgagcattataacctagttccaagcaagggtcactcatttcacgtgcatccttttctagactgaaaattccggtacatctcacgggaaattcatgacccgttacaggccaaatcagcaaatgcaggtaacgaccacaaggcttttgctcagaattgaaaccatttaaggagatactcccagaacaacctagcattcctccaacaattccaaatcagcatcaaccccctcactctaaaccactgaaaacacctaagcccccattccaaatcaccaaatcaccgaatcgctccccacattgcccattcaatcgcgtaagctccccctagccgcccgcatctaaacgcctccaaaaccctaacaggtcaactaaaacccatcgaaccccaaatgaagcagcaaaagcggggggcgcataagcgtcacgaattcgaatcgagcgtagacattacacgcacgcacctaaggcggagatcttcgccctgagctggcccagctcggccgcgagcgccgcctcctccttggccctcgccgcggtcgtctcctccgccgccacgtccccgagccccgcgttctgcgccaccgccgccccggcgacgagcgccagcagcagcagcagcctcgcgatccgcatcgcgagatccgcgcgaacctgccttcctccccgcctcggcgcacgcggcgcggaaaagtggagaggagatgggagcgctcgccttcgcctcgcctcgcctcgctcgctgtcgctttctctctctctctcgggtggccaagccaacgactcgttttatatggagctcacgaggggagaggggagcacgtgggcatggctggcactggcactggcacagtgcggcgcggcaagtggcggtggccggcgtgaggcatggggtcactgcccggtgggccccacccaacccggccagcggcgagcggcaccggcgttgggagagacctcggccgcggcccatttagagcccatcaaagccacaccccactcgcctgtcttaggtgggcgacgcgcggcaccgcaccggcgctggaagagacctcggccgagggcccatttaaagcccatcaaagatacaccccacgcgcctatgttaggtgggccgggcccacgggtaagggagatttggcccatttaggcacgggaggtagcgaaagaggaggaggagccgtcaggccgtcagtgtctttgctcctcttttttcttcttcttcctccgccaccacccgactcggcggcctctgctcctccgctcgttcctctcccgacaagggtgggtgggttgggttggggtgggggttcctggtcctccacagtccagggagctgagccgcgccgccggccgcaggtacctgcttcgtgccgccgtgcccagatttcttgtggttttggcgtgggcgtgttgttcgtctttgattctttgctttatccgtctagacgggtgcggtttgggtgtggcggtgtgcccttccccttctcaatcgctgtgtgatctctgcgttcccgtgcagaggattctgggagagaatcttggtaggaacgggttgcgtttggtgtggttgcttggtgtcgaattctgtttactgttcttggttggttggttgattggttgcctggttggccggcctagtcggttccacacttcattatgtttgtttgtcatggggataattgttgatcaagctaatgtttgcagtgtcataattgcaaatcccccgtttctcatcttatagtgcgtagtgcgttgtttcatcttaaggcagagtcacagagatgatttttcttacatgtccatgatgtgagtcttctattgttgctctgtgtaagtactaaagtgcccaaaagtccaatttctgcctgattcggcctattctatgctgtgtttaacaaggaaatatattgttcttgctccgatttgttcgtgtggttggtcagtgtaacagtgttcatagtaatgcataaacagttaacacaccttgtattggacaattgttctgggtcactagatttcaggatttcttaaaaaatatctatggtttcaggatgtcggatttcttagggaaaaaaaaaatctaagatcatcttttctctcagatggaatgtagagagcttttctgtatgtgagtaaaagttttagcaactataattatgaaacacccctttcattcaggcttgcttttgcaaagatgtttgacaataaataccatttcttgaatcatagagtacagaagtggtcagcttgttgggcactgtgaaggatctgttaacctctgcctatatcatatttttgtatctatttatgtcattgatattatttggcaatctagtttcctaaaagaatatttgtcaatctatttcttattgttgatcaacaaaatgtaatttctaatttctaacctttattctttgtttgttagccttatgacagacaggaatggaccatttggtaggctccctgaacatctccttgtagaaatatttatccggttaccaacatgcgaatgggttcaaatatcatgtgtcagcaagcactgggcaagcatatttcaaggagaatgtatgtggcaaactgctattgcaaggaactggccatcagctggtttacggaaacgctggcctgggccaattcccagaggttctgctagaaggttagttttgtaatctgatgttgcatatcttctccatcatttgatggtgttggaaattttaaagttttgccagagtctgtctgacgcatgattgcttgctgctgtatttgagtatccactttaaaacaaatacacaaatctgaaacaagatgaaaaaatctcagatatcaaatggtttgcatcaagtttattaccttacgttcctttagtaacatgctttactagatgcctagatctactttaagcagctgagtttgaagcggcataaagagctgtgttccgctatgcatgctcactatcccaaaatcttaagaatagcttctctcttcggatacgatcttccatctgaacattcaataaaaaaaagtatctctcggacatttataggagattccaagcattatacgtcagccagaaccttgtctcatctggtggggatattgatgaacttgttggccacacttatctctatttgaaagaacagcttgagcgcccagttgttgctccttccagcatactccatggcaccatcatcggtgaggttttctgttccaagttccaactagtccaaatatagagtttattgtagttcatgtgttggcgtgctttttgtgttgagtgatcattatgaaaatcttttctcaaagataaaacacatgggaaggatacgattaaaccatgtcaggtacaggaaatttcgatagcacatgttttgtgtctgacattacaggaagaaatggttgatcttgtaggattggtaacaatagtatgaactcgtgattcaattgcatggcatgctgagttactgcaagatttatgtatgttcttacttttttgagaaaattttgttctccaataaaatgaaacctgggcagattctcaaacaaatgaagttcctatttttcctaagtggattcgcgtctcaaagaggcctttaaagctgcttccgatctaaaactgataaccatggattgaattttgtggtacaatgagactcattttcagcatcaagagtagagcttcatcactgagtattgcttatactgacgttattggttgctcacactgaatttaacattgcctcacccttctatgtacagatcagttcattgcttgtggtaggacaggagaaaaggcacatgaacttgcttcaaagatatggcttgcagttattgacaacttggaagaaaaccagcaaactttcttgctgttaaaacacctttctcaagaaggagaagtaagttcagcgtcccaattttatttatgacctgtgtactcacatttgacatgtcaatacaatggacgtgtcatccctcccttttccgtaagttatcaaaaatatctcttgcgtgaaatgatgcatttcatacttcttagggcctggctaggtgcatcttcataaaatagctatagctactatggtgcattctgctgttatttcgttactagaataaaagtaaataaaatgaatgtcatatttgatatgcaactgtgcaaagtgcaacaacttgctgaaaactgttatatttcgctttctgcttgcagtttttccttccattcccatactccagatcatataaagtcttgtggagggtgttcgacaagctgttcaccgacttccgtgactgcttcagccgaggggattaccatgatgcactagcgggtgccaagtctaggtttcagccagtaccatctgcatggcttggccactgacgagcagttgctgctcttgttgtgcactgcacattgccttttagatgtagcagctatactttctgaaatgcaaaactggaccgaaggatggtacttccattccaatggatgatttgtatatcttttagtgtcttagcaacttcagaaacaccaaactgttgtctgatcgaaaaatatattctcttgtaaattctaaacattcagaattacccgacttctccattttcggcttatgatggaacttattatatgaactcttacctatatcaagtcagatgtggggtattggtacaaaacttttacttgaatacaatgtgtgctagtttctatacagaattcagtcctctagtaaaatgataaatcggtgtgctggaggttaaccggggatcctctagagtcgacaaacaggttccaatatagattcaaatggcgcatc

SEQ ID NO: 66762 - DNA, 9576 bp, Oryza sativa
caataataaaccttttgtttagataaaagttaaattaaactatgaaatgttatctaccatatgccaccatatatacatgtgttcatgtaagaaagcaatattactagagtgtactagtagtaacgaaagatattataggagttttactgcacattcactagccacgcgtagtagtacggttgttgggagagattatcgccgagtttagttccaaactatttcttcaaactttaaacttttccatcacatcaaaacttttctacacacacaaacttccaacttttccgtcacatcgttccaatttcaaccaaacttcaaattttgacgtgaactaaacacgtcctatatttgtcacctaacgtgactaaggcatgtaccagcagtatgcagcaactgtacttgcacagtttcaattatgagttggacttgagggtgagcttatgacgagatcagctgacgcgagactaattaaaacttcacgtcgtcaccggatcggctggccggctcacaattttcaacttaactagaaagaaatacgcgctacgctgcgccgtttgaagatgatgtacatgccacaactatgctacaatgtcatgaactgaagtgtataaaatagcacctggtgccaacatacatatgagtatagctttattgagaaaacatattgttttatattgaaaaaaaagtatcactacaatacgtcagcagaacaaaggacatgcatatctgatacaccacctacgcagaagatcataaagattatgcaatgtttgttgtatagtttgtaaagctgataaaccattggagtatgtcaaaggagtaacttacatatgtaccgatgattttaatgacaaaataagagaagtaatatcgtatatagagaggttctcccatgtacagtctcttttatgtaacataaatcatgaccaacagagtaaaaatgtcccaattaccaaaacggcacaaaatacacaccatgatatagtctaaatataggttttgggatacaaatatcaccaaaaaaaagtagaaatagatgtctttttcaacagcagcaatgctggctcggcttttgaaaggtgattttctgatctttttggcagtaactaaggtggtatcgctcttgtatgagtttatctgttgtcacgtcctgataaattcatcccgaaataaaaatcattttctaaaaggaataatagaattaattaaaattcgaaaagaaatggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaatgattttataaaaagaaaaactctaaaaagtcctttttccctctctctcccccttgggccggctcagcccatctccctccccctccctctcctctccccgcggcccactcggcctctccccgcgcgcgcgccgctgacgggcgggcccgcccgccaccctcgctgacgggtggggcccacccgtcatccccttcctcccgccgctcccgccgcctcgcccgcgccgtagcgccgccgccgccgcgaatcccgccgcccccgtccgccccgcgtgcaatcaataggggggaaatattccccgtgatcccctccccctttccccccatttttccctctctctctccctcggattcgtttggaaactttccccctaacctcgccggcgccatcaatggcggccggatcttccgcgcccgtttccccctcgtccggccgccctctctctctcccaaccctatataaaccttccccgtgcctccctccaccgtttccgccactcgccgctctctctctccaccggaatcgagctcgcgccgtcgctctctctctccgccgtcgccgccgagctccggtccgccgccgtcgtcgccccggaccatctcccgcctcggcgccgcctccttcggcttcgccgcatcctcgctgacctcgtccacccctccgtttcgctcgccgaccgccggagcaccgtcgaccccgtccacccgagccgcgccgccgccttcctccgctccggtcgccgtttccgtcgtcgccgtcgacccaaggtgagccgtggaccgccgattcgtttcccccttccctcccctctctcggccgccgctccgccatacctatggccgccgccggcgaccataggggcgcgggcgcgccgcctcccgccggccgcgccgccgtggccgtcttcgggcgcgccccgcggctgccgcgtggggcccggctgtcagccgctcgcgcccttaggtgcggctgacgcgtgggacccacggcgccggccggtgcgagcccgggtgcgcccggtccaccgtggaccgtggggctgccgcgtgggccccacccccgtggacccggtccgcgcgcccctcccctcggctgacgcaataaatccattttaaattaaaatttaaatgaagaaattcgcaaatattcatttaaagagcatataaacttcaaatggccataacttggccatttgaactcggaattggaccgtttaagtctctaatttttccttaagaagtcaagaacccatttttgtgctttgttcctgcttgttatatggagtttattagagtaaaagccttttcttttccgttggtcgtgtagacgctgcagcttcggaggatccgctcttcgtggaagttgaagccggcgtttgggaaagcgagcaaggcaagtcacatcatccttgaacatattgaatcccagtttataaaattatgttgctttaaattattgcattatcgctttatttaaattgccgcgttatcactgttttatctagccatgcctatctacctttgttatgaccttattattattgttattgttattattaccttgttcaccctagattaaacaaaaccccaactagtggacactctactcatggtaccactagtatgattttaggtagatgcttcgcttttttaattaggtaacattaggtggtttttcaactctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggtcttcgggcctctgttgcaaagtactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgttatggcacagggctggtgtcctgctgctaggggctcaatcctgcctacctgtcccggaggttccggccgtaggtggggttgggtcggtactcttgtctatggctaggatgggttggaaactatgtcacgtcttccgtctgtataccgtggtggtatgtggcacgtggttcacgtgaggaagatgtgtcttgtgggtaaagatgtacacctctgatcagagtataacctattcgaatagccgcgccctcggttatgggcaagccgagcaatgtacccaagttagtgttttaattcttaaaatttgctcaacaactaaaatgtggaatggttggactgggttggcttgggacgagctgggacctagggtcgggttgccagttcggtctgaatcatcgtaggccttgggttaaggcaggttcgtgcgggttcacgaccttgattaataatactgtgtagctctaggatcgtctttttaaaatggctttgggcaactaagtgacttttaaatgctgttttctgcaaaacttaacccctatatcattaccccttgtacccccttgcattaatggtgcatccgccggtgtggcttggtgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcattcgggaaaatgcaattttctcggtcgcgacatctgttcacctaaaacacattatacgcatcagaaaggaatctcctgaaaaaaaaggagaatagccaaaactgatttgcaaaagatgatgcaatgttattgcaaaaattaatgagaaaaaatgtgggaataatatacacacagcaataagttactgggatttgtacttccagcactagaggctaatttatacaaagagaagaaaagagaaatagggcatctatcaacacatgatggccatggattaagaagtggcacaaatagtaagtataagagaagtattctatcatgaacctaagatagaatcttataattgctggtgaccggcaacatggagaatttatatgcatagaacattcctggtgctgctagcatattctagaggcccgaccaaactattggatcatggcagagacagtggtgcaaagacaaatagttgcctgcagtcttcatcatttgcacattacattataaaaataagagccgctcttttaaaagttttttgtttggcagaatataagtttgtaggatagcatttcataattacctgcttcaatatcctatttatcgaatatggggtaacagagtcatctaaaacaccgccaagcaatgataaagcaatcataggctttatttcctccatgatcttatcaactttctttattgaactcgaccaacacaacaaaccccataaattaatctaacaacgcatcaataatagcatgtacatcatctataatatctgcattctacgcatcattgtcatttctggtagaaagcttggcaatcctaataaaaagtatatccttacagtgcatatcctgttggcagaatgctttcatataagctttctgttgatagccttgtagtgatgcctagcatgattttttttccatcgatgtcattctatcaagctaggtaaagtggcaccaccatatcatataatatataatgtagcagtacaaccaataaacatggaatttctggcaactgaattcatattaaataatctgaagtaaagaaaattctcttaatagaagtgaggcataattgcatatgatcattagaatataattaggcttttgttaaccgtgccgtggtaaagaagatgaatggtgtcctgcaagatgaatctccctgctgaaactgtgagtacccctttcaggatagaggtaggaacaacatgaaacagttagtgtttcctaaaattaaacaatgatgcacatgaacaatatggaaataaataaaaaacaatgcacctgcatattgtttgtgttcttcaaacttgaatccataaaactgcgcatgaatcatgaatatgatcatgccataaaccaaaagaggcaaacattaatttaaggaatatgatatcctttttaatcctagttcaacctagacagcgaacaacctagttgagagagagaaccaacctacataatcataagagaattgtattaacttgtgatagaatgatttcttgccttactgcatgaaagaattaatattattccccacactacatggaagcaattaaaataaaaaaggaatcactgggttgtagttaaaaacaaaaaaagaaaaggaaattgttacggtctagttgcttaatagagaggacagctcgatgggtccctcagcaagatggcacgatagagtggtagcacacaagacatcttctctctatctgtgaacaacacctcaccctaatccatcagtcactcgacggaacctaagggtaagatggtggatcaagtaaaaaaacacagtaaatgcatggaagatgctaaactgaatcaaataattgccttacattgctgtttttgtgtgcaacagcacaaagcagaatgggaagtagaggaccatgatgtgatgggatggctgatggcgtcaatctttggcggctgaaggagtggggaactcggggtggatgggggacgcacaaccaggaactcgaacgccggtggatagagaccacgcaagcagcgtcacggattcagttgccgctgcttcaccagatcaactcccgccggaagcttgtgccattgaatagtgatccaccataagctcgtttcgtggatcaagcacatctaccccctcaccgacaccactggcaaggcacgggatcctcctcaccggcgccactagtgaggcgccggatcaagaaaggggcaacccgagaagcccgaatacctccggttggttgcggcaggggagggccggtggaatcacagagctagagagagggaagggaatacccggatcccaggtaattagcaaaacatgcatatttatttgcaaatggtaaaacatttataaattgggatcaacatgctcaaggggaatgtgtgacttgccttgcttcttcaaaacaatcttccgaactcttttcctcgcgaccgcggacttccgaaacgacggaaactacacgctggcacgcaaaacgaggaaaaactctaataaaaaccaatgaaaaagtacataaaaagtaaacaaacatgtagagctcaattttagatgaattttgcaagttgaacggctcaattcggagttcaaatgaattagatatgaattttagaagttttgagccatttaaatgaatttctagaattattaacgaattattgcgcaattactaattattttccaaaggaaaagatcatcgttgatgtcagcaaggggcggccggcgccaacatgcggcccccacatgtcagcaagcaaggggacaggcgcacggtggacacggtccaccgcggcctcgggcgcgcgtccaccatgtggatggcccaaatggggccgggccgatccgatggaccagaccggccacggcggggaccaaggggaggcggccagccggcggcggagcgggcgcggcgcgcggcagcggcgacctggccggacagccaccggcggcagcggcgcgacgcggcgctggcacgggaggtgggcggcgaaggctaggagggagagggagggagcgctcaccgagcagcacggcaacggagggaggcaagatggcggcggcatcccacgggcgaggacgacgacgaggattgtgcggcgtccggcacaggaggaagggtggccgagggtcgacgatacctggggaagcgatttgaggaattaggaggggaagaggggactcccgacgacgtgaatcgccggccggaggcaagaaaagcgacgggtgctcaccggtgtgcgatggaggtggagttccggcaggattcgggcgacggggagcggtggccgaggaccttctcgtccttgcggagccgagggaggcgacggcaaagcgggggacggacgggagtggcggcgattggcggccggaggcggcaatggcgacggtggctcgggttcaccgtggagagggtagcttgagggtggaatgggggagcggcgtggtgactaggcttgtccgcggggcagcgaagccgactgcggtggtggcagggcgcgggagcggctcaggcggcgacgacaagcggctggaggcggattaaggtggtggcggctcgggtgcacggtggaaggggagtttcggcagaggtttgtgcaaatggagcggtggccggtgtgcagcgaggcatggcgaagccggcggtgcaagcggctcggcgcggcggtggctacggcgacggcggcgtgtagccggagctcaccggaaagcggcggagcgcgggctcgagcggggagcacgggagacggcatgaggagctcggggaggagggggaaacggaagaggagagcacgagggtgctttttataggctcggggaggagaaatcgtggccggacgtggcggatttgaagcggcaacggccggcgacatgggcgacatcgtgggtgaagtgggggctcgatttggcgccaaaaattggggagaagtgggggatttggtggaggaggtggaggggaaccgattttatgcggtttgggggcgagggcgcgagcgggagggcgccagatttggcgggacgtgggcggcaaccgccggccatggcggcttcggcctgggaagccgaaggtaggaggagggcctgacgggtggggtcgccgggtccacctgtcggggagggagagagggaggagaacccagggggttagttagactttgcgcgaggggaaggggaaacgggccgacggcccaagagaggagaggggaggctggccgaggaagggagagaggggcgtgggccgcgggagggaaagggggattgggccgggagcggcccaaaagggagagaggaggtttttaattcatttttcattttatttaattgattcaatgaactttatgtcattaaaattacttcttgagctccgaaaattcacggaaaaatccggaaagtgttttagggcacaaagaatattacaaaatattctcggccaatgatttttaagggaaagttttagttctcccaataattcacttgattaaattgattaacttttatttaatttctagaaaacgcattatttaatgatttttaatcccgaatgaaaatcggggcgttacaggtgatctcgtagttcttggtctgtgaagatgcgttattaggtggtccattttcccattgaggacgaacctcaacctgtgctcgagcgatagctctccatacactgataagggatgtctggattctcgagaagagaggagccgtagtgccccccctccccggaccgcccggatcccacgagtgaatagaaagttagatctacatgtgatctcacctaaatcgcccatctatcctcctgaggagaagtttgtttggtttcaactccgattcaaacgggaggagtacgccatgctaatgtgccttggatgatccacatcttcgggtcaggcgctgatgagcacattgaactatccatgtggctgagagccctcacagcccaggcacaacgacgcaattatcaggggcacgctctaccactgagctaatagcccatcgcgtgggcctccctttgggaggcctgctacgccaaaagcgagaaaaacttcatccctttccttttgacatccccatggcgccacaccacaccgagggggggggaggggggccatggggatgtcaaaaaggggatcctatcactatcaacttatctgttccgacctaggataataagctcatgagcttggtcttacttcaccctaaacgaaagaagacttccatatccaagtttagctcagacgtagctgccttgtttttgggcgtgaagcagtgtcaaaccaaaatacccaataagcataagcattagctctccctgaa

SEQ ID NO: 66763 - DNA, 16237 bp, Oryza sativa
agccttcattatttaactttgacactgttgattctattaaaaaaagaaaatggtatttttccggaaaattgcgatgatttcataaaacctaaaagttttgcatatgattacttagaaattgtaatgatagaaaaagtatatactctaagaaaatctttgtgcggattacaaaatttgattcaattttttgtactctaggacaagattttgactaataattactttattgatatattatctaggtgatagaaaagcataattatgagtatacgtcattatgaatatacatgtagcagcagtaccatatagtaaataacaaatgacacttacttccctttctcacttaggtcaacaatagaaccacctaaatcttttctaaaatgactgccatcctcaatcacaccaaaatttaaactacatttaaatgttctgtctgcctcaaaacatcctcacaagaaagaggggaaggtgctggtctaaattctgttgtgccatcaaatgattttgtatctgatctaaatctatgatcagcatctaaaaacctgcgatgtgccatgtaagaactcttgctgccctttgatagccttgtataaccggtttctatgtggcaatcagtgcaagcaacttcacctgaagttgtgcatccatgaaaatatcataagccgggatagtctgatatggtggttaatactgcagcacgcagttggaaaaattcacccttagaagcatcataagtcctaatgccttcacgccaaagagattccaaatcatctattaatggttccatgtagacatccatatcattaccaggggcagttggaccaggaattaatagtgataggatgaaattaggttgtttcatacacatccagggtggcacattgtatggaattgcaataacaggccaagtactatgggtagaattcaaggatctgaagggattgaagccatcagtagctaacgctaatcttatattacgactttcattaccaaaggtaggatggactgtgtccaagtgtttccaagctggagaatctgctggatgtctaagcaatccatcttttgtacgtccttcgtcatgccacctcatatttttggccatctctgggttaatgtatagtctttgaagtctttccttaattgggaaatacctaagaacttttctaggaactttgtggaaacgttttccatcaagactctttctttccatcttccatcgagaagtattacattttgggcaggaagtataattttcatactgtttccaaaataatatgcaatcattttcacaagcatgaatgttaatgtagccaagacctagagatttaaccgtcttctttgcttcataaaaatttttaggtagtgctgcaccttcaggaaatgcctctctaagtaagtccagtagcatgtcaaagcttttatcactccatcctcctagaaattttgtatgcagcaaacggactaagaaatttagtttagagaaggtcttgcaaccagggtacagctcctgacttgcatcatctactaatctataaaaatcatcggcatcattattggcatcccctgaactgccatcagcagcacccccctcccccatttgatctaaaccatatgccatatctctaagcatttcaggaatttcatcacgatcagctgccctctgttctacttgaacttgttcatgtgtagtgcaatgtgcagaagatgatgcttccccatgaaaaatccacagccggtacccatgcttaaatccatcacatatcaggtgttcaattacaatgtttgcttccaaccatgaacaattaacacacttcttgcaaggacacagtattttatttccttttgctgaatgagtaaaagcaaattctatgaagttattgacaccacgtctgtactcagttgtgctcctgaaatactatattattagagtttggacaaatgaagatagtgaggctaaacaattccatgctagtaattgtgtgtttgtacctaggcagatccatccatcccttatccatgcttgcctcttataatgaaatactaaatgtctgaatataaaatgcaaatattcgttatgatactgcaaaaacacaaatggttaacatagctctcaagctcaacaagcattccagtcatacaatcaaaaggcaaaacatcgtgtaaaaaaaaactaaagtatgtaaaagtagttagtaaatcacatagaagtaagaaaaactgatgtcaaagagcaagggaaacacatatgtaccttttagttgtgcgtttgcttgttaatttgttctggtttgctgccaaccttgttggtgtctccgattactcagcaagaccttctacatttttggataataaatacaaaattttaaatgcaacctctgcgatatattttgctcttgtgcaatgcaaattgaaaaattaaataatctgagtgacaatcctcaggttcagaaaagagcatctgtatttctttttacttaagccactgaacatttgtattttcagatgaaataccataaacaaaatcaagtagtcaccctgtttatatgcagtacaatgggttagttagataccatatcacttaaggtaaattttgttaattgttagcacaaataaaaaggcagctatacacctaaatccagacaaagaatggatgctcgcatttgatggtctgctgctttacttacataattagaggagccccctagtcataaactaataaacagagaaggagttccacttccatacctagctaaatatgtcagggaggtcaagtagacaagaattaagcaaattccaccataactactgaagatagatctgcaatggaaaaggtagaaaattggttatgccagggtgaaataagcacacatgagtagtaacatctcagaagggatgggacaacaaccaattggaaaaatattccttttacaaagacagtaagaaccatcatctatcatttctatcccagtagtcaaattaaaaatcttagcacatgactgaacataaaacagaacaaacaacaatgaactctgctccatcaccacatctgcctggggaataaagttaagataagggggaagagaacataggagggaaggggaagaggaagcagggaatggggggacaagcttgaccttgtgttgttgattgcagtggacaaagaaacgtcgtcttgagcttcaagaagggacgacggtgcccagaacctcaggtgaagcagatctggtgagcacagatgcaggtggctccctaggagcgatgaggtcgtgctcttggtgatgaatcgcagccaaatgcgacctccctgcaggaaccaccttgggggcgtggagatggtggattcatgtgggatgggccacatggatgaaccaccgggggcaatacatcgtggatgatgtgggggagatggaggaggggacaggaggaggtggtggcgctgctggttggagaggaagcggcggcggcgctgctggttgggggaggagatgaggcggaggcggaggcggtgctgctacctgctaggtcttggagtggggattttttcaggtttctgagagagagcgtgtgagagagaagagaggtctgtttgtttggagttttggtgctgaaaattttgttccgcgccattccttttttgtttagcgctcgtttctcccgccgatacatttgggccgcgccttttttttcgcctgggcatctacagatatagcgacagacaattggacgggacagttcaattagtggcagacaacttgccactaatctttaccgacagacagtgcgttaaaaaaattatttttaccaacagactgtgtgacaggatattttccgacagacaaagtgacatctaaatttttttctaccgacagacgactgtcttctttttagtgttgtggtgtagtgaatatggatattatgacatcaatttgtgtcacaacaattatatccgcatagaatagttattgaatatcaaagctttatcccaacaaagaaaattaaatatttgttgtattttttgttggtgggagtacatttagttttctctaactaatattttattatagtaatatacgatatcaatgtggctaggatatttgtttcgatcatagtatatagtatattgaatttgtctgacgatttatgaagatacttttcttcttgcttattttttccttttctccttttattcgtggcccaaacgcctgtaattgggctgtacagcccagcttcgtggcaaacaagagcatctgcaccaaaggtctattttcctttctttctttttctttttgtttttcttttttgcgtgctgttcagaactccggattggtcgagacgccaaaccaggcacgacgattaatgcatgagagccgtgctaaattgatcgtaaacttcgccacgtgtaccactcaatttaaggcggttccgccggctttagaagataagatatgtatgtaaaaatatttttttgagaagagaaaatttctcttattaatctattatggtatatctttgatcaacatgtaattctattaccttgttatatttacatcattcaaaaaaatatataaataggacaatcaaatctaaaatcctagatgtgcaactgactccaagactgaagttctttttgttcatgttaaaatgcctctcgtttggaagaaaatatttaacacgttagttgttgcatgcgggcttaggacgaaatgctcgtaaatatgcttatatttttggtttcttgatgagcgaatgttagaaatgatatgtgatgcaactagaaactcgattatatttatttattagcaaaggtgtcatcactctgcatatcctcacatgcatccttaatagaagatggtagaatgcgattatatatcatggcttataagcttattagaaatacaaagtgtcgtaaacaaacatgagagatggccggcacactggtttggatatcatgatatccaacttatttatgactactccagggcagcatatatagccttgcaggggattcaaagtgcgaattcaagtcccttatgcttgcatgatgcagttgtttaggaaacgatagtgacaatatcagcttccttgttgcagaagtggtagcatgcttcgttgcaacgttccacagcaccgttcccttcttcgttgccagcaactgcaacggaaaaaatgattgtatacattagctacagcaaaccgatgattcttgtcctatatgttgaaaaatggtaatttggtttcatgttctagtttctagcttacaagtgtttatgttgctgcacacggatgaagtacatcccagcatacagaagtcaagtacatccaattcctctgcaaaatcatgcattttcatatatatttcagtaaagtactaatttctaatctcttgcacacaaggttgattgagctgcatatatgaattatgaaaccaacagccaacaaataaagagaaaaggaagttaatatgttttaatttaccagactcagggtgaagggtgtggtgaatgtaaggtggcttgcatttcccatcaacaattttacagccagagagtttagaacatctttcccttgtgccatgcgcaaaacggcatgcattatagatgtttcttgccgtggtggttgggcagcagctctttgctcccaccttgatcgtctcttgctgcaggactaagcctagcaccagcacacacataatcaaactcttcacacctttcatgttttctagcttcttttcatcgagatttagtcgaggagattagcaaagcaagaggctaagagacggtactactttcttccactcgtctatgcagatgttgggagagtgaggtgcctatttataggcgcaaccaggatcacgtcccagctgcatctgcatgatatactgtgattatttatcttcattagattattattgttaatatttcttatgtgtgtattgtttgtttactgggacaaggacaaatgattcatccatgtggattaattgcatggtacttaataagctactagtgtaccatcttatcttcactattgtaactcccggccatttcatgcaatgatgcaaagccttagctacccatgtgctgaatattaaacgttttgtactggcttctagtagtactgggccgtagcttggtgactgtcaaaaagttttacacaagtagtaaattaatcaccatacaaataccacctgttcacaaacctgttgttgcttttaaaactagggcacgttttgtaacatacctgaattctaggattaaggaatttccatcaaaactagttgaaagggaagttcttcaattttgtaaaccaaaaatttccattttaaacctaggtggagttgatccaactcttgcatgataaaattttagaacaaattaaaaacctttgcatctctaacctaggacaaaaatataaatttatgtgtaagcatgcatactctcatagacatgtttgacttgagtccttcatatgcatttggattcggattgcatttggattttcgatttgcatttcataataggtctcatgaatattaactaagatctagataaacaactaaaccattagggcctagtgctagctagaggaagttaaaatagaaaccatacaccttaaaatatatcaacaaggccaatgtcaagccccacaaaactatttcggtcatccatctgaagactagtcatgaacatggaagtgaccaaataaattatatcatatagggtatattctatcttaatcatctctataagcattctcttaatttaatactaatgtaaacttatgcataataggtaaggagcttatgacctgtgtaatgtaaattgtaattctaacatatcaacatcacctcaggttaatgagagtccaaatataacttttataaacatttacatgcatttaggaaagggaagcatttataagatataagtcttgcgaattatctaaaataattcgtgcaagataaaatcatgggaaaattcatgtaggctctaatcaacacatgcaactcactgtaattttggtatgatttaataactaaatttggtacctcaaataaatcagtcaaactaataaaaactagattaactgtagttcttactcggctaaaaccatactttgtctaaaagtgcatttaactgcataaaagtgtataagtaaaataatttattcaaatactaggtcatttataatgaataaaaataatttttccagaatttatcttctctttttatgtctcctaaaaattcgaactattttccaaagaacccatattcctctaatttctgtgagtaatctatccataatttttgagtgcaaccaaagaaaatggaatctaggtatcttcatctaccttcagaaaaatccacactaaattattctacccacaaattaaataattgaaatactaaagtgggagagagaaataatccttaaaatcattaaaatcattcaaaccttttgttcacccacgtttctgcccaaccctctcaccctagcttagtttgccatgacctggacccacttggcagccactctggctcgtcctcaccctgtgcaaatcttccagccgaccagacacagccgagagagagagattggcgccggctgtgtacgacgcgtggcctcgacgtggcagcgccgaaccgaggcttcacctccacccagctgcgtcgccattcttcaccaccatcccagtgccgatccaaccgagggaggaagctccagctctccctctccacctctctttcgtcgccggccgccaagaagagggacatcgccaaccgtcgtcgagccctcttcatctctaactcatactcgttccattctcatctcaccatgacgaacaactttggttttgatcccattccatttcatcttctacagcagcgggaacgccgccatgtcatggtcgctctagagcgcgctctgtgcaccgccgcagcgacatcatcgccgttcccgcttatctggaccaagccgggccaagctgtcgcgccagcgtcttcgcctcgacctcctctccatttcccctcaataatctcgaaggatggtgctacgagtgtggagatcgtccaccgtcttctccacctccggtcaccgtcgccgttgccgaatccaccccctccggtgagtaccaacccaattccatgcatcagtaccatctctggggcctctctaacctcatggacacacatgcatgatagttcttggagctgattgagccatcgccgttcacccggaggttcttgccgccgccgagccgttacacgagccaccgtcataaacctagctaccccagccatgtctaccatctcggtgagcacccttcagcctatagaacatacatgcatgcacccaattaaccaatacatgattgtagaagcacatgcatcaccacccgaaaacatcctcctttcggactcgccgccggcgttactccgatgtccactgaccgagaaaagtagaggaatggaatcgcaatagcatgatcttcattttgtcttttggtcgcaccctcaaacgagccatcgtttgtcgccggtgagctcgagattgagctcagccatggctgttctgcctctctgcgtgagaaaagaagtcagggaccttgtttcgagaatttaaacaactataaggtttaatgtgcaacttttcaactcactgacatatgagcctaggtctgcgggttgattcttagaaacctcagggatctttttgtatattgatctttcactgacagtggaccccttggaaacaaaaatctgaaattataaaaggaaagtacctaaaacttgtaaaatccatataaaattaaatatagctcattttaagatgattcaaatttctgtgaactcaccaaattgggagctttgatgttatggaataaaaacttccactcacagtacaaatttagcctctaaaatttatccaagttaaatcacacataaagcacgcacaaaatttataaaatgcatacagaattcatttcaactcattttggagcaaactcagtttctacagatccaccaacttatgttctcctataaagcaaaatgaaatagcatacatactatacatcaaatgcctctaaaactattacctttaaatgactagttttagataagctgaattttagaagttcatataaaattcatcttagatctttttttagtaaacccaagttctgtagaatcaccaaaacatatacttccaaattataaaataaaattatatacttactgtatgataaaagcctctaaatacttatgtaagtaataaccatcatagagcaaccttaaattgtaaaatttgtagaaaattcatctttagtctaaatgaagtgaaccaaatatctatagaaccagcaaacagtgggcttcaacatagtaaaataaaatatggaaccttctgtacaggttatagctctaaactttaaatttataggataggtgctaatcacatagtatcgattgagcaatatgtatatatataaatgtatatagaaatacactctagctataatgaaactcaaataaaacttgttagaccagtgaatgcatagttccattcccatccaccaaaacttaaggcacttagctcatataataatttctaggttgatataataaattgctaacatggactagagctcccctagtttataaaatatgaaccatgataataaagaccataagcctatgaactaaggttagattagctaactaaaatactcattttatacatcactagctagatgaggcaagttctagacctaaacctctaaagccatgaacctatagaacactatacacctataacacgttataacttgtaaaatacataaagaattcatattaactctaaaaattatgaaaccaaatgtgttagtgttagaaaacacatatcttcaccccagcaaacataaacttaataagaattaccttacaacagcatttcacaacagtaactaagtaaatcctacactataccgacgaaacttctaaaattcataactcccaaataaaatgagataaaatagaaattctttcacctaaattaattttagaccagtacctattcactgtgcacaaatcatccattttagagcattttggatttttcgcatatttcggtgtttaattgcataacgtgtactttgtatagatgattgcttaaacggtgaagaagtgatttaggtgctgacattttcctgattcaaggcaagtcccacctccctctctttgatcactttgaacctatgttttggaggttattgaaaatgtttgcaaatcctgcatgtcgattgtgcattaacaaattaaaattgtgttaaacttgttagacaaactcctattatttgcattatcaccttaaccccacatatatccatatccctcattcctaaccttaggaacaatatgactacaccactttatatatgaattttggagtcactaggttactataatgcttagccatgcttagaatggtcttccttgtcattatgggctcattacaaatatgaaaaattgattttgaaataatctggacagaactttaatacttgtgattttgataaataaaatgatggaaaacatggattttaggtttgggcctcaagtggtgcacatatggtgattagttgtgtaccgatagggggagagtgtgcccaaaccgacctaaggacttcactcaatgtcagttcatttcgtatacagtgcaaccacatgtgctagtatgggatagcccaagcttagtaaattatttatggtttagccttacattctggtaggccggtgtgtatgagttcgtataattcagaggagtttcctatttaccccgaagtggtagtttaggtgactaagcgtgtccaatacaacggtattgtgccacgtggtgggttcccgttgtgtccgccaccacggcgttaagtttaaggcgtgggcccgccacttaacggttctaggtcatataacgtgtatggcttaggatggagtaacacgtatcgtgctggtgtaaggctaaatcatgaattttggaaaagctttgttgcgggtaatcgactgcttcttctaggacttgaacttaatggggtaaacccctagtcggtgtgcttgtggattgggtagacaagcttccactgttctatatatttatttggccaattggccaatgtaactaaagtagatgtagtttataatcgctttcatcttatttgtgtttgctatgtataatcatgcttgagatgaaagtgtgaatctagtgcacatcctgggaactagattcacatgagtatgagttaagaatatttgagatgttgtagatctttagccatttttgtcaagtctcctgaatgtgtaacacatctggtcaccgccttcgagtggtttgacgggcacatctcaggctgaagttgactggcaggctaaaggcccggcaatgtctccaatattcctctctcgaggcgtcggatatttcattatacttgtttgatgacttgaattatacatttcatctctcaattataatggaaggtccggagagcctacgacacgtttaacgaccgattgtgataaataccactgtaggttccttaatacaaataccacctatccacaaaccagttgttgcttttcaaactaaggcacattcaacgaccgatcgagataattactactgtgctagttccttaaagagtaaatttcataatcattcagctactttaattgatcaaattattttaaaaatatagatttaaagtgatgtttaccaaaattacatatttaacaccaaatttactatgcaactacgaatttaaggtgggtaagccaaagctacatatgtaataatagagttatatataacaaaactacaggttttagagtttaaatctctagtgctactattatgtcagagtcataaacgttgtagatttgtgattaaatgggtacataaacagtagttccatgataaatttaatgctaaatctgtagctttgtgatacaccatcttaaatctgttgttttgtattagtttggtgaaaatatccgttgttctgtgaaatttacatagaataaaaaatatagatgatttgcatttcacaaacttgaatacacacttgcatactgatttggggaatgactgcagtaagaaaaaaaaattcacacataagcaagttgatgtttaagaaaatttgatggcaagaacacatcgaggataaatcaatagaaaacaacacaaaaaatcttaaaaacaatatcatacgcatctcggctcaaatccaacccaactgtgctagcatgcctcgccattgccttaaactccagacccatcattgttgtcatgactcgcctcctcagtctccccctgtcacaaccttaagctagatgtggcccgtggaggagttgcccgggtttaggaagatgagaagccactattgccaatgtgagggcctgatccagttgtcctggctttcttgcctgtgtttttgttgtcatacctggttctctgttatcgaaagaggagtatggattgtgtcagacaaggagtagacggtgctggagcaagagtggatggcatcgcttggagccggctttaatttacgtgatgtcttgaggtgatctccacaacagccgagagggctgtaaggtaccatcatcatcagggaattcgtcaggaaagcagtaaacatttctagcgatgaaaatggcaacatcgtcatgaagcgggttatgggtggcgtcttcaggtaccatcatgaaataaatgatctgcctcataccgtcattgggggagatcgatcttggaggtcattgtgggaagccatatatgagtggggatgaaagagagagggggaatggagagatatcgagagaatcgggtgttagtgcaggacttaaccagatcaacggatgtgaggccaacacttaatgtggttctaaaactatgaccgccatctcgcaatttttgccattagttcaccttaagaaccggtattgaatattactgccagttattttaattcgcagtgatttttgtactgccggttccatttggaccaagattgataggccggttggtgtttcggtactctgtatcagttattatgtgttgcgtctaagtttgaaaatttgtaatcctacgtctgtgtaagaatatataccccgctttacactacaaagtttgtagcttgtagcacctctcaaatacactaaagcactaaacaaaatatcatcctagttaggctccactactgcaaaacatctgttaggtgccagttgcaaacccggcatacatgctgaatttacagccggcacatatcatctggcagcaataccctagacttattggtgccagtggtaggaaaaaagaaacgccagctcgatgctttgatcagtttgaacctgtttcccaacattggatcaagaatccacatcaacagatcaagaacatacaggatcaacaatcccccaaatcaacatatcaagatcaaccccacactaattaatcccctgatctgtaacttagaaactaaaaaaaatgaaaagtctggactcctataagtcggtagctacgagggttttgtagtagtgctcaaataccatgacaaaaaaggtttggcaaatatccaagggtgccatgtcgtagttatgttcttcggtgtatgagattcatctctagtgaaaaaaaataggtcatctctcatatggtagcgatcggacaataataaaccttttgtttagataaaagttaaattaaactatgaaatgttatctaccagatgccaccatatatacatgtgttcatgtaagaaagcaatattactagagtgtactagtagtaacgaaagatgttataggagttttactgcacattcgctagccacgcgtagcagtacggttgttgggagagattatatttgtcacctaacgtgactaaggcatgtacctgcagtatactctctccgtctaaaaaaacaaaccctggtttccgtgtccaacgtttgaccggccgttttatttgaaaaaattatgaaaaaaattaaaaagataagtcacgcataaagtattaatcatattttatcatttaacaacaatgaaaatactatttataaaaaaatttataagacggatagtcaaacgttggcacggaaatccagtatttgatttttttaaggacggagggagtatgtacgcagcaactgtacttgcacaatttcaattatgagttggacttgagggtgggcttatgacgagatcagctgacgcgaggctaattaaagcttcacgtcgtcaccggatcggctggccggctcgcaattttcaaattagggtgtgtttaattcacactaaaattaaaagtttggttaaaattaaaacgatgtgacggaaaagttgaaaatttacgtgtataagaaagttttgattgatggaaaagttaaaagttgaagaaaaattttgaaactaaaccagaccttaatacgtgttgtccttgaattattgccactactagtatttattctgaacggcattgatacccgtacgttctagttcaactggaaatagtacacgagttggtactactactaaaccatttgtatagttctcagacattttagactgtgtttagttccatattaaaattagaaatttgaaaaaaatgaaacgaagtgacggaaaagttgaaagtttatgtgtgtagaaaagttcgatgtgacagaaaagttgaaaatttgaagaaaaaaattggaatctaaacatgatcttaattattatatataggcagataagagatataccgatttgccaccaaagtccaaagagtctgtagcccaagagattgtagcatcgtatagaacctctcaaatacataaaaaacgattgggattataacacctctcaacaagaaaagccatttgtctggggacattgtttctagtactccacaagatcgcggctgtgcaagagcaatcacgcgcgccaccgtgcacgatgtaacgagcacatgtatgacagtatgagatgcctttgagcagtttcaattcatgtatcagcccaattaattatatgtttgtcagaactcgatcagaaactaaggtttcccagaaatacaccctccgttaaaaaaaagacaacttctaaagataaatctggataaatgtttgtccagattcatctctagaatttggttttttataagacggatgaatagtttggcagggtatataaaaagacctttataccaagagagtacatgctggattgatcctttctaacccccaaaattatatatataattatatatgtatctggaatgtgtgtgtatatacatacacttcgcggatgctgacaaacattgatatttcgaccacatcaacatgtattaattacctcattccaaaataaatatatatatatatttttaggcgttagcacttaaatgaggatggagagaaaaaaaatactccttactaaaagaaagtagctttggattactgttaatggcactactggataccacacgctttcctgcgggatatgtaaacgaatacatgttatacattacagaaataatataggtatagtatatatttaaataatgtaaaaatgatgcgaaaataatgatttgacattgatttcatattgagttctaaaaatataacaaaattataaatggtatatcatgtttgcatgatatttaaaatattatactacctccgtcccaaaataattgtatttctagaattcaaaatttgtccaaaataattacaattctagagtactaattgccccatcaatcatctctcattcaattttttcctatttttcccttaaccatcttcccgctctcacataaacactatttaatgagggacactatagtctttcctctcaaaccttaatacatgctagaattacaattattttggaacggaggtagtagataataattgctagtgagtgatgatgtatcacacttgcatatggagttttaggagttactgtacataaactgtagatagtatagatttattggatggagaatacgagggaacatatctaatgcactttaattaggacaaatattagcggataggaatgaattcattttgggatatatatggaggaagcatataactagctcctatctcgtttaattttgatggacaattaatataattattcatacaatataaataaaacatcaggctcatatcgataaaaaaaaatactatcgg

SEQ ID NO: 66764 - DNA, 11693 bp, Oryza sativa
ccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctggagatatggtaacgtcgcttcggtcggcgagcgtaattaacgcgcgcacgatatgatctatctcgactgccacaaccgcatatccacctcatgcgccgcaagcgggtgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgctgcttgcgccctaactccttctttcctgtgccctaccttcgccacacgcgctcgctcttaatcttctcttcctccggcgccatggcacggggttccgctctgctcgatggtagcgtgctgccgccttcccggatcgtgagcgagaggcaggctgggctgccgcgccgcttcatgccggaatctgccaccggccgggagatagtcacgctgggcgagggacgcccggcgccagactacccggggcggtccgtcttctttctcccctttgcaatggcagggctggttccaccattttcttctttcttcatggatgttctggagttctacgatctccagatggcgcacctcacccccaacgcggtgatgacattggccatcttcgcgcatttgtgcgagatgttcattggggtgcgcccatctcttcggctgttccggtggttcttcaccgtgcagtcggtgtcgccgccatcggtagtcggtggctgctacttccagccatgggggccggtgctgaaccgctacatcccctgcgccctccgcaagaagtgggacgactggaagagcgactggttctacactcccctcgccgacgaggcgcgcctccgacttccgagccagcctccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcgacgcgctcggggcgcctgggagtacaccgggtccgaagacttcacgaggacccaccagggagtgagatgggactgggctcctgaggacttcaagatattggtccaacgggtgctgaatctcaactccgtagaggcggccctcattccccaaggaatcctccccctctgcagcgatccagaccacgcctccatcctgaccattatgatggcggtcggggcctcagaggagcgagctccaaagggccacgacggcgcaggcgggagccgcaggggggaacaatctaccccgagagggggtcgtgcttctgggtcccgcgacaggggcccggggagcagccgccctgccgacgcccgggggaagaggaagcagggaggaacacctcccccatctcctccccgagggggcggggcggcgcgtgccagcagcaggcgcccggagggggccgcgccaacatcgcagcccgagggggagcgcaagaagaagcggccccgcaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggttttttcttttgtttcagcgagatcccatcgcatccctcccgccattccaagtccggccagtctgaggccgaggatccggcggccgcagaggccctcaggcgggaatctgaccggcgagaggccgcggatcgcctacgggaagccgaggaggccgcccgggctcgccaggccgaggaaactgctcaggaggaggccgcccgggcccgccaggccggggaagccgctcgggaggaagtcggatttctccaggacgaggcgatggcgacttccgaggcagctcacgacgaggccgcgggcgcgtcgcttgggcccactccctcgggcgacgctcaggcgacaacttctggggcagctggcgacgaggctgcgggcgcgtcgcttgggcccactccctcgggcgacgctcaggaccaaccgggtccgggggacatccccgagtccggcacttccattggcggcccgagccgcgtggcatcctctccaaggcggctcttccccacgccttctatcgccccactgaacgcagagcctcttctgcaggccttggccgccgcaaacaccacggtgttggatgggttaagtgcccaggtggaggtcctgcaggcagagcgggcagagctcgacgccgcgtgggcgcgtgtcgaagaggggcgacgctcggtggaggccatggtggaggtgggccgtaaggctcaccgccggtacgtctcggagcttgaaacccgtaagaaggtgctggcggagatcgccaaggaagtggaggaggagcggggggctgccctcattgccaccaccgtgatgaacgaggcgcaggacaccctccgccttcaatacgggagctgggaggcggagctaaggaagaagctcgacgccgcccagggggtgcttgacgctgacgctgcccgagaacagcgggcggcggagaccgaagcggcgtcccggcagcgtgaagaggcccttgaggcacgtgccatggcgctggaagagcgcgcctgcgtcgtggagagggatctggcggaccgcgaggccgctgtcaccatccgggaagcaacgctggcggcgcacgaggctgcctgcgccgaagaagagttcacgctccgcctccgcgaggacgtgctcaccgagcgggagcgagctctcgagggggccgaggccgcggcgcaacagctggcagtcagcctgtccctccgcgaggcagcgcaggaggagcaggcgcgccgcaatctggaaggtgcccgcgccgagagggccgtactgaaccaacgggccgctgagctcgaggcgtgggcgaaggagctggacgcgagggcgcgcagcggcggggcggccacgggcgaaagcgacttagccgcccgcctcgcagctgccgaacgcaccatcgccgatctgcagggcgcgctggactcgtccgccggggaggtcgaagccctccgcttggcaggcgaggtagggcccggcatgctttgggacgccgtctcccgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctccccatggatggcgctggatgagttccctcctgggaccgaggaccgcgcgcgcgcgcaggtctgggatgccgccgaccatatcgtcgacagcttcgagggctcggcccctcggcttgcgttcgcccccaactccgacgaggagggcaatgccggtggtgcagacgacagtgacgtcgaggccggtgatccgggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggctcgtgcccaagttctagtcctcaaaaggcgcgggtcggggctagtgcctggggagatccacatgtcgagactggccaggccgggaacgtggtgaccgagggttatgggtgacccgattgtgggtttttgccgattcccccccggagttcaccacgcctcggggcacggctcggttctgggctccgttcggcgattttagccgacccgagcccccgagggcaggattgagcacgagtgacctatttcaagtcaagattcttcaaaaggaaaaaacagcacagatacagcctttaggaaattgaaactgcttttattgaaatacagatgtaagagaaaaaagaatatgcatatgttgtagcccccggccaaccctgcacgcccgagggaggtgcggggttggcccgagcccgaaacctgacacccgacccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcaaagctgattttgatcagcctcgcaatacatggtagcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaactggtatggtctgcagggcctgggccggctgatggatttgcttggcgtggaattgacacgctctacatcgccggaccaggtcgaccgcgtcattaagagctgtcggccaatagaaaccctggcgaaaagctttaccaaccaaggtgcgcgaggcggagtgggctccgcattcgccttcatggatatcggcaagaagcacaacaccttgttcccgaggaatgcacttcaggaggattccattagccgcgcgccgatagaaggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacgggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactctgagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccacttcaccacccgtcctgtaccctctcgattacgcaagatttgaccgagggggtaagacgtaactacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttatcttctgtgctgatgacctcggggtcggaggataacaggggtggccttcccacagtggcttcggggccgtcctgggggtcgggggctcctggcgtcgttggacaagcgggcaaagggccaactccggtcgtcaggggccttaggcctccgttcggctcgggggcctcttctccctgctctttcccgggtcgggtcagcacagggttagcctcggggtcgaagggcgataggtgcggccttcccacagtggcctcagggccttcttgggggtcgggggctcctagcaccgtctgacaagcgggcagagggccaactccggtcgtcgggggccttgggccaccgttcggctcgggagcctctcctccctgctctctcccgggccaagtcggcacagggtggggaagcgtgaaatgagaattgttctcatcgcgctccacaaccaatgccgcactaactacttgcggggtcgccgctaagtagagtaacaagggctcgtctggctccggggcgaccagaactgggggagagcttagatacgctttcaactgggtgagggcattttcggcttcctccgtccaggtaaacggtccggagcgtttgagaagcttaaataagggtaacgccttctctcccagccgcgatatgaaccgacttagggcggccatgcaaccggtgacgcattgcacatccctaagtttgctgggggggcgcatccgctctatagcccgtatcttctcagggttggcctcaatgcctcgggcagagaccaagaaccctagaagtttgcccgcaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccgtctagaagaccaccgatccgtgtggtcttggacgggccgtcgcccagggcaacctccttgaccgggacctcgtcgcctgtgatcatccgctgcctcggggtggcgggggcggaggcgccaagcctctcgtcgccaccctcaggctcggatgcagcggcgaggtggtccgcgcgctgctccagacaagcgagcgcgactttgaggtcgccatggacagagatggggccaccggggcccggcatcttcatctgtaggtaggcgtagtgaaccgccgccatgaattcaccaacgcgggcctccccaggaccgcgttgtagggcagactgaggtccgccacatcgaagttcacccgctccgtgcggaagttggcggatccaccgaaagtgaccggtaggtcgatgtgacctaacggccacgtgtgccccggcgtcacaccgataattggctgggacggccggagcaccatccccggggccttgattgcgtcaaaggccgcaggggaaaggatgttgagggccgctcccccatcaatgaggacacgccccaacttcacgttgcaaacggtgggagaaaccaccatcgcaatctgccctccccgggcaacgcacggtggttggtcggtctggtcgaaggtgagggcaacctccgaccaccgcgcccggcgcgtcgcctcatgagtaggggccgcggccagaagctctcgcttcatggccttgaagctccggcgagaaacgtgagcacacgctcccccatcgacggtagcaatggtggccccaggctcttggaaacctaggtcatcattgccgtcatcgatgtccttggcgggggccttctgcttggcctcacttcgccgattaccggaaggaaccaccggggatttgccctctcggcgctcctgcctcctctcctcctcccacttcctcgtccgctcagccaaacttttgactgcacggcagtccgcgaggtcgtgaagggaagtattgtggacggtgcaccacttgccggttgggcgttccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgagcgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatatgtgccttagaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgatgcgacactccggacgaggaggcgccctccgttgcgtggggagcacgtcggccattacgccggcgctcgatactgatgcgagcatccggttccccacgcagatcttcccgggtcggaggcgttgacgaaggagtggcggccgaatggcgaacagcggctgccgctcgccgcgccctccgtcttgacgacgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtggatgtcgaagtcgcggatccttcggccctctcgagcgccttctcccgcctaggactttggcgtggaggtggcggtggagtacgagctcgacggcgtgggtttggctccccgtcgtcaccgctcatactcggggagaggtcgtgcgcctttgctggctcggctattgggctgaacaggaaaagcttggcgcacacgaaagagtgcgagagctcagaaaatccctcgcagggccccctacctggcgcgccagatgacggagcgtggggctcctcaccgggagaccgcgcaggcccccctttgccggtttggctggggactcagggagagattctaagctctctgtatgtggaaggctcgcgagaccggaaacacacaagacacgggcgatgtatacaggttcgggccgctgagaagcgtaataccctactcctgtgttttgggagatctgtgtataaaggagctacaaagtatgagccagcctctcccttgttctgggtttctaatctggaaaagtccagtctcgtccctcatctcagtgggcaaggtcctccttttatatcttaaggggataccacatgcaccatttctctcttttttgtggggacttaccccaccttttcataaacagacggagacttgtatggttgccgtccgaatgaccttctgatgggacggcccatacctacctccacttccgccggaagcaggcgcgacgtggaatcgtggctgtctgctgacgacatgaccggtatcagaccagtcacgtcggtcattcttgtccaccacgtgtcagcttagcaacctacatgctcgcccttcttcacacaacatcttgcctgtaatggttaggatgaagcctggcatatatctgaccaggactaacgtgccatctctgggaggtaacacgctagctccagctggggatgagcgcctagaagccctcgtcctgacgggatggggcgaggcgtgcgtcagatcgcttgtcgccacctaacccgcgatctgaccggtctgtgactggtcacagaccggataaacgagtgcactgcactgcgttacatgcggcgtgacacgctcagccaaaccgcaataaatgtggttaggtg

SEQ ID NO: 66765 - DNA, 1840 bp, Oryza sativa
catatgtcgttcgatgaataccctcaaataaccgaggcggtgtgggaggaattttgctctctcaaaaacacccaagagtttagggaatcaagcgagacacatcgccaactgcaacaacgaaatgagcacccacatcggttgggcaccgcagggtacatcggcaaggaggcaatatgggcccaagaagatgcagccgctgcagcagcgaatgtccctgccccgttttcagacatccctgaacaaggagctcgcaactggtcgcgggcaaggggtaaggtcaacccggacggctctgtcacatttgagaacaaaagtgatgccatcgtctatcaggaactggtgagttcactacttaacctaactaatttccattcgtataaagtagaagtttatataaacgactcctttttttctagttgggcttggctgctgaacaagcttcacaaagcgaggttgagtccgcgccgaagaggcgcgaagatgacatcctcacaaaggcgctcggaaccaaagaacatcctagccgaactaggggaattggtagcgatgtgccctggaagcatggactcccgcagtacagctcccaatacaggaaacggaaagtctccaaggaagagaggggcgctcgtttgaaggccgaatttaaggttgaggtcatccaagaactagaagctagcatgaacgctatggtggaagaaagggttaacaaggtcctcgccgacatgaatataccccgaggcacaacacctgctgtgcatccaactccttgtgcacaacacgacgcgagtccgtcacagcataggagtagttgtgcatccacagaggtgccggcccctggtctcccggtcgcaccactagctgcagtggaccacatagaggtaattgatgttatccaatccatatctaataaaaaaatctttacacgttccaatattaaattcaaactttcacatatgcagggcatagcacagtgtgtcctactggcgagggtccacccaactttcgctcccgaagtcgctaagggcatggctttcaagccctcggttacagacaaggtccacggcgcagacctgctagctaggtatgccaaggtgtccatcgatacagtaaaggacacctggtcaggctatccgctgcccgtgccccccaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcctggtggagctgatatggacttggcaaatatagctcaaagcttggctccaataaagaccacaagaaaggccgatagctccccaccacttgtcaaaggcaagaagcgtgaacgcggcaaggggaaggtcggggagttggcgccggagccaaaaaggggcaaggctgcaacgtcgatgccgctgagcaaagcggggaaggccgtgagggcgccagcccaatttgagctaggcatgccattggtggaggacaatgtgttagccatgatgggtattgcttgccgagagctacataagcaatacatggagctaagcaatggcaagcggaaaatgagggagtcatccatagttggacatcacgaccaccagccgttcctatcgtcgcctgcctatataactataggctttgatgacctctttgaccttttcaggatccgaaagttggacactggtcttctaaaatgctacaccttgtaagtgcataccttctatacttgtgatatgattggactatatctcct

SEQ ID NO: 66766 - DNA, 31432 bp, Oryza sativa
acctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcatccccagctggagctagcgtgttacctcccagagatggcacgttagtcctagtcagatatatgccaggcttcatcctaaccattacaggcaagatgttgtgtgaagaagggcgagcatgtaggttgctaagctgacacgtggtggacaagaatgaccgacgtgactggtctgataccggtcatgtcgtcagcagacagccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaagagagaaatggtgcatgtggtatccccttaagatataaaaggaggaccttgcccactgagatgagggacgagactggacttttccagattagaaacccagaacaagggagaggctggctcatactttgtagctcctttatacacagatctcccaaaacacaggagtagggtattacgcttctcagcggcccgaacctgtatacatcgcccgtgtcttgtgtgtttccggtctcgcgagccttccacatacagagagcttagaatctctccctgagtccccggccgaaccggcaaaggggggcctgcgcggtctcccggtgaggagccccacgctccgtcaactagattatagaaaatatatgggaaaataaggactgcgccggggctcaggggcagcgccgccggccgcgccgccgcctgccgggaggacgagcggaaaccgcggtgatgcggtgatccgtcgggggctcgggagagatgcggtgcctgcgtcgggggctcgggggccgcgccgccgcctgccgggaggaggagcagaaaccgtggtgatgcgtcgggggcgagatgcgttgcgtcgagccaccgattccgccatacttgatgagacagagaaatcataccattccaaaattacctctaatctatattaacatattactaatctatccgtttaagataaacggccaagattaattctatttgtagtagaatactgcaagtatattgcatcggagtgcctctatcttctattatagttcttttttcaggatggtctgaatgagcaaactgagactaggagtagtgaactttaatttaggacaataagcttgatgaggttgatatactgcaatggcagagcagtacctagagtcattatggcagagtagtaccaagagtcattatgcagcatactgttctgtgtgagtttaagacaaactttggggttttctaccgtagtcagaaaatagaacttgaactttgttgaaatgaactgctgtgtgtttggtgcaacgattattaaaatgaacattgttaacatgatcacgacacctccattcccatgtgcacaactacggtacaacacctaataaaatgttgacgactataaaattatttgcatttctcataaaaattcatatcagtaaacgcgtcatcgatcttattttcttatcattatgcatctaatatattttgctagcattcatttaaatataaagaagtaataatcaaagtgcattcacagcatgtcaatttccaaagaactagagaatagagcaagtaataaggtattgaccaaggccaacttgaataaagcagttattaatatttatatagccttaggtttttcttgtcctattgtatacaatgtggactacatgaatgctctttcccttgtcccttgatccaaaaggtcagtaattcttgcttcaaggacattttatcagatggatcatgaactattttatttataatgtaggtacaagagttgatcaagctgaggaggacgcagaagccgccggtagaaagggtgtgacatagatgcctgtccggatgcgaatattgtcggctcagtagtttgttggctgattggagtttaaggagtactgttgctgggcatatacgagtataattttgtgagcagaaacttatcagctagttgcgttaattgttgctcgaggagggttgatgaatccatctataaagtagaaagtaatatatatatgctgatttatttatgtatcttggcttacctttgcgtccactgtgtactctgaaactgtcgagtttttgggcataggtgtggcaatgattgtttgctttgagttaacacaaaagtcgagtgatccaactctttcggacagtttggcttgaggagtgagatgatgagttcaccacttgcttcttgttgagttgtttggttcgaggaattggatggatttttccattaccacctcattcctcaatgcacaaacccaacgctgagccttcaaggcagcagaatgacaagcagtccaactgtccaactccacggcaacaactcctcagaatcgccatgtatgtgctgttctacaggagaatgatctctttggcttaaatttgtctcaaaagtcttaaaatgcatgtcagcttttaatcggtcaacatataaatgaggttaaactgggtgtttttacttaccggcagcgtacgtgtaacttcgcgtctttacgaaatttggcttattaagggttagaaatttggcatgttaagggttagcatgtctagagtatcgactaatcttaaattgcaaatgaatgattagcatttgtagttggggatttacaaatcagacttgtcaacgcgaaactacgacatatgacgtcctagggtttgtcctagagcgcatagccccttaggcttagctcacggcacaattacaatattcaaatacccaaatcagactcggaatacacaattacaattacaatattcaaatacccaaatgaagtacgtggatgaatttgcagattcccagcagctcatgaggaattttgacatgggagcaaaaccatctagaagtaaactccataagctttctaacatgtattaaaataaaaagtaaattacacccacgatataataacttggcaggtgggtgcgatatggtgcaagaacttgagaattgaatgttcgagtgcaacaacttgacacgtgggtgcgttctagtataagaacttgacaatataatattttggtgcatcaacttagctaagcatatgctaggtgggttttttcccgcaacgtcaatatgtcattacatagcaatcctacggatattaccttataatattgaatttaatttttaagaattatattgcacatgcaatttacatccaattacctttaagaatttttgtttttttctcacctttccaaatctcaaccgaaatataataatttctacatcagtttaattgacttattagttattaggataaaaatataaatatgcttatatacaaatccacgctagcatattaattgtcaaaataagtacttaaaaattaaatatgtataaaaaaaatgctccaaataattaagttaccgtataactttttaatttattgtatgaaaagcgtacatatcttgcaagttgttgcatttatacgatcacttataaagttcttatactaaattgcacctatctaccaagttgttgcactagaatactcatttctcaagttcttgcaccaaattgcacccacctgccaagttgatacaccgtgggtgcaatttactctaaaataaattctgtaaatataaagaaaatgtggatggtgcttcaagaccataagaaaatgtggtcccatatttttgttttttttttgttgattaggattccatgtcagccaaaataactttctatactgctatgtgatctaattttgaatttgtttcgaatttatttcgtacgtacactagcaatcaaacttttataacttttaacagattatattttttttgcgggggaacagagagaatattgaatactttgattgttagttgattggttccatttcactatgtcaatacagatatcattaccaaattgggatatattgatcatataattagaatataggaaaaaaccagataagattgtactatgctctaggagatgagatcaaattaccgcctgcagctgcggataagataaacgaaaagagattgtattcattccccttggtctcttaaccagatcaaagatagatactcctatatgtatactccatgtagtgtgagtatgagtgtatgaccggttctctctcattcagtctgtccacatcaacagagttcctctgataaatcttggcactctaagcaactccctcttgtgatcgttgtctcgatgaaattaaacaaaaaatgccagtacgagagtcctagaattagttgtaacatgacaatgacacacaatttggtgtttatcgtacagactttcagtttataagggattaaataagtacttactaacaatctcaattattcaaggattaatttattcagttaggggataagcacatcacccccattggcatttgacagttagatgtcattttcacaattgcttttgcagccacccaaatctatcaaccttgtacttgtagtttcataattgtttttgttttttagttactctcgaggaaaatgcgagtttattctgcattatcttgtgtgcaagcaagtacaattcaggatggtaaatagggtaaaacagtaagatcaagttgtttcataattgtcttttagttactctcgaggataatgcgtgtttattctgcattatcttgtatgcaattgcaagcaagtacatttcaggattataattagggaaaacagtaagatcaagttgtttcatgttattaattgccgaaataccaagtcttccaagatttctttgttacattatagtagaagttttctgctagattttgttctggtatcctggctaattatcagcgattacttacctccgttattcgatttttattcactataggtactacattcgtacggaggactacattaaaattgtcttgctgaaattgtcttgtttcttgagctgaaccatttttggtagagcctattcacttaaaaaatggtactatgatgaagtcaaatataaatgaatttggtacagcctattcgcttaaaaatggtactataacgaaatcaaatagcgttccaaaattgctcaagtgaaggtttatcaaactacagtgatgataatgtcttgtttgtctcagttcaacgaatttttacatttccctttttctgaatccaaaatatatagaaaggtagcagtattaatgtttttatgtttcaaaagttcaacttaaaagacatatgtaaaaactcatgttttcataatcagagggagtatttgtcaaactagccacacagaagtgcatctgaagcaacttgccccccccccccctcccaaaaaaaatgcttgcttgttggcttaaaaaaacgcaagcaacatttgaatttttcatattgattttaaacaatccaaagcattttttttctttttttcagccttagcttttaaaccactaagaatagaaacacaagttgtaaccccgtaaaatctttggcttctcatatttacgcaattatgagattacttattttgataaagatttatagcatcattcaagtaaatacaaagtgagatttaagaaacataagctgcttgtgatatagctgcacctaattaagaccggttaatgctatgactataaatagggaccaagatgtcctatgaaataaaaaaaatagaaatagcataatccaagcaaacccactttctaaattatgattggccatcatattagcaaaaaaaaagtatttttttaggttaatgcacaaaaacaattcgagattaactcatcgaggagtacttaaaaaaaaggtgctaatgtctgcgccctaagattacttttttgttgtctcatttatttttctacgggttatcatccgaaaccaataaattcgacatagctgatacattttcagatgcaaccaattgttttcctctctgtgtgttttgctcatgttttgtcaaacttgagagaaataagtggctagtaccctgaaaacctaaaggcaggggcaacgaatggtacgtttgcattgcaggcatttcttctccaaggcgtccgtgacattggcgccatccttcattgacttgacgaccgccatgaattcatctcatctcatctgatttcggtggtgtttggattagggacttaattttagtccctgtctttaaacattatttagagtattaaatataatctacttacaaaactaattacataaatgaaagctaattcgggaggcaaattttttaaacctaattaatccataattagagaatgtttactgtagcatcacataggctaatcatggattaattaggctcaatagattcgtctcacgaattagtccaagaatatggatgtgttttattaatagcctacgtttaatatttataattagtatccaaacatttaatgtgatagggagttaaaactcaagttttagtcccacctaaacacggttcatcaggatacaagatatcagcacagtgttgattgagtaggttcatcaggaagcagagtaatagcacgtaacagagttgggtatcctgtatacagcagttgtccccaaggaagcaactctccatcacatcacatcgcggaatctaaaaaagaattcatcaatcctccattttctaaaagaaaaggaaagaattcatcaattctgccctgccgcagctgcgtcctataaataccctacacgcgtagccatcttctgcaatcatcaaaacacctgtaatcatcttctgaattcatcaattcagagttcagagcagagtgtccctgcttctgtgcagaggagagagatcgagctatagagctagcctggctgctgccatggcgaccggacgacgcctctccatgatcctcctcctcctccttctcggcttggcttccggcgacaagattctcttccaggtacgcagccagccacggactgaactgaagttgtgaccgatttcagttcagtttctgaacaagctgttgcgttctcttcaggggttcaactgggagtcgtggaggcagagcggagggtggtacaacctgctgatggggaaggtcgacgacatcgtcgccgccggcgtcacgcacgtctggctgccgccgccgtcgcactccgtctccacgcaaggtcggtttctcctgctgctcctccttgtctgaaactaaactctgaacattttggagttggcgaaatttgggatcctgcaagcgtggagtggacagcacgctaactaagctaccctgattgcgaagtgtggataatgattgtcactttggcctttatttcatttgggttggaatgagatgtttcactgatttagttgaggaatttttggctagataatatcacactgacatgcgtaagggtcaatcaatcttgcaaccccattctaatcttatacagatgcaatacaaaggtaagctgtcagcagttagaaaaaaagattaatgatatataattagtgtaataatgagtactagtaattaagctccttccaggaaaaaaatatgtttttttttcactttccgaagtaactaatatgccactttattatcatgtttttattttctaaaaacaataaaaaaaaactactactgtacttcctgtgggtacgaaaacatatcatttctaaacatttaaactggatgtgcaaaaatcatgtgtaaatttagcatactttatccgttccacttcgggtattcaaaatacatactaactcagggtctatttggcataactctagcttcagaagctccagcttcaggtcaaccttttccgaagctggagctcaaccaaacgattttagctccatagaaattgatgttgattttacaaagttgaagttgattaggacgtgacatacacgggagcgtatcctatgcacacagaccctcgcgtgtacacaccgtgtacaccaactaaaaattatcacaaaaaattttaggaaaattcatacatgtactttcaatagtattacatctacgtgcaaagtcgcatcttcaaattcattctacatagagaataacaaaaaagataaaattctgacaaaattgcaaccttaaaactgtcagattttttgttttttttttgttacggctaaaatataatgaatttgacgttaagattttaaccctaggtgtaatacaattgaaagtatatgtatgatttttttctagattttttggtgacattttttagttggtgtgcacgtgtgtacacgtgagggactgtgtgcataggatatgttgccgacatacacacatgtagtgagtatgcataaggcatgccatatttatatcttggtctctactttatcttacatcattaaaatgtcaatggtgaatttcatatctctgtaaccatttaccattattcatattttcatatctttctctacaatcactatgcctcattctatctttttttattgaataaatgtatgtccaaataacaacttttttgttatatattcatgtagtatcataatcagcgcctagatctacaaacttagccatgtagtatccttttggtcttggtttggttatgcaccaaaatgagcgattttataggttcgtgtactagattgcatccacctgataagtttgcatactgccaatgcaatttactcgttattcaatgtggcgatgtgcgtgaagggtacatgcctgggcggctgtacgacttggatgcgtctaggtacggcacgtcgatggagttgaagtcgttgatcagcgcgctccacggcaagggcattcaggcgatcgctgacgtggtgatcaaccaccgctgcgccgactacaaggacagccgcggcatctactgcatctttgagggcggcacacctgacggccgcctcgactggggcccccacatgatctgccgcgatgatacccagttctccgacggcacaggcaacctcgacaccggcgccgacttcgccgctgcccccgacattgaccacctcaatggtgtcgtccagcgggagctcaccgactggctcctctggctcaagtctgacgaggttggcttcgatgcgtggcggctcgacttcgcaagggggtactcgccggaggtggccaaggtgtacattgaggggacaacgccggtggggttggcggtggcggagctgtgggactcgatggcgtacggcggagacgggaagccggagtacaatcaggacgcacaccggcaggcgttggtggactgggtggacagggtgggtgggacggcgtcggcggggatggtgttcgacttcacgacgaaggggatcatgaacacggcggtggagggggagctgtggcggctgatcgaccagcaggggaaggcaccgggggtgatcgggtggtggccggcaaaggctgtcaccttcgtcgacaaccacgacactggctcgacgcaacagatgtggccattcccctccgacaaggtcatgcagggctacgcctacatcctcacccatcccggcaacccatgcatcgtaagtactcctactactgctacctctgtttttaaatagatgacgtcgttgattttttatcacatatttggccattgtcttatttaaaaaataatgtaattataatttattttgttatgaattgttttatcactcaaagtactttaagcatgatttatatgttatacatttacataaattaattgattatttggttaattgactctcgaataacatgcactattaattgattattgtcatttcagttgactataaatatttttttaagaaacacactttggtaatagctatatttgtgaccctacagacttcagtagtaaaacatatttataattatttgtaattttttccaagtaaggaagtagtcaaagtttaatattgaatacttcatcaattttttgctatttattagccgtctaatacttttttgcccttatttatcagttgtctactaaacttgcataatgcacgtgtgtacatatatatacactcatcagtcatctaaaattgcacaataatgtgcctgtatatatgtacatgtagttctacgaccatttcttcgattgggggttaaaggagcagatcgcggcgctggtggcggtgaggcagcggaacggcgtgacggcgacgagctcgctcaagatcatgctgcacgacgccgacgcctacgtcgccgagatcgacggcaaggtggtgatgaagatcggctcccgctacgacgtctccagcctcatcccgcccggcttccacctcgccgcccacggcaacggctacgccgtctgggagaaaatcgccgccgccgccgccgccgccgatcatcgcacctcttccagcgcatcgctctgattgattagcgatatgatgcttgtgtgccacctcttatgttttacttctgctgtatatggaacaggctcttctacctttaaaggtacgtactttcgtcactgatatgtgggatcgataaaccatgggtctaactgttagtgataaagccatgatgactttgaagatataggatttcaatccctgtatatagataagtacatatgtaatatacatacgcatgattagtgacatatatatacactacattgccttggctgtgatcgaccgtcggtattggctggagatgtaaaccatttatattatcttaagagaaaaatatatacacagttaaccgagcactcctaccatttcataattctttgtgttttgaacaaagttgaggtcaaacttttataactttgattatcaataattttaaatatatttagtttaaaggagctagagatttatctttcaaagtattataagaaaattaaacatgcatttatttattgtatatattataataaaaaaacaaaatcaaatatatattttggagaacatgtcattgtccaaaacgttaagaattatggaaccggagagagtatatatagttgtgtctccaagctaattaaatcctgattactgtaatgtgggatattaaataaaggcactaatctgttcattttaagtgatttggtataataattgtttatagctcgttaagtaaagacagatatggtattatattccattataaaaaaaagcattaatctacacaattcgaactttctacttatggctattatgactaactttattttcatatccaattgagattagataaagagatactccctccatactcataaaggaagtcgtttaggataatgtttaagtcaaaccttgggaatataaatcatgaataactctcaaattattaagtttgaaaatgtaaaaattatatgaatagatttatcttgaaaaatattttcataaaaatatacatatatcatttttcaataaacatttttatagaaacaagaagtcaaagttatgttttagagaccgtgtcgctgttctaaacaacttcttttacgactaatgagggagtagctcattaaagtcacttgaacgtggtggctcgcaccgacacaaaccccggccgacatgaacacgcttcaccgtggcggcacgatggtgcatggtcatgcatcgctcgatgcttgccggccatgtctgttccaaattccaatggtgttgacgcacacgagcaaggatacggaggattgagggacgccagctggaacgtacatgtgtacgtcaaatgatcaagggatgaaatagatttgaaaaatagaaggtcctcatcagttggtctactattattataagtcataacggcttgttagcgattaaaaaaataatatatgagtaaaatttttgtatatatgttcttagtgattgaaaagctaaaattgaaaaaaaaactatgttgaaaagaatcaaattcaaattaaaatcaagttttaaattttaaatttggctttggcttataagccatgggcaaacgatgaggcacgaagcttgttgagcaaatagctatacaaatacatgatgaggattgggtcagctaaaatttgctcacaaatatatatctcgattgggtaaaaccttacgcccatgtgactattgttcagcctaacagttcacacttttggtcaggcttgatgaaatataacatagcaatttttcaactcttctccatttcaaccacacaatggtacatattgttggcaacttttttggcaagtagacaaacataatcgcaacacctaaacgctttgcggtgattgtagagtcacaaatcaccctaatcactaccatatttcacatgacaacaaatgatccattatcattacaataaatttacgtcacgaaacatgagcatatctattcacccaacaaataacataccaactctacaaaactattttccgcatcactagcaaaccatatttcagctatttcacaaatcttcgtatctcaacaaacatcaaattttcacagtgtatttgacctaaacccgataatttttttattttttcaatttctaaactatttttggttttgtcctcaaatttgaatttatcttaccctatttttaaaaaaaaatcttcatcatctgccactacaaatcaagaactacatccatgattttttttctttttttattttttttggaatttttaatttgctcaaatttcatccaaaccataccacggtaaaccgttaccgtgtcccagcataagcgttattaggtaaaccctggcactgttagagggtaaaacgccgaaggttggctagggtggtgacacgtggcgtgctgtgggtgtggcagaaaagatgagcacaaggaggcgatgtggcatttcggatattcaaaatacataccttagataatttgtttgataaaaagaattacgcgtttccacatactgtattgttgagcatttttaatttagaaaatatatcctatacacacaagttccccgtgcacaccaactaacaaatgtcacaaaaaattttagaaaaaaatggacacttactcctaatagtattacacatatatgcgaagtcttatattgaaattcattatattatagcggtaacaaagatgtgaaaaatctaacagttttaagggtaaaattctgtcttttttgttacgtctaaaatataatgaatttgaagataaaattttatacataggtataatactattgaaagtatgtgtttaattttttctagaattttttttaatatttgatatttacgaagtgtgcatgaaagctcgtgtgcacaagatatgttccattttaaatttacaggattgataattaactttgttgatgtaaaattagttaattaatgtggccagacacgtcgaggggcacggcggcggagttgaagtcaccgatcggcgcgctccacggcaagggcgtgcagacgatcgccaacgtgtcgctgatcttcgaggcggcacggccggcggccacctctgctgggccccccacataatctttgtaatcacatcaacgtgaagagcacaaaatctcacacaaatgtcaccattaacatgtacttccaccgtttcataatgtaagtcattctaacatttcctatgttcatattaatgttaataaatctagacatatatatcattctagattcattaatatcaatatgaatgtgagaaatgctagaatgacttacattgtaaaacggagggagtactcgcgattcgcgaatgcaccaggtgctgtagggtagtaggcatgctcagcacttgtgacagaggtctgagaaatcatacaacagaaggtccatcatattcctatactgctaattgttcaagctggtggctcgcaatggtgacatgatattattctcagaagtcgcaagtatgacctcaagcaggtgatattgtgtgttacatcatacctcctatacattgctggatggaacccagtaaaatgaactcattgcaatagcgggagaaggctaggggggaaacatgatatgaagtgaaggcaccaaacagctagcggaatagagtgcaacttggcctccatataactgcctacagagcctatctatgtgctagccaggtgtttcaggaagtagtggattagacactcccccgtttgtctactcttcttcaggattaaaaaagaaccagatctaggttttactttggacgtttgcggtaaggatacatgatatcatccatggtgtctttaatgtaggccccaactttatttaagttccttgctacaccattagccacaagtccagcattcctctgaaatctgcaggttcatcgggaaatccgtcattcattaaattttgatgccgatcttaagggatctaaacataatctaaaacagaagaggaactcacttggttaagaaatcatctcctctctgtgcaggcttatatcgccgtggttggggagctgcagtgttatcaagataagttaagtcttcaagaatagaaatgaaatgtagatactttggacagttactcataacaaactcaaagagattcatattaatgcaatttccgaagtgaccagattgtttcaccaataaagtcaggaccagtctgagatccagtaactccgattaatgagaaattggtcatacaagtagtggccaggaaacatttctacacaaccgtgataaaagtacagtgtgctaccatgtgtgcaggttggtcacaaagggtcaacaagtaagggcaaaattggtctatcatgataacatttggcggtttcaattttacacaggctcaccaaaaataatagggataatcaaggaggcaacattcgcactcgaccattgttgtgcactaacaatcctcattcaaagttttttctggagggaacaggcaggagctctgccatttcattgataggagggaaacatcagttacaacgctaaaaaaaaaggcatactgtgtagaattcaggtatatgtataataggtccaatatctaaaccaactagatgtgacaacaggcaaggctcatcaggtagaacacaatagccactacacagacaatcaactttgctagactaaatgtgtcagtgattagcatactgtggtagaattggtgttgctgttctacgtgctagtcaagcaataaaaataaaatatattcctaccttcctttttatggtgagatgaagcctgattagtcgaagtttttctatcagccaatagctgcatgggcatttgcagtgcaaaaagatcaggaaaaaacacaaaagatatatatttcaaatggaataggcgaatagcatgggtagcatctgtttgtactgtcgttcataaaaaagaaagaagaagtctattttgtaagcagaatatgaggaagcaagctaccacgaagtctaaccatttgtacatactacagagctaagttagcacactgatacttttcacagcatgtctgaatcatcacaataattctttatggtaggagaactgtttcataactgcttactctgcacattatgtcatactaacatgctccaacatgtgaactgacaataatgtgtgcataggttcagagcaataacatggttaagtgggaaatacctcgattccaacacaaataggcagttgcgggtgcttgtcacctttcccttcagaactcttcttgtcatccagatacatggaatagccgatacatccatatctgaagtcggaaaggttgcgaccttcctggatagcttccatctcaatttctccaaccatgtgatcagggactgatgcagaaacatagaacagtcagccaatgccaaccattgcgaccgaagaaaacaattcagattgagcatttaaacaatccataaaaattaggccaacagttaagtactccattaaatgacagcaaattcagagtaaatgacaacaaaacatttcaaaccaagcaaggagttacggcgcagtgcgatggcatgtaacactgtccagatctgcagttctgctgctattaggcattagcagtggcagtggcatgctaactagcaacaagtcaggatgaatacaaatatcgatcgtgcgttgtggtgtgtggtaaggatcatggttacttccaaaagttacagttgctactatgaccgcgccaatccagcagttgcgattgaacatctacgttccccattgttcctgcgtgcgtgcgtgcgtgtttgcagggtcactggaataaggtgccagaaaaagctccggcgctcggctcagaggcagccgcggctgaatcagcagcagaagaagaaaccctagaactcgtgagaccctaaagctagcgcgcagtagcatagcatatgctcacaaatgaagggaggggcactaccttgggggatggcgcgggtgatgccggcgcagacgggaccgcggtctcgcgacctgagcgacgacgagtagaagaggtagcccttgcaggacttccccttcaccgccccgcccccgccccctgccgccaccggcggcggcggcggcgcgtctgcaccccgcgcctcgccggctcctcctccgccgccgccggcgacgcgctccatgccgggctggcgggcggcgagctggagggatacgcgtgtgcgggatcgggcaccggcggcggcggcgtgaggcggcggagttgggaggagtggagcggggggcttcacctctttggctactccaacttccgtttatttaccatttcagcctcccaaggaaacataatggatgagatgagcccgtgtttgtgttgtgatttgtgaagcattcccttttcttttctttttttttgacaatcgtgctttatttaatttaagttgcaattgtgattttgtccctttttttagcgtttgtgattttacttttagtttttttaaaatgaagctttagtttgcccctgctttagatggcgttaggtgggtccagattttgtaagataataaaatggataaggtaaagaaaaaaatgtttacaaaatatagaaagaccattgtacccctgtaaaaaacacttaccagttaccaccacctaagccatccaacccattctcctctcccattccaaacaggtggatgcaggcgacggagacagaggtggcagcaccggagcaactcacgagcaggctgcgacggtggcagcgctcgccggcgtgagcagcggctgctcggtagagagcaggtggtggctcagcgacgctgtagcaggggaaggggtggcttagcttggctcagcaacgctgtagcttgctgcgaacatcgttcagagtaggagcagcaacaaggacacacgacaagcaagctcatccacgaggccaatgcaagggatgctgcctcctgattttctttttttttccccatctcatagttgagagtatatatttgggagaattttgtttggtaaatattttttttcctgtgaatgcgatgaatccttggtgaattttttgcgccctgtgcaacttctgtaaaagtgatatccaaactctatcaaaatttgtcaagtttggtcaaatttgagagaaaatgtgaagggtatatatgtcttcttgcagctcatttgacactgttagttggtcttaacagagtaagggcaaattgaaacttcgtttgaaaaaagtaagggcaaaatcacaaaccctaaaaagaaggggtaaaatcacaattacaatccaaaataggggtaagaatgtaattgtccctttctttttccccttcctttttacagtttgaaatttcatattgttttgtatttgaagtaaggatgtgtaatctaaaaacggcaaatatacaaagacagtgtatgaaaaagagcactagattagaaatgtgcatcaaatcgtacagtagctctctccttttcagcttattcactgaatcatttattccacgctctagaaaatattgtttttcaaaaaatctatcgcattgattaaattttagatttttgttttaagctatttagtattttgtattaaaataattaatttatttcgataattataagtagataatccgtgaactatgttcaaccattcatttgctgacaattggcttcggccttgcttatgtttatatttaccaatcaaaatatgaatttttaattttaaatttaaagttgattttaaggttttttatcgaagtttatatttcagcctttgtttttaaatcgttaagaacacgtatataaaagtttattcacattttttttggcaaatattccgttttgcttatgcttaaaatcaaccaaacgatggcttccaacgatacatgggcactgaatgatttaattcagctgacagaaaccatctctttgcatatcatagtaccagacaagacaaacgatgaggttaattggatggaaaggaaagcacgcccattatttcatcactgggatcgaattaaacaggcagtacagctggtatatctgaattcttgtttcaacaaataaatatcatatgtacaaaacgtaagattgcaggatacaattagttcctgtacaatgagttgtatctacagaatgaatacaaggtagtgatgcttatccatgctgagcgctgcggctgcattccatggccagaaccaagcactgtcaatgagttaacaaagaattagtctcagagtcacaaaaaaaaatgcagttttcgatcaggcaaaaacgactaaatacctttctagagtcccatttggagtagcagcactgtctaaccattaatgcagatgcggctggatatgcatcaccatcagctgttagcactgagattgaaatttttgtcccgtttcactgttggtcagtgactcagtgttacagattttgcatactatgtgcagcaaggacaaatacatacctcatgattgaaagagggtaacagttgcaatatatccatttttcatgacctgttaatcagtgaaggcagaacaaacggtttcacttctgagtaatgacaatacagtttgcacagggaaaactctattcttatttgattaattaaaaaccacctcaaaagcaatattctgatatccatagacaaaagttgacccaaatggattattcatggagccttgcgtctggattgctgctcgaccacaatcaccaaggatctcctaatataacaaccaaaatagatggttttgttaacacaaggcaagggaaaaggttaaagagacatccatacttggtcaaaaaaaaaaaagaaccataacaaaaaaacagcattgtaactcaaagcatagatacatttacagcagtcataaacagaaacgacattcctaacataagaactttggccattatgtttatctggaagaataaattggcattcactattcaaaaataaagggatctctcataaaataacctaggaagttaaggagatataaaacagaattgcaacagaagatgaacacaatgttgtgaacttgtgattaaataaatcctagttcaaagcaaagctgagcttgagaacctatctattaaatcaagacaagacaattagtatcttggcagtgcaaaagtcatgtcaaccaccataccttgacttgttcccactttgtgcgaggcgttatgcaactcttagggatactaccaggctgatctgtcccttcagctgatcaagacatatagttaataggatgtagttggtttcttcacaacaaactaattctacagcaagtagttcagaccttcggcatcatagataacaaagttacacttcatataggaattgaaatctgaatgaccagggaagtttgtgtgtaaaacaaacttctttatcctgtgtgtctgcaaggagaaaataaatgtagagcaaggttagcaagcattttgagtctctgaaaaaaacatgccctttgaactgcagacatccttagtgtaagaatataaatacctgcccatcaaataagatatcaataccacgagagaagtagttgtaaaaataatccccacaaagagttgtccgagggcgggggtctgatgctgaatgtattaccatctggtcaacctgacagatgggagagcaaaatatggtttgcagatgagagcgagtagattgaattaaggagcacactcctttatattgaacacaaggtgccacatcatgtttttacaatatcagaaaacagtatgcaatagtttggaaaagagttcttttgacatgcttcagtgaagcagtgagttgttgtctaatttcaacacattgtcgtctcctaacaaagtaacagtcctatgctatcccagcacccaaaagatatgccatgtgaaaatgggatgccctgagatcttgtaagggcatacatactcattgcctgtgtgcccatgattatgcatgcatggcatgtcatagcatattaaaacagagaagatctgtgtgttctatagcatggtcagatgttaacaggagctaagtacacgataaatgtggaagttcaaatacatgaaagattttactacaataccatacttcatgttcaacaaactcaatttagagcatattatttgtgtgaaatagatattgaaatatttacatgctacaaaacatctacgggaatccatattgcaatggtttcactaatagattaaaaaccgacctgcttctggtggatgccacatggacgacccaactcagtccacacgtcctgccagagatgccaaatcaagaaataaataagaccatcgcatcaaagtggtgagaaggggaaagcagagagagatagagagagtagacggcataatttgctacctgcggtgatgcaccgaaaggaatatgttgcccgcctatcgtgaacaaaagctcttcaccaagctggaaacatgataatatcctttttagggatgccaaaagattatatggagatacattttccaaaaaaaaatataattcctttttgttccatatgtgcatttgcttaaagaaaaggttcctgggtaagagatgagggttgtgaagtatatatatctccttggtttctatacaactactaaggctgaaaatattatcgatataatatggtgatatacctttgcatgcacttcctccatgtacaggctgcctgcaggtaatgcaggaacaactgctttatccatcagtgatccaaccccaaccttgctatccgttgaactgtcatatatagaaacccggcaagtaacaggagttgttccgtcaggaaattccagaggcaaatctgccactgccataacaattagggagctgagctgagattctgagaaaatataagtatataggacaactgaatattgatgcttgaataattaaatgtggcaacttggcagcagtgtaccttccccattggtaaacaaatttgtatattgactggggatagggaatgcaaaggataacccctacaagaaaatgtgagtaagatggataccctactgatcatgagaagaaaaggcaggaaaaaaatgtaaaagaataacacaaggcaggctacttgtcatgacgtactggatagaagagggtgtaaatgcccctctctttgtcatatatacccgggaaagtaggtccgaataatccataaacagccacaaaagtggctaatgttgatgggccactgaaagagaaaaggagaaaataaaattatcaataacatagcacagagagttgggttaaatggccaaggtgattcagtgaaacgagtaaacatgccaaatattggctcaacgaataacaagctcctcacccaattaaggactttgcatatcgcagttgcagtcttttcacgtcatagatctcaatgagacgaagcctctgtaaggggagaaattatctttatcacttgcttaagtacgctgaatatgtttcaccaaccacacaagttcaggaatagcaattctttttggcgctaaaactagattattttttttcctagagtaatgactttcatgctctctaggatctgcattacactttacaattaatcagaatacatatatcgctccaagttcaattcgatcacataagaggtgcactacagtactctatattcacaaaaacatttttcgtattaacatgttaggcacaaattagccgaatgatgcctgagatgtaaccggactaccaggaaatcaaagcacatgtttcatgtttgtaccatacaaacttacctgtgaccaaggatcgaagcgcaggtggaacccatggtcaggaaagcttatgacaaaatccaactttagaggctcctgaagccacagaaacgacagcaaacaatcagttgagctttactggcggcgcatttggtagcaaacagagccacacgctatcacgaacctcatcgaagtacttcacgtggacaacgtcgtagagtgttggctggccctctatctgcgcgaacgcatcggaaatcggcatccctgcagcagcagcagcaatcgcgacctcccacgtaagaattcaccagccacagaatggaagcccggcgattgcttccaacacaagcatatacatatccgtggcaaagcgagaggaaacaagcaagcaaccgacgacgacggcgatcccaaccgtggcggaaggtgggtggttagggttgggggggaggaggagctcaccgagggtgaagggcccgacgccgttgccggggcggaggtcgagcgtgatggcccccatggccgtgccctcgcagcgccgcctcaccggcaccgtcgccggcgacggcggcccgacggcccccgcgccgccgccccccaccatcgccggcgatctgtgcgcctgcatcgctgggcccacctcctcctcctcgccgcgaacggattacggattattccttgcgctctctcctcccctctcctctcgattcgattcgattcggttcgcgtgggcttgcgtctactcctccctcttcttctccccctctccgtcgactgctttgcttcgctttggtttaacgagaaactaacggggcttgggtcagactgacaggtggggtccgagtagtggtgggacccggtcctcagtgagagtgggttacactgacaggtggggtcggaaagagtggtgggacccagtcgtcagtgagggagttttgccgtcgcttcggtttcgtgaagaggaagaggagcgtcgccgcccgccacgaaggttaagtaggtagacggtggagatcgcttgtgccgccgcgtgcgctgcatcggggcaaccgttggatccgtgccttccaagactcggaatcgcaacagttggattcaggacgaaccgtttagggatagagaaaaattcacaaggatttcatacgaatacaaacatttgcgccatttttaacggataataaaaaggcaacggcccagagttgtgacgccacgctgacaaccaaatgcaagtaggttggatggatcaatcgaacgtaacacattaagcagtttatgcttgactgaaagataaatgatgcataggcatagcgatgtgtatgtaacaacaatgcactagctgatggaaaaacgaaacaaaagggtgacagaccagtggcttcgttcttattgatcatacaacatgtcgattgcacgttatcaactggaaaaagggaaattaagttgtttgcaccctggaggtgctaagttctgctcctagatgcagcagggctcctgttcatcagtcttcttttccatagttgtagataatctcgatctgcaggagtcatataatcaccttataaactgattgcgacactttgatgcacgaaacacaaaatcaaaggaaaacaatgtgacagcagcaaaaccggaacaagtatggcagcaagtaaatccttattcataaagctaaaatgcatcgcaaactgcacagaatttgcttcttttcacatatgtttatccataaaactaaaatttgcatactattcacatatgcttgtcaagttttgactgaagcatacatgccatataagtaatttggatacaactggaacaaaatactctctggtagtaccaaaagaataaaaattgagctagtaaagtggatggtgactaagagaatgcagcaccaaaaccagaacaggcaacttaactaaccatacagtttgtggcagttacctctttattaatcagtttatagtcacacatctaaaagcataaaataagatttagaacaaagagttatgtgtttcgacaaacagagatgtactccaatgtggactaatgtttgaattaaggtgatctaaatctgctgagtaattttgttaaacatttagatacaaatctccaagaaaaccattataaatgacaagcactacatcaatttctactaaggacaagcaaatattggacgaggaaaaggagtcaggcatgataagataaaaaattatgaatttatgttcttacccctttaggtggaggagggtttcttgtgaatttactgccaccaggagcccatgggactgcagagattcgaacaagcatataagaaccccaccttattgatcacatcatcaagggcatcataatatgcctaaaacatactactaactcctaagggaagtttgaatatctctagtacaaggcagtagtgtttacagcaacggtgaatacaaagtcagtctgatttgtgagattcacatatcagctcattgcaccagtagtccagtacattgacttgaaactagcaatacatctcagaaacagctgcagccttttagtcccaactcccaagcaagttggggtaatcttaaacaatataggtagaaataactatgagctgaatggtgatttggcattgccatttgaaagataataatctgtaaggcagttactttatagaagcaaatctgtatggcaccgcatacttatcagcagggatgttcatatatggttccagtgaaaccgtgtaatcacatcagtggcaacgctaatcactagctacttttgcttaagtttgttttggaaggtttcttacaaatcatagttgaacacccctacttatcttgtacccattttaagagttctgaagccttgaaagtaaaaaattaaacgccaaaccaaacagaaatgctaccatcctacatgacttaacaagagaaattcggcttgaaagagaggtttcggcagtgaaagcaaaattctccagcatttcagagcttaccaatgtagggatcgggatgctggaaattcctgtactgcgcttccgcatcatcgataagcctatcgatcacatccgggttgtcctgcaattcccctcacaaaatcaaacacacaaaaaaccattcgtaaactacaactcgcgagttcatttcgcgacacaacacaacaagcggaggcggagatgcgggaagcggaaacggaggcgttaccacatctctgttcgcctcgaacttctccctgagatccgacgcctgcgagggaggggggaggaacacgaggtcagatccgcgagcacggggggagcagatcggaaaggggggagaggagaggagagctcacgtcctggtagaagaggtggcggtggacggcccagttgagggtgtccttgagggcgcggcggtagagcagccgcaccctctccttctgcgccgcccgccgcgccaggaaccccgccgacgtcgccatcgccgccgccgccgccgccgcttgcttcctcttctctctcctctccgatggtgtggtgggattcggatgcggaggagaggagacccaactgacaggtggcccaagcggaggagggtggatactggctagcaaggccttgatgggctaggccttttgtatagtagtgggctgggctttagcacacagggtattattgtagttgggccaatttttgatggatttgggcttctactaatctggtaaggacctcattgtaaaccacttgtattttcctttatttttttatcttttcttacatttgtgggtatcctagcgaaatccgtaaatatttttctgctccctccatttcatattacaagtcactttgatttttttcctatttaaatatgtttatgtttgaccaagtttatgaaaaaaaatattgtaacagttctaatacaaaacaaacatgttctcaacatatattcaatgaaacattctaaaaaaaacatatattcaatgtaccacaagctgatccttggtattgcctggcctctattcaaaataaacaaattctccaatgacattgagctactaatactaagcaatttcttcagacagaaattctcaagaaaaagaggagaaaagaactcatatgagagtaaagctgtgttcgctatgggttgttcccaacttggaacagtagcatggaaaacggagcgatccattagcgcgtgattaattaagtattagctatttttttcaaaaatggattaatttgatttttttaagcaacttttgtatagaaaccactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtgttaccaaccgggactaaagctagagctgaccttttttttttgcatgcccctgttgctgcatggtttatatatatatatatatatatatatatataaaccatgcatatatatgtttcaatacatatatatgcatacatatatatatatatatatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacggtttcgacgtagtagtactcgctgctagctcagaagctaaggaccagtgaattgtgtttccgtcgtagtagaattcacccttgggatcaaggatttcttcgttgatgaatcccatgagttgttcttgaaccgccgcgataaattccaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccctttgccgcggaccaaatgatggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgtttttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgtcttcgaccaactcaacttcgaccttagagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcaagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttctgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccacgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacagacgactccgacaacacgtcttttctgcaagataaaaaaaatgtattaggataaatgcgaagtaacatatatatatatatatatatatatatatatatatatatatatatatatattgcatttcacgttaacgttcgtcctcgttcgttcgctcgttcacgttccctagctcgttcacgttcgttcga

SEQ ID NO: 66767 - DNA, 17292 bp, Oryza sativa
ctgcagcctgcttggaacctgtagactctctatatctaccgcagcccggagttatatatggatggtacagttaataatgcttgatggtgattgctgaaaacgtggcaaaattgggcagaccattgataactttgctagctacgtgccagacagcaaccagatccaaaacagtgttaaaatctgtactactgtagcatcatgcatgtttcacgccctttgctctcagcctatgcgtgccagctagcctcttttgccttcgattccacagtgccactgaactgccacacctgcacacaccaccacgtaggcacccaatacttttacatctgtgagtatgtcccttaatttgctatttgttcaacacaggtgattaaatgttaattaattcggtacacctactaaattcatagggatgccgcatatgtaaattatgaacaccataatttaaaccatgttctggagagtactatcttcagttttgtttggcacagctttagctcctggagctgaagctcatccaaacagtttcagctatacctaaaataggagcagagctgggtggagctctctcacaagataaactagagttgtggagctaggtctaggtagctccacatcaggaccggtcctagggttttggggccatagggcaaaaacttatatggaggcccctatgtatacatgtaaactagtatatatatttatatagtcttataaagaggaaaaaagatagagaaatttaccaaataagatgaattggacttgaaggagtgtaggatcttgaaatcagatgaatgaatgaattggaggagtgtagtgcaggcagcgggcgacaggggcagcgagtagtagcgagcagagaaggcgaccggtggacgatcaagacacacgagcatggctactggcgagccgcgatttgctgacttgccgtatccgtttgcgagatgccgagaagtcaccgagagcgcaggagcagcgagcggcgtgatgtgatcgagatggtgcaacgcgagtggcgtgtgtgatgtgatcgagacgaagcgacgggagtcagaggaagatcgcttcgtcttcgctgaaacaagcctggcgatggactaaaattcattttctatattgggctattcagctgtctaacttatataggcccatggcccatggactaaaattatataatacgtagtatatatactatatgtgtataggggcccctagattttggggggctcgggtggcggcacggcctgaccccccccaggaccggccagtccacatctccactccagacccaactcatgtaactaaatttagacgttggagctctaccaaacaggccacccttacacctatattgtttcatgaatctcatcatagaaaacccaatccaaatcaaatgtgacaccccaagtattattcgacatttctggcatccaatatctctccatttgacctaagaaggccatggtagctggtggcacgtggtatagacttcggcaaaacatagtaagtgctccgcgaccaattcattatggaatacacaaaaagtagatggacgcactcctttttctttcacctgtgttcataaccactctctacttagaagccattatcgatcgaaaatacataaaattcaccgctgacccgtgaaacatgaggatatgttttgtgtacagatgacatgaatcttttcggggatatgagcagttctcacagtatttgtaaactataacctacctccatggttgtgcttaaagtggaaatacgttatgttgcgattgttaatccacggaccgaaacaacccgtctcaatgataatgatgtattgttagagccggttatcgatgatctagaaatactctggtaagaactttaatctccgcgtcctattgttttgcaccattaatgactattccatccttggtaatctttcgagacaaactgtgaaaggaaaaaaaggtttgctcaggctgaaaaaatcgcaaaatatattttacatgggtcataggagttagttggctccggttacgtcactcgtacagaaaaaagaagaaactttttcaacggtaagaaagagcttcaacatgctccagtggatttaaccatagatgaggtgcatgacatgattaatatataagtaatgagtttaggaagaaaatgaaatgtcctaaggaaaatgagaagggtttgtggaagaaaatccctatatattggcaactaccttattggaaagatatcgacgtccgtcattacattgatctcatgtatacttcttctatgtattatcttgtagtactatcaaaaaatcaatgttttgaatacacaattatctagtacaatatttttggagaaactatacatactacaatatacaaaggaaagttgttggtatgagctatagcccacctcatctagcaccctcttgcctagctaagcaagctggattaagaaaccaaactcagatcttcagttttttaacaactgggatcctcagaatcctccatttttcgtgtcgtaattaacataaagccgacacatgttgatttgttctctctcactatgcaaatatatatacatagaggtgcatcattctacttacactacttatcagagggaatgctggggtggattgttggatcagaagtcattacacaaattaatcaatcgagcaaccatttgtaggctgtagaatgaaagattgtggtgaattggcctacaggtcatagagattttaatcctattgacaacccactctctcaaacagtagtaacaactagtgttgaattggtgtcatgttacgcatgttggacataatttgcataaaagttattgaagggttgtgtttgatgaagacatggaagccattggtgaccatgtttgcatcaaaaggttacagttctggtagtaaaacaccagtacagatggtcataaggcttgaggcccgatagttgggccgtgcctgggccgatgccttggcacggtgggctggcccgacacggcacaatcaaagaaaaagttgaggaatccaaaatagacttaactcagccatacaagacatggcccatagagaagaaggatacacgatagacttattccaaccatataaaacatagcccaaagagatgagggaggaaaatagacttattctacgaagaagcacaatgtgttgtcatgccttcaggcagcctagcacggcttgagtcttaatgggccgtgcctgggccgtggatgcagcctgtgggtaggcacggcccagcccagcgtgtagatcgggccgtgccggcccaactgaactcatcacaagcccggtcatgcccggaccgggtgacccatttgaccatctataaaaaccagtggtaggtggtgcgatgagggtggcgttggccctccggtctccacttgtacttccctgccacggatgtcacccttcgaactccctcaagcacctctatcagcactggcttaacctttattgggaactaggaaacatctatgtttgtcacctcacacacgagctaggttcctttagtttaatggcgctagtgagtcgggggcatgtcggttgaggtcaactatgtgcactctgatcaatgcacatatatgtctaattaaaaaatacgtaaggtttccgtgactatttttgtccgtcgtcgtcatcatccgtgtacgtgatggaaaactctagtgaaacggactctgagatgagaaactctagggttttgcttatttaggatagggctcgattccgtgcacgatacgatgcagttttgctccgattcatgggaaaacggagagaggatgagataagaatcgaaactcctcaatcaattttgtactatctccaaggatgctaccggatttcacggagaagacgatttcagacagcgtctgcaagctgcgggagtctagccggaggtagatgacgaccgtgcgtgtagcgcgggtacccacgcgacagtgagaggagtaactgagggagcactattagacttgtggatgcctgatgggcttgatgcgcttgcaggccggaggcgaaggggaggagaaggggagaaaatgggtcggctcggctgcgtgttgagggaagaaatgggctgaaaatggcctagggagaaaggagggtttttatttagaattttatttaaataattgctgaatgatgtttgtattatcaaaattagcagtatagctctgaaaattccgaaaaattttaagatagtttaattaattaagaagaatttaatataaattaaatccagccatagtttaattgggaattttttttcccacatttacttcaccggaaaattaattgaactttagtataaattctagaaataatttattaaatgatttataaatcccttaaacaaaaatcatggtggaaaatccatcaagttgtcaatttggattaggacgatacatacatatgtcctatcacccacaaaaatcatgcatcattcaaatttatgttgtcactgcacatcaaaatagaggtctacgagatcaattaaatgaaaatgacttgatgaaaacgcattcccgagatctgtgaactcaatgatgccatcttctttttagagggaatgtgctactaagacgcaacattacatgcaacatgaacgttcatccgtgcgttgccgattcggcacccgtctgtttaccgcgtgctttctgtgttcccatccatggtggtctcacgacagaacgaaccggtcccaacgtcccaaccacgactgttttatcaagccactccaaaactagatagtacagtgatgttatgttaacgttagacctaccatatcaccagacctaacatctttcttttcttcaacatcgtatatatgtgtaattgcaattttcatatgtagcggggatgaaattgcaactacaacagagatacacacatggtttctttatataaagaagataaaattagtattttaattaattacataatgtaaatctttcttaactttttcttaatttttttgaattttcttcctattgcaatcgtacgggcacgttgtcaagtggttagagacgtgtataagtcctggagactcgtcttggtcgggcatgggctcggccggggtggtacgtgtctgttttgcgtcttcctatggcacagttgccatgatatcaaccaacataattatcctatatgaaggcacatggattgcctattatttaattgtaatgacaaactattaacacactatctaaactcatcgattttccaacactattatttttattgccctaattaactagtagttataatactgggagtctgagtctctgagagatactattttttaatgtaaaatttggaacctctaaataattcatgttcctaccaaaatttacactagtaaatttggtatatctcagtgcatctcgaggattgtaaattttccctaattatgaggacgtgatacgtactgacagaaagtgagcagttatgtgctatcagtagcatgattcgaaaaataaatttgcagagtatatttgatgcgcacaaaatacttataaatatatgagtaattttagtaaaagccgatgttttgtagacaaacttcttgtaaaaacccatgtattatggacatgtcataggttttatggattgttgacgattgtcttcgcagtgtccctgtgatattgatcctgataattggttcaggccctctcaatgagaggtaacaccctactcctgtttggggatttgaatccgccgggtgtagtatagatctgatgatcatatgtgctcatgccccctagagagcctcctgcccaccttatataggatggggggcaggattacaagatagaaaccttaaccaatacggtatcggttttctaaatatactttacaatcttatcaaaccaggactttaggccgttccataatatacagggaaacgtaatacccaaatcatgatctgttacatatttcatagatataagttatcccctataactagacggataaccacgccgtgtgggtatggggtacccataatctctacagtagcccctgagactttcacagtcgaaaagataatcttctctcgaactagattactccaaagccgagtgcttcaatcatctttgccatggtctcccgtgtacttttaccaaatctgaagaccgtggagggctgaaaaataattgaatttagacttaggtgcactgactagatgcacctaataggtgtagcccctgactatgtgcttagttgaacaaactaaacatatagtcaaggagtaaataatccaaccaaccgagtggttttgataattgtagtcaaccaagtgacttaatattaagatgtagcatatgcggtgtgaatccccgagtaatcatgatataccgactgctttgtaaaaattgatgcgagcaacctaaagttgagtacatcattgaaaattcacatagtaaaacagctataaagaagcttgaatgctgcgaataaagaaatttccaaagtattgggcatacgccatgcgcacactgctttaacagatgtgcttaagtctctaaaagacacatggtttcaccacacttggaaatatatggcatatgtggtgtaaaatccgagtaaataaactcataaaggatttaccaaccgcctagaaaatgaccacaacgtataatcagcctaagccataatattggtcaacaaaaatgcacacttacgtggcaaaaagcaacgatattgtatccaatcaattgcttgataaacccaaacagtgccttgactatataaaaaagtcagcggggcagctatataaagctttactgtttgacaccttttaagatgcattgtaccaactcctaaaaagttgagtaactgcggtataaaagattttaaggtattgagcatttgatcacgcgcactttggcctaagcaaaaagtgcctaagtcactaaaagaacgtgacaggccacacctgaaaatatgggctgcagacatattaggcctaggccaaaaaatatgcattcgacaccctttaaaggatgatgcatgtaacatgctcccgagtaataaatcttccgagtgatatagaccaagtgtagctcatatgaatagcttctgatctgagtgattatcccttatgggatactccaaaatagatataaaaattgaatcccgactggtgcaagtattagttgataacccttacggggaataatgattggtctggtcttcgagcacagaaaataatctcaggactacaagtacatgttgtctgtatctagaacaaaatccaacttgaaggtatgatctttgtgtttgagttgataagcccctgagcatatatagcttgtccttttatcatagtcaaaattgtccattggcaatagctgatgcagttgatatgaaagcaagatgactaacatggagatgatatcacccatcaaagctgacgacgatgttggtggtggtaaagacaatgacgccaatcaaaggtgatgaagtcgcatagccgtagaggcgaagaaaccagtcggcagcagacaagtcagccaacagtgaagatgaaggcgtccagcaacatcgacaaaattgtgcagccatggtggcgaaataatcaatcggtgacagacgaggtagccggtgaagaagatgaagatgcccattagtggcgacataataagccatccgtgaaggcgaggataccagtcggtggtgacgaaagcaagccgacggtgaagatgtagacacgcatcaaaggcaacaacgaaatccaccaatcatgaagatgaagaaaatagtcggcgacgacaaacgcaactgacatgataaagatgacgatgtcggtgatctagtgaatagcagtgtcgcaacaaatgataatgacgaagacgctcatcagcatttgcatagtaggtcaaccgtgaaggtgaaataataagtcggtgaagacataatcatccattagcaacagcggagatgttagggtcgatgaagcagatgtgctggtgatgatgtcagtgacaataatccatcaaactgttgagaagatattgaagctcaagtattttcttaatgttggcatgtgtgtgacgaagattgatgcaacgcctcttgatttataaagatggcagtagaacttggtgctatagctgttgcagatgcttcacttagaggaaagtatatgctgttgttcaactcattgaatctgatacgagttgattggttgatgactccaaactcccagacatgtaaatttaatcttgacctactgctctgaagcgaagacaaaattgatgactcccagagttgactcgttggctgattaattgattaattcatcttgacataaagcttgtcgaattttgagccatgtatttgtgtagcccccgactatttggttagttgggaaacaactgaacatagagtcgagaattatagcttcttgtcgtcgagtagtcattgcttgattgaagatatgtgttgaagatgtccaagtagaaatcctgaatattggagagccactttttgtagtaaaataacacggcatcgcatgccgagatgtcgaggttcacaaagacgtcgtggttggtgaagtagcaaaacttgcgaagtagcagcaatagagtttgccggtgccgaagataataaagatgaagtcgctccaccatgatgacaaagttgcattgccgtaatggagtgaacacgagtcggcggcaacagaagcaaatcggtagtgaagacgcgcagttgtgaagataaaagcatcagtcggcgacggcataactagtcggcgatggaagacgatgatgtccatcagtagtggtagcggtataaaccagacgtagagacgatggcactagtaagcagcagacgagacgaccggcgatgacgacgataaggccaatcaacactggcagaatcatgcagccatggaagtgaataaactagtcggcagcagacgtagacagcttgcgttgaagatgatgacgtctattagcggtgacggcgacgtagccagctgtgaagaagatagcatcagttggcgtcataacaggccagctgtgcaggcggaaacaccagtcggcgggggacgaggtggccggtcggtgaagacgtagacgcctaacatcggcggcataataggccagccgtgcaggcggaaacaccagtcggcggcggacgaggtggccggtcggtgaagacgtagacgcccaacaacggcggcataataggccagccgtgcaggcgaaaacacgagtcggcggcgacgaaggcaagccggtcggtgaaaacgtagacgcccaacaacggcggcataataggccagccctgcaggcggagacaccagtcggcggcggcgaaggcaagccggtcggtgaagacgtagacgcccaacaatggtggtgtgaccaaacaaccgtataggcgaagacaccagtcggcggcgatgacgacaagccggtggtgatgttctgactgatccattcctggagcgtaagagataagcttaaagccatgaatcccttttgtgcatatctggatctggatcctgcagaacaaacatataggatgagtagtatctgatgtaaatataatcctcgagaaaatttcaagtattttaaaatgtttataaatatgtatttatcctcttgtcaattttgatttccccgagcagatgacttattacgtttaaacgctctgtccgactagtcatagcccccaagcaccgggagtcagcctaggcacttcccaaacatgcatatgagtgacatgagttcgtcattcatggaacaaagtttcacgaatcagaatttactactcgggtacttttgcaattgtgaagagcagaaaataaatttatcttatctctatgcttttgatttattccgaataatacttagcaccttgcgttactcggtccatccaacgagcccccggtgctagcaattggcccaaaggcaactatccattggcgaaccaaacggaaagcataggaagatggaactccataactcgataggtacttttgtactcagattatgtcgcaagcaatcaagataaatattatgaaaaatatgatataacatctgtagcccctgactcactactcaatggaggaccaattggtgtagtgaggcagaggaaaaggaaaatatcatataaagaaaaaaattaatgatgacttagctttttaatattcccttggtgatggcagaagtagccgatgtggaaacaaagccgtccatcaatggcaatgaaaacaccagccatagaagcagcttgaggtgactgacgatgaaagtgaagatgcccatcaacggcggcatgataggccagccgtctaagcagaaacaccagtcggcgacggcgaaggcaggccggcggtgaggtcgtagatgctcgacaacggcggcataataggccagccgtgcaggcggagacaccagtcggcggcggcgaaggccagccgatcggtgaagacgtggacgcccatgaacggtggtgtgaccaaccaaccgtataggcgaggacaccagtcggcggcgacggaggtaggccggcggtgaggacgtagacgcccaacagcggcggcataataggccagccgtgcaggcggaaacaccagtcggcgacagcgaaggccagccggtcggtgaagacgtggatgcccataaacggtggtgtgaccaaccaaccgtataggcgagaacaccaattaacggcgacgaagacagttgacagtgaagatgacgatgcccatcagcaacggccaatggagaggcgcagcccggtcagcgtgagccgtacagggacgatagtcgggctcggcagcgtggaagcagccaatcgcgaacttgttgagacggtcgacagtgtcagcggatgtagccaaccatgcaggcgaagatgcccggcaatagtgagtgcggctaacgcgcggacatatcaagtcgatactctgcggcacggcgacggcctgaccaccacggcatctcagtagcacatgcaaccaaacaaataattaaattgatcagcagcagcaaggaattaattaaagataaatgcacaaatatcacgtgagatgtgattggttgctggcttgatgggcatgcatgttgccgatgcatggtcctgtgcatgctggtgatcacgtgtcatcgtatcatttgtcggccatgttgccattcacagccttgttgaatttggttgttgatgatgtcgccggtggcgaagacgatgcaacccgcccgactagttgacgatgacggcgcggccgcgcgggcacaggcccgtgcacaagtctggcagcagccggtcagtcctcgccgactttgaagcggcggaggaacagatccgcggctccggaaggacggcggggagggaggcgacgtagtcgtcggagcggaggaggcggaggtcgcagcagcgcgcaggcggcgtagctgcgtgcgcggtaccggcgtcgtcggtgtccatcagctgcagccatctcctatgcatgccgattagatcggttttgtcatgccttgtgattgtagatccatcttgcagcatcatggcatcttcgttggggtagattgattggttcattaggcttggtggtggacgaccatctgattcgtcggatcgtcgttgccatcgtgccgatacgaacaggatcaggcggagaacagcaacggcgaccggtcttagggtttggccatgatgctccttagttagattgaatctctcccgactggtttgaatccaagtcagagaacgagagcttgttaaaactgtcggtgataaggaagcaaaactcctgaagcgaagtgaagacgaagccgacgactcatgaagttgattccatcgcactagtcaataggaaactcggcgtcacccctacctggcgcgccaactgtcgaaacatgaattcggcaataataaaagggggtagcgcacgagacctaaaagtggatggatgcggagacaaagatttagacaggttcaggccctctcaatgagaggtaataccctactcctgtttggggatttgaatccgccaggtgtagtatagatctgtcgatcatatgtgctcatgcccccgagagggcctcctgcccaccttatataggatggggggcaggattacaagatagaaaccttaaccaatacggtatcggttttctaaatctactttacaatcctatcaaaccaggactttaggccgttccataatatacagggaaacgtaatacccaaatcacgatacgttacatatttcatagatataagttatcccctataactagtcggataaccacaccgtgtgggtatggggtacccataatctctacaatatgtgatgatgagatgtgtcatgactcgcagattcacaatttttgcagaacatttgctctttttctcttaattaacaatttgctgaacaatctgctattttgcagctgctccaactagtccattatggcagaaagtggagagaaaattttgaaggcccgatgaacatgagtagagcaacacaaataagttcaatgaattcatagtactaactacaccccaaggcctgatgaacatagagcaccccatatgctagtcctctccactcatctgttatcctttttttatgtcctaacagatatagataattacaattatgcgatgctcttttcacaaagagggcagctaccgcacgggattccgttgcaacgtagctgccacgggataagatctccactaccttatctccttcctttcccctccacaaactctctctctctcacaggagaagaaaacgagaggcggagatgaagctggccaggaggaaggggtcgtcgtcgtctccggcggccgtggacgacgacggcacggcgtcggcgaggtcggggcggcgtcgagggtgatctcgccgcacctccacgacgtcgtcctccgcccgctgcggtgccgcctccacgcgctgtggcgctgcttcttccactggcgctctcgttgctgccggcaccggggcctctcccctcctccctcgcgctcctcgccaaggtcgccgtcgtccttgcccgctgctcccgccgcctccttgccagtgagcgcaggtggcaactcctccgccgccacagaagcagaggaagccggtggtctcctcctctccatcctgatacttggtaccttgggtatcaggtacctggtacctctggtaccgtctgatacatttggtacctggtaccaggctagtacctaaaatctagtaatgtgatacctggtacctggtacctggtaccctggtgcctggtacctggtacccgtgatatctggtatttgatacccgtaatacctggtacctagtatcctggtacctggtacccgtgatacatggtacctgatacccgtgatacctggtaccagtagcctggagcaggaggagagagaggaggaggcatccgcgtggtggagcaggagaacgaggcggtgcgcgaatccggtgatcggcgaggcgaagcgtggaggaggcagtggcgaatccggtggtcggcgaggcggggcagccgatgagaagaccgacaagggcggggagccagagcggcgcggcaagggaggcgagcttgagggcgacccttgccgaggccgcgccgtcgtcgtcctcctcggcggccggggtcctgagccagcggcggcttccccggcgccggcagcggcctccacgcccccgctcccgctctccctcttgttcaccgcacctgtcgccattctcctcgtcgtcgccgcctcccccgcagcggtggccgccggctccgacgagcggtggggcgacggcgacagggacgacggcggccaccggctccgacgagcgatggggcgacagcgacggggacggggacgacggtggctgttggctccaatgatttaggggagaagagtgaggtaggaggaggggatcgatccggattactatcccgtctccacgggatgccgtggaatagattttctatttcgcaaaaccaatttttacgtgcgaatattcatgatgtagattgagttacgccctcctcggagatggaataaatgttccggatcaagtgaggaaagcagtgggcgtgaagaccccttggtcgagacttgcaggtgtgacaagatcaacaaaccgctcaaggcaatgaaggcatgaatagcaagcaacaatgtgcctctgctctgtctagggatgcaagccgcgtgggcaagcggtttttttttcccacttattccacttctagttcattttttcttctaaattttgtactaccatgcgggaaatagactagcaagctggtttttatgcgggtagcggaactatccacttgcatccctagctctgtcccctctacatgacggtgtctggatcttgaggtcactaaaattgcagagtcctggaaccacatgaaggacaccttggtcatcctgacttcaacggacataacccatttcagtggttatacaagagcagcaactctcaatctgccatctgtgattccaataggaccaagaaacactcaagaaaacattaagcagcttctcgcaggtacacggagccagagtttagcaatcccggtgcctcctcctctactgaacctccatgctgccatgcatgtacagctgagattgcatttgacagcagagatcgatcctcaatgtgccatttgacagcagagatcgatcctcaatgtgctcaaattatcgtgatgtgatttggtcaaagcaagacacatgagatttgttgttggatcacagtacagatatatagagaggcgcattatactctacagtactacttatcaaggagagattgtagtgctgttttgttggatcattaagtcacaacacaagttaactgatccaagcaaccgtttctagactgaagaataggaggttgggatgattttgcctactgtttctagtcctatttgagagagttaatgtaacaagcacggtggtatcaatttcaataggtgtagttgcatagatattccatataaataggcatatgaaactacaccacaatatgaacttactaagtctaacactgacatttttacttttctgatgagtcatgttgtttacaatatgtatatttttactacttaacttttagagctcactactagaaaaatgatctttgctgggtcgacccaaaaccacaatagtcccggttccaaaaagaaccgggactaaaaaagatctttagccccggttgaaaaccgcacagccattatatgatctttaatcccggttgttgttaccaaccgggactaaagatggtctttagtcccggttttcattccgtgtaagaggcatgtcagggggcgataccaaccgggagtaaagatcgccacattgtatataatccctatcccttatcctctcctccacaatcgcaaccactcagatcctcccctcccctcccctcctcctctcccctggagacggacgccctcctcccctcccctctcctccccttcctcctccctcccctggagacggaggccctccttcctcctccgtttccaggcctccccttcctcctcccctcccctccccttcctcctccctcccctgaagacggaggccgcgcgccgcgcggacgcgtggtggatggacgggcacgtgacgtgcggttgcacggcacgcgcggtagtagtggcgccgtgattggagcttgttttttctcttttttttatatattttgtgattcactaatatgtataattttgtgattgattgtatgggtctgagatgtataatctgtgatgtatttgatttgtgtgtaatttttttaggatttgtgatgtatttgatttgtgtatattagtaactttaagatttgtgatgtggattgggatgttactttgatttggggatttggggtttgatttgggatgtgcatgctacccgattcgggagaaaataaaaaagaaaaaaataagaaaagggaccatctagattgccgctatcccctctttagtcccggttggtgttaccaaccgggactaaagatctttctctttaatcccggtttttgctaccaaccgggactaaagatccatctttagtcccggttacttcaactggaactaaagatgggcatctttagtcccggattcctactcccggttggaaacccgagactaaagggggttatcaaccgggagtaaaaaaggtttctccaccagtggctcttttcccatccttgataaggtaccatgaggtaccaggtactatgaggtacaaatcaaatctagccattgatttggcaggggtacgatcggaataaatttgttaagagattgtatgtgctaattgggccttcaggtaggggtgggcgttcggtctgaccgaaaaattcggtctcggtcttcggtctttcggtcagttcggtctttgaaaacttaggaccgaatttcatccaaataaactctggaccggtaaattcggtctcggttttttcggtctcggtctcggtctaaccgaattcgctggagacttggattgcgcaggtgggcagcgagagctggtggcgactggcgaggccgcggctacggctgccgcaacggcgaaggccacgccgccgctcgccaggcgcaccgcggacggcggcgctcatcggggccgcggcggaggcggcgccgaggcggacggcggcgctcgtcgtggccgcggcggaggctggaggcggacggcgacgctcgtcgtggccacggcggaggctggaggcggacggcaacgctcgtcggggatgcggcagaggcgagaggcggcgccgaggtggacggtggcgctcgtcgggaccgcggcgaaggggggaggcggcgctcgtcggggctgtggcggaggctggaggcggcgccgaggcgggcggcggcgctcgtcgggactcgggacggcggcgggggcgtgaggcggcgctggtagtggttaggtgctgaggtagtgggactgttggagtgggagtggggaattctagggttttgcaatttgttgggcttattgggcctcctaagcttattgggcctcaattcggttttctcggttaattcggttaaccgagcccaataaccgaaatgaccgaaataaattcggtcttttgatggctgggaccgaactactaaccgaatttctcgatttcggtcttttcggtttcggtctcggttttttcggttcggttcttcggttcggtcttattttgcccacccctaccttcaggtcggcaccgcgcaagcaccaatagctagacagattggaaaagagctcgatcggcgcaatctcttccccgcgactcatca

SEQ ID NO: 66768 - DNA, 2663 bp, Oryza sativa
  unsure (1)..(2663): unsure at all n locations
gagacgagcaactcaattattgcttaaactatcggaggagggcttccccccggcttccgggcggccaaagcaaaagatgcttccttcacttcaacaacggactgggatagccgcggaatcgaccttccacaaggccgggatgggaaaatacggcttcttcaatcccaaccaacgggacacctgggtgcggttttttttaatttaaatcatcatcatcatcttcttcttcttcttcttcttcttgtggtggtggttgttgttgttgttgttgtggttgttgttgttgttgttgttgttgttgttgttgttgttgatttgaggtgtttggtttgagaatgtgggctctaatggtggtttcttgtttcttgatttttgtttgttggtgcagcagcagtggagtgcctcttcgagaccctccgctgcctccccggtggctgcgagcgcggcgcctccacctgcatctcctgtagctggttcatcatggaggacgacgaactgtcagccagtgtgccccttttgtgaatgatatgatattgttgtatgataaattcttgccatcccctttgtgaatgattgctatatgagatggtgatgcggtgatggaggataatgaactgttggtcagtttgaagtttttgtgatgtggtcagtttgaagtttttgtgatgctgtcagtttgatgatagcaagcaccaccattgtagggttttttcacacctgtgacgggttgcaatctatttttctttttttttgctggattgtagacatcactgacagctcacaaattaatgggccgtttgagataatagttacctgtgacgggttctatacgtggcccgtcataggggctggtcaccactgacggcctttcacccgtcaaaggtgaagagagttatcactgaccactgatctctgacgaggggccgaatccgtcagaggtgatggtttagacccgtcacagctagcatgggccggcatagtggaacggcatcccgacgtggaactcctcgacgtggagggcgctctccaggccacgcacgtcgcgggcgagctcccggagcgggcggacggcgccggcgccggcgcccctcagcgcggccgccgcatccccggactcgtgccggaacctctcgcgctgcgcggcggggctgaagtccgtggcctcgtactcgaggagctcctcaaggctcgggaaccacgtcggcatctcgcccctgagctccgcggtctcctcgtcgctcatccccgcccacgacgccgacctctgatccgctcccacgccggagcagctgcgctccacgcgcgcgcgggacgaacgcagtaggggaggatgaggacgcggcggcggcggcgtgcgggtggcgaggacacgggcgcacggcggcggcggcggtggcggccggccggaggaggaacgcggcgtgcggcggctgtcgcaagagatgttcaccgngcgcccgccatgatcgatcgatcaacgtgtgtgcgtggttgaccgatggatcggattcgttctgaccgatgaattcacctgacaccgtatatatatatcaagatgcagcgttcaggattccattatctaaccgtgtatcaaatcgaccccgagcagaagtaacttcataattattagagttgtttggcaactacaacttgatgaaacatcatatggggtcgtgggtgttcaaatcctaatgcttatacatattgcgcaagaaaacgggtggacgtccacccgagatattaggatccatctcctcttctttgaagttgtgggtgttcaaatcctaatgcttatacatattgcgcaagaaaacgggtggacatccacccgagagattaggatccatctcctcttctttggctttgttctccaaacgctgataggttatcatctagcttcctaaaaacagtctgaatttctgccaggccattttaaggcgtctttcgggcaacataatgtataattgcatataagcagtcgtattcttttagccaaaaatatacagtaataaggggtgatacatcatgaaggcaaatcagcatcagacatgagaactatggatgttcatatcctatccaaccttacctgtgaaccaacgcacccttagtatatttcactgacactcgatccctcttgtctactcgctatgcaaccctcctctcgctggtggtgtccacaataccatggtgttttcagcttttttgaaggcgttggcgagtggcaacattgttggtttggtcacgtttagtgacacatagcggcaatcggtgcagttctagccctttggtgtgtggtggtatgttttttcacttttgatttcgctaaaaattttggccattttggtagacccaaaattttgacgcttttttggaccatctttttaaaaaagaattaacatactttaattgaatttgactaaatgttgaccaaactcacaaaaaatggagaaaaaccgaaaatttcagacgagataataacttggggtggggggggggggtccaaagtttcgaactgaaaatgcaatcattgacaggggggtgttttttttttctgattataggctttcaaagttataggcttttttttttccatatcaatatgaaacatcgtgcactgtttgatcttggtcggtttaaaaaaaaaaatatttcacctgcataaa

SEQ ID NO: 66769 - DNA, 913 bp, Oryza sativa
  unsure (1)..(913): unsure at all n locations
tagtttcaatgagttgaaccaaattaggattctagttcgtgagcttaacgagacagctgctcgtttatctcgttagtccaacatattatcattaactaatatttagttccttaattacattgaaactatttatatgtttatataataaattttaccggcacttgccggttaattggattatagcattataatttatccgatcttaaaatatgtcattcaaattcgcgatattcaagttgtgccattaaaattttatgggtatttgagatatactactgcttaccccttcgatgcatttctcaaattttttttaccaaattaataagggtcaattggatccatggcaatataaatttgtccgttttaaaagttatcattacaacttgcgaaattagagccataccattaaacaatagtaagtatttaagatgagtgtgaacatgccaaggccatacctaggcgttgagataactcaccccagcgctaacctcgttggtgccgaccctagaaccatgttgtttcaccgagctgatgatgccacgggagagaggggtttggggggggggggtggttttggtgctattgtttggcgccaagttggtcttggtcggctgctatttttgtggatgcaaatgtggtgctaccataaaaatcacagccgaacaaccccgaaaagattgagggcctcatcttttcgcttatgcttatacttatcagtcaaaatttgaattttcaaccttaaatttaaagctgattttgaggtttttcatcgaagtttatttttagcatttgcttttaaatagctaagaacatgtatataaaattttattcacaaattagttttcgtttgcaaatatgccgagatggcaaaatatnntgtggngtngtgctncagtgtgtactattgccacat

SEQ ID NO: 66770 - DNA, 1424 bp, Oryza sativa
  unsure (1)..(1424): unsure at all n locations
cgctgcggatttgttagactaactcgattgactacaggcgcgaattcttctttgtacccctatcagcgccagcattctcctatcagtctataactagcgaccatggccatgtttggatctgaaaacatggcagcctgagctttctgtgcttcctctttcgggacatgaagcaatccgttttcctacagcgtactcaagaaaggtcaaaataacacccaaaagataatactcgattcgttagtggagtaatgcatgttagtatcaaatcaaaacattcagcaggcacgaagtccatcctgagatttcttcaatgcagattacaacatatactgatgatgtacagtctctaataactacaaaaaggctagcctttacaaatccttacttaattgggacagtacactcagatgcttcaagttgaattacctcgttagtgtaataaaccttgcgtgatttgaaggccttggccgggatgtactgcgaattgatcctcaggttcctcgccctaattaccacttgcctgtgaacaagcaaaaaccctcgcatcaacatccaaacatgaacaacatctgaacatgaaaaaaaacagacgcaatacagcacgcgacacgctcgtagaggctaaaattctaggaaaatccagcaacggggaggccttcggatctaggtctcgcggcgtcagatcgagcgaaatcggcgagcaaaaacagatcgcggcaggatcgagagttggaaaagcaacgaaccccttcttgacgagcttggggtcgggggagggcgacgccgacggggagcgcatcagcttggcgacgaagtagcggagcacgccgatgagcaccatcaccacggagagcgggacgaggacccagtcccggatcgccgtgtccagcaccagctcctccgccatcgcagccggcggcaaaggcctctcacgctaaggctaacccccccacctactagctgcggactgcgcggcggagggcggcggcgacccgggcgacgccgacggcgagaggagatcggggtagagagagatcgccgccgcgggtggattgggccgatgcggaagaggacgcgacgcgaggatattcctagccaacccgcctggttattgggtaatgggtcgggtcgggccgggttcttctcaccttttgggctccgctggaggaggaggcccattaggtttggatattgggccgagttggattttttttcttggaataagttccccggaggtccccctcaatttaacagagagattttttgaggtcccttaaccacaaaaccagaaacgtctacccctaaacttactcaaaccattcaccggaggtcccttgacagtatttttgcccggttttgctgacgtggcatcctagtcaacaaaaaaaaatannaaagtagggtaggagtgttctaccgccagg

SEQ ID NO: 66771 - DNA, 1434 bp, Oryza sativa
caagaatccagtgactgccataaaaatagatagttcatgcatgaacagcataatggttttaacgggcatccattgacagatagttcatccacataatcaggtcttaactagcacataataagttctaactggtaagaacaagcacataataaggtcttaactagcattacatcatacgaatttggatggcactacaaatattgccagacaaaatggtgatgttcatccatcacactacttgagaacatggatcttcagatcaagaacgtcgtcatcgttgttgaaatggaaaatacaaacatcaccctcattgaatacttcgacatcaatcagttgattccatccggtggtggtcagtaatgccctatcgttctgggacttcttcaacctcatctgatataactgtgttattccagcctcgtcctgttccaagcactgcacgccgggggagcgcgccgtcgccgtcccccagctctaccgcctgcagccgcgcaacgggctgcagcgccgtgtcagcagggggcggctcggagcgcgccgttccaccgctgcccaccgccgaccatcgccgcccgccgccgccgaccaccgttgcctgccgccgccgaccaccgccgcccaacgcctatcgcctcgaaggggaccacgagcggatggagggatgtatggatctgagcgccatccctccatcccctgcgctagttcagccgcccacggcatggctactccctattgtgtgcgccaaagcttcggagagatcggggagaaggaaacagaaccgagagaaggaacaaagagaccccttctccctcgctacgcgaaattacaattttaccccctccccaccagcggtactgcatcaagcagggtgtgcggtaccatccaatctcagccatccgatgagggcatatcaacggtcaggatttggtaccgcccaccctcaaggacagtaaaaaatctctaacttttatgaatagcagaacaattaagaccattcaccctagcacatctagctactgtttagcaaggtaatcaggactacttacagctagtttgttgctcacaagaatgtgagttccctatgcctccctttcctaataggcatcctgtgcgcaattaccttctaagttacctatagtagtcttcaaggtgagaggtgaggaccgaatatttgatcttccagcaatttaacttggtggtgtaaaaagaataggatgattggggtttgttttgtgcgttgctcgacaacgaggacatgaaggtttcgattatatatccatcttgaaacggatcttctgacttgggctgtgtttagttgaggagaaagtttggattttggttgaaattaaagatgatgtgactgaaaagttgtgtgtgtatgacaagttgatgtgatggaaaatgactgaagtttggatccaaattttggatcta

SEQ ID NO: 66772 - DNA, 701 bp, Oryza sativa
ggcaatcatacgccgttcgatgaataccctcaaataaccgaagcggtgtgggaggaattctgctctttcaagaccacccaagagtttagggaatcaagcgaggcacatcgtgtactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcgctacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagaaggacgctcgtttgaaggccgaacttaaggttgaggccattcaagaactagaagctagcatgaatgcaagggtgga

SEQ ID NO: 66773 - DNA, 1616 bp, Oryza sativa
ccataattattgtgagaggtgtgagactaatcacgaaaaacattgcttaacccgcccataaccgcgggcacggctattcgaatagttttactctggccagaggtgtaccactgtacccacaagacacagcctcaacatcttgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaaagccgtgcccacgctggcttgtggttggcacggttaatgtttcacaatagtagctcgcgaaccggtccttaattgtcatgagcacgactcttaaaaccattatcaagttttagttggcaagtaattaattaaccaatcacgattgaccatcgtgaactatctttaaaccatcattaagtaataatgagtcataagttatcccaataatgtgctaatgtttctaagcatggctaagcaatcatatctaatatctagctgaaccaatatataaagctcaactagtcaagttataataacccaaggtatcaaagaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttctgaacactcccgacgcactcacgaaccttcgcaacgacggaaacgacaagctaacacgcaaaacgaagaaaaaaacttattaaaaccaaattaacagttcatataaagtaaacaaacatgtagatcataattttagatgaattatgagacttgacgggcctcattctgacttcatatgaatttattatgaatttacaagattaaatctaattaaagcccacttaaaaagaattaaataaatttaattctatttatggataactttaatatgtagatctttattttataaaacttttgcaacttgaaccacattaaactgagttacaaagaattagttatgaattttcaaagattaaatcggattaaagcatttatatagattttaattgaattatgacgcaataatgaattatttttgaaaaggaaaaggaggattattgcgtcagcgggtcgggttcacggtggaccgggtgcacggctgcggtctatggatcgggcggccgagatctaccctatccacaaagaacggccgagatctaaacggtctacgatcggtctaaggcagacggcaacgatgacgtcagcgatgacgtcatcaccggcgatggcttgggcggcgtatgctcgccggcgaatgacggcgcgacgacgcaaacggaggacaccaatgggtagagggcgacgcggcgaactcaccgagctcttggacgacgacaaacgacgacggatgacgaccgcggcgaggttgaagcggcggcggtcttcgggtcg

SEQ ID NO: 66774 - DNA, 3009 bp, Oryza sativa
caaattattactaggtataacatccataattattgtgagaggtgtgagactaatcacgaaaaacattgcttaacccgcccataaccgcgggcacggctattcgaatagttttactctggccagaggtgtaccactgtacccacaagacacagcctcaacatcttgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatctttaaaccatcattaagtaataatgagtcataagttatcccaataatgtgctaatgtttctaagcatggctaagcaatcatatctaatatctagctgaaccaatatataaagctcaactagtcaagttataataacacaaggtatcaaggaataaagtaatcaatgcaaacaggccataacaaaagaatagattcacaccacccagtgacattcgaaaataaatgcacagttgaaataaataaagaatttaaatataggatcaacatgctcaaaggattgtgtttaggatatgtgtgacttgccttgcaatattcggtcttcaattaatcttcttgaacacttctgacgcactcgcgaaccttcaaaacgatgggaacgacaagctaacacgcaaaacgaggaaaaaggataataaaaaccaaataaacaatacatataaagtaaacaaacatgtagatcataattttagatgaattatgagacttgaacggcctcattctgacttcatatgaatttattatgaattttacaagattaaatctaattaaagcccacttaaaaagaattaaataaatttaattctatttatggataactttaatatgtagatctttattttataaaacttttgcaacttgaaccacattaaactgagttacaaagaattagttatgaattttcaaagattaaatcggattaaagcatttatatagattttaattgaattatgacgcaataatgaattatttttgaaaaggaaaaggaggattattgcgtcagcgggtcgggttcacggtggaccgggtgcacggctgcggtctatggatcgggcggccgagatctaccctatccacaaagaacggccgagatctaaacggtctacgatcggtataaggcagacggcaacgatgacgtcagcgatgacgtcatcaccggcgacggcttgggcggcgcatgctcgccggcgaacgacggcgcgacgacgcaaacagaggacaccaacgggtagagggcgacgcggcgaactcaccgagctcttggacgacgacaaacgacgacggatgacgacggcggcgaggttgaagcggcggcggtcttcgggtcgacggtgacggcggtgctccggcgtgctacagcggcggcgaagcggtggagggggacggcgacgacctcgtgatcccgatggtggcgacggcgaccgacgacggcggctgcaacggcggcgcggcgcggctgaaccgacggcaacgacggcgacggctagggctacgcggaggcggcgctagacgcgacggtgggctaaggcaaaggtggcggcggatagaggagagctcgggggtgcttttatagtggctaggaggcggcgacggaggcccacggcgaccggcggcgagaaggaaagtctagggttagaggagagagatgaatccgaatccaactcaaatcctccggtttccaaagaaaattagccgatgtttccaaaagagaaaaggaagaggagatctcaaggatcatttgccctcaatcaatttgaccggaaatagagaggggcgacggaatttggaagggcagcggcggcggcgcggcttggctagggttcggccgggcggctcgaggaggacgacgaccccgacaggtgggtcccgcctgtcagcggctgagagagaggagggaggcacgcggcggactgggccgactgggccggggagggagagagaaatagagaggttttgggccggctttcggcccaaagccaaaagagacttttaaaaacctttttcgatttaaattattcaagaaatgcgattccatttattaaaaatactttcttggctcaaataaatcccagaaaaatctaggaactaaagattcaagagaagtatttaacaaaattttatctaccccaattttatattgagatttagcaaattaaaattagatcttctcttttaggcttttaagatcatttctaataattccttttaaacaacaatttaaggtttttaaacaagaaaagcttttaacaattataattagatcattaattgattaactaattactgaactgttttttgtatcatttaggaattgagctccgaaaaatccgagaatattccagagagtataattaaccatggagaatttaataaaaattaaatccatccatgctttatatttaggaaattttatttcccacatttaacttcacttgaaaattaaagaacatttaatataaattctaataataatttattaaataatttataaatcctgaaacaaaaatcaggatgtgacaatacccttatgaaacaatatgctcttgagttggttagttcactctctccataatatgtaatagtcttccgttcctgttttagtaactaactatatttgaataatgacaagatatcgatagtatacatgagagcaactaaaagaggtttgttcatcttgg

SEQ ID NO: 66775 - DNA, 90831 bp, Oryza sativa
  unsure (1)..(90831): unsure at all n locations
caacatttcaaagaagtaaagtaactgtcgctgatgtgtgcttcctttcttggcctgaattgtgaaggtgcatggctgagtatcttcctaacttggaagaaaatcttaaaatccaggtactatagctttaagttttgcatgtaactgttggtcttgactgcctgctcttattgttgatagtattactactttacatcgtagtgtagttgtcatgttaatggaatgactaatcatcctttgaaaaatagtgtgcggaaaataagtgaggattgaggaataaaagaaaaggatagacagtagatctgatgctattgttgaattgtttaggtgattcaagcaagaaaaaatttcctgtatttcaatcttattatttagtggaagtacctttatgcataaaatgtacatcctttcccattattttaagcatactagacttactggaaactagctactactgaatcatttatcagttagatgaggtattgctaaaggtagcatggcatagcattaatcgtgcaactcgtgtctgttatacaaaacttatgtttctaatctataccgaaggttgtggaagcatcagcttcaattggttctagaagacgtttcattgaagcattggctcctacttttggaaggccattagaggctgatccggtacttgtttgccattgttttcgtatgttattgtctgctttgccaaattgtctaccaacctgtccacacttcagattttttgcagaaaagctacgattctttccatctcagggattttcacttttctggtatgtcataaaatttgtgaatctagtgctttctctgtttttccattacatgactgctatctgttttccaatctgaccagcgatctgatacagctttagaactgtaatgaaaaagtactagtggaatatgactttaattttctaccagttagtatattactaacaatatatatcatgtaactgctgcaggtccactttgtcattcccctccaattccctaagcatcaacctgtgctgacattagagagttctcaggtatttatttggtttgtcactgcttattgctagttgtaacttacatgctcaatagaggtcttgttgttgatatcagcatttagagctgggtagtcagtagaagtgaacaaggatgatacctatagcccatctacccaaacaaaacacacagaaacacagacacatcgtttttcttttttggagatcctatggggaggcaaaaatgagaccaacagctgttatactattccatttcatttcaccccttccaattcacctctctaatggatggaccattttcttcctgaaaatgataaaaaagtaaacatgcaagactatgatgtgttaaccttcttttgttattgattgacttgtagtgttgatttagcatctactggctagagagggcaggtgttgcccttgtaagttactctgtatgttaaattgttctttcaaggtgtggggaaataaccttttttgtggtgaatcctccgcagcacttcaatgcccaggggttacctatcatgtcagctccagtaaatgactatccctggagccctagatgggatccaacagaaatggttgaacgcatctagtaagtttctagttctcctatattgcatctacagaagttttcatgagtccaatttgctgatttgtgccaaaatttgcagtgactttttggttgacgagtgccaaactttcaagaagttttgcagcgattctatccctcaacagaagtagctgataaggtgattttatcaagaaagaacttcttgctactgttaacccatgttcctttcactgattgcataactataaccacagaccgttttttctcatatggtgtatcaggaagcatctctgttactgccggcttgctcggtctgctcgcaagttgcaacctgtattccccaacctggcaagtaaatttgtaagctcaagaagaagcctagtcaggcagtagaatccataagatttggataggtgcgcttctgtttgacaagtaaattgtgtacactagagcaaagctgggcatatgttttgttggttaaccccattgctgctggtcctagactcctaccttgtgattgctgggataaatggcaacccaattgctcctgccatgtacatacagataccgcacgtttaccaccggccgtttctttcactgtaaagtttgatgcaagtgacctctggctgctatggtttactgtacttaatgatttactagtactacattcatttcggatggtgaactggcaacttggtcgccccgttagaatgttcgttttggcgtttagccgcttgccttacgagtgaaaacagtcgatcactattaacttcttccttgattcgagtagtatttaatttgctcatcagttctgacttctgagctcgaatttttccctctgcccgagttgctctctcttgttattttaatttgggttaattcgtcgccaagttgcgtttttttttttctattctactaaaatactagtagtagtatgtatgctccacttgtgctatgatttggttgtttatttgctttgtgggggtaagttgctgttgctgctaagaaggaagtgcagatgacgacatgtatatcctgcttgagaagcagaagcttggcttatttttattttgctaagctgtgttgctcgtcttccatgactctgatgctcttcttctcagtagcagtatccctcactgctacctccggtttcctttcctttttttttttgttccgtctattggtctttggctctctaatctgagttgattcttgatacagactaacagacatgagaggcaggttttgtgcactccttcagttaaagttttccgggtgtgggatttcttgatgatggattatggtttatggttctgtttcttcttcctgattttatatctataaaattactccctccatttcataatacaagagtaggtattataacagactattagccagctataaacatattttaatgagataaaagatgaaatagaagagcagtggactacggatctgtagccagctgtagcacgaactatgacatgcatgtatgccattaactatgacatattctaaattaaattactacctttttaaattcttctctcacattctctaactctattgaatgcatgcattatatttattaggatgatccaaattataatatgataataattatttctttgtgtcttatattttgaaatggggagagtaataaagaacagatgtaaaagcaaataaggcctaatgactgaacgtcaggacctgttaaaggcccattcaaaagctaatcagagcatcaggcccgtttacggcccaagaaggcggacgtttagttgcgcattaatgggcctaatgccgcgtggagtgacgtcaggacattaacggccagtgacatcatacatgatggacattctacacggcgattaacaagcagttccgtagtattggggatttgtcagatttgtaacacgaatatgttacatcccttcaaaatcacttacttctatatgagagagagtgagtataggacggacggagggagttctcaacgtcattagaaacggaaaattgaaagaacgcaggaaagagagatattacgggctggtttggtttgaggtctaaattggtcttaccaatatttagcaatttcaatagtgttaattgtttatttggtttggagccaaattttggcttgcctaaaaaaataggccatttcaacagttaatttaggctttggcttcaatataaacacaattttacctttgccaaaattagccatgccaaaagttactaaaatttaacattcacaaaaatttttaggcccctaaccaaaccagccctacaagccaagcctattacacagtgggtatatataactgcaacatactccaccagagggaaaacacacacacactcttcattccatagaagcagaagcagagcgtaccacgatacagacagaaaaccaaaaacaaaaacagcagagcgtgtatatgtatcattccagtattttctgagaaaatcccagagttgacactgcaagtatgcaactaataaaaatttatgtgattcagcatctctcagatcgaacttatgttattcggcatgtcacagatcaaataagatcagagatcacatccatagcatataccttgaacaaaactgtgtttttcaagaaaaaactttcatgtaaaagtacacaacaaggtcgaaatttggtgtcaacaaacatgtgcagcagccacgaaactacggtttaaaacacctccattttctcatctatcgtctgcaaaagttacttgtgaagggctaccctcaactgtctcattctagatcctgaaaatgattaactagagttcaagggcctccaatctatttcttcttcttggatttgcttccctgtgcaaatgcagtgccctgccacatcaatgaactcaaaagttaatcttctgcatggggctcacaataatcgatcaatatgatgttcggtgagcagcgaaacaaacctccagccactcatccatgttggcatcagtagttccagttcccagttccaccttgggggccttctttgttttctacagcacgcagaaatgattgatgagataaacgtacacagctcaaatgtccagctaacctgtatcgcaacaaattagaaacatacctttgagagctgttgtacttgaccatatgcccacaatccgaagagaccaagaagggcaactccaagggtaataaggaacacagactcaacgctgagtaaacctccagcctcaacaacctctacagtgccattgtaaaagacattctggtatgggttctgatcaatctcatacactatgtaaccaactagatcatatgctccaggctgcaaggagacaggcattaggacgtcatgaatgcaaaatgtacacaacttgatcttatagttaagattgtttcaatggttagcgttgtgaattaacaaacctgcaagaacttgctcacggcgaatgtatacggaaaggttgcttgtacagagacaggaactgatgcattgaagaagttctgcaaaaaaagaaaccacaaaataagcatagttatgaattagaacatagcattccaagaatgtgtgcttgactcaataaattgtgtgattcaacttcacttaaagacaaataacatataatactactgagaagcagaaatacagatatctaatgaaaacataacagaacaagatccgaacagttatttctcggtgttcaaagttaaaacaaaatacattatatctctagagcaggcaggattaaataaattatcaataaataggaaagtttgatggtgcacacatcaataggttaatttcagaagttcagctgttcaggtagtaaaaacaagaacgctcccacatttcctcacctgaacagtaaggttttgtccatacatcttatggtcaaaaggaagatggagagttgaatggatagcaacaacattcaaagttgattcacctgtaaacacaacatatgcaaagggtgtttgactctaagcaaactaagaacaaaacatttgaactagcatggtaaaaagaatattaaactattgaactcagaatctacattgccaaaacaagaaaaatttgctcgtttatgaaaatgtcatgtacggtaaactagtgatctctaacataaggttattccttattggacccacatattcttggcaacaaaagaacacactaatatggctatgcatctgctctgacgcatcaatttacatgatataggaaaatacatgaaagacacatttgcatcaaaggcagctgaaaaactagtgctattaagggacgtgaacatatgcatcttacaactcatattgcccatttggtgatctgttattagttaatcctatatagaaaacatggcagtttcaaccaacctagtacatattgaaacaatctcatgacctggatatgatacttaagccaaatggacatgaacttgcaataacttactacacagaaagcaaataactgagacaaatatgcatggcctgtttagatgaagtgcaaatctactggtcgatttaagataaatagagatagcccaagccaaacactaatcatagctaagtaactgaagtggcaaccgggaatatttcatgaaagaaacagcatgagttaccctcgttttgcaggccaaccagtagttcagtttcttcacctgctagcacaactacaataaaacaagaaaagggaaacattattgcttattgaagtcaacaaggatatgatgctgattttaaacaaaacatgtttccaaacatggcatgcaaatattaagaatagacaagatcctacagatatgcatagaatagaatcctatcagatgaacagaactagcaatttagtttagaatatttcatattaaacattaagggaaatgattgcaaatgaattacagtactagcgagtgaatttcaaataaatgattttgctgagattgtgatttgacactcacttttgccagcgtttttgggaaaaacacatactgtctccacaccaggagccggacttagaggcccatcgctggaaacttgtgtatcatcactgacgattcctagatcagccccatcaacaacttcagctgtagcagcttcttccatggactgagctctggcaactgcaggaaaattcagttcaaaggagcatagcagagaaaacagtaccattttcagccctagaacctcatcggtaaatttagaatatacgtcatcacttggttggctattctaaacagagattctgctaataatacatcccaattttccaattatgaaagagcttgtcggaggcttggagcagcatggtattctcaattttaaccaatcttaaatggcatggttccaaaattttacagtgttaaaaattaccatagaaacctatcctaccaatctaccatcgttaaccatacatgaaaaacccgtctcaatttcagaaagctccagcctcagatggctgcgttactttgataacaaatatgcaaacgcagaaacatttttatcatgaaaattgcacaccaacaaactcttcccaagacgtcgcgtctagaatcccgcccccacacaccgatctattcatataatacccacctaaacttgctccaaacatcaacctcctccggtgcaacaccacagagcccgatcggctcaattaccacacccgcggaggggcaaagcgcgcagatctaccgctgccccgccgcgaattatcgagatcggcgctcatctacgcggccccggatctacgcggcggggcgcggggcagagaagagaaagggagggacgaatcggtgcgcaacgagggtgtttaccttggacgacgggggcggcggcgaggaggaaggcgaggaggagggcggagagccaaaccctagtcgccgccatggctggctctggctcagatcggatcgggtcgaggcggaggaggaaggggtcgcgtgggttttgcgcggtggctgcgtgtggctcgcagtacaagtagtagtagtgaagccgtcgcctactacccttcaccaccacgaggtccacgacttgggtggggcgctgcgccgcgtgcccgcgtaggcttcagggtcgagtcgcagctgggtttgttactgtacatggattgtttgtttggcacattcaattacgatggtctcgtgatccgagctgtaaagcgtttataggattaatctcttcatccactgatccactgacagtggggtccacaaccgtataattagttgcaagatcacttcagcaaccagatgaaattgtagctggaaagatgcaaaatatacgcgacaactttcaccctgatggaaatgcagcgcaactagagcagattcgatgaattgcagctcatttttcagaggatttatggattcggacaaatgtgccctggtttttttttttacacaaattccaagttacaagaatacaaagatgtcaggtttacagtcccaacacatcacacctacattaaggtaaacaatttgtttgcagcagcagcaatcagagtgcctggaacggactcgccagcagttggcaccatccgttgtttcgccacatctatctggagctcttcttcttgttgcaacaatgcagtgacggtaattcgtaagtggcatcattgaacaagcgtaacagcttgtcatatgtactccctccgttccaaaaaaaaacaaaccctggtttccgtgtccaacgtttgaccgtccatcttatttgaaaaaattatgaaaaaaataaaaaagacaagtcacgcataaaatattaatcatgttttatcatctaacaataatgaaaatatgaattataaaaaaatttcatataagacggaccgttaaagttggacacgaaaacccagggtttgcctttttttttgggacggaggaagtatccagctagttgggacggctcagcgccatgaacttgcactgctcactcatcgcctgaagctgcgcttccttcttatcaatcatcgcacgcagcctcacattctcctccaccaccttctggacttcggcttctttttgtgctttctcactctcaagttggttggttcttgcaactagcctgttcacaagaacacaaaacttaataccaaattgattgtttggaatgaaaggattggataccacttgcttcaccaattcataaatcacccatgagtacgtacttatctaggcgattaacagaaggaacactataagtcaatgctatgttatgtttacgaatatgtagtttcatatgcgactgttagggaacttatttgaggtatcatgggttttacagcagccttctctgcatgattccaagaccatgaaaaatgattatatctgtatcaagtggaaaaaggagacaaaaagatgagcctacacagcatatgattttcccctcagccaagaatgtaattttctatgtttttaatcagtcatgggcatttccttaacattaggatgcgcatcactcaaatcagaaggtgaaggaactggaactacatgtttagaggacagcaagaaaaagtgttttggactaagtgctgaaatgcaaaccagtagaaaacatactgagacttagtcaattctatatccacaaaagcatgcatcattttgacaactgaacatccatacgaaattttggacatgatcaaaacacacaatttttctgcagttaaatgtgaagttggggaccaactcctagacttgatgattcgatttatactacactaacgtaacaccatatcagctgacaatagtctctatgatatcaaaaggtgacaaagtatttaaatactctagatgactcatttcaatgatatttagcatgattaaaagcaactatcaacaaatctgacaaaacactctttaccattgatcaacacagtggggataggtcatagttgttacaaaaaagaaggcttctggagatgcagtgtaaactctaatttataacagaatagatgtagctttgtgccttgaggataaaccatagagctctcctagtcaatgacagcccaacgttattaccaaaagaaaaacacttgaatgcgtgacatagtttatgtcaatcatatatgccagcaaaaaataggtttccatgctgtgttttaatgatactagtgtatatgcagtgtcacaaggaaagttcaaggcctgcagagcagttggtttcatgagctgatgagcatatcattaagcggctcgtgctttacaaaatgcattagaatatgaaatgttgtcttaacaattttctcagcagcatgtcctagcatgaaggtgttggcagcatcatcaatttacatgacgaatagggattacagtgcatgtgcaggatttattgtccaattaaactacagcagcatgccctaaaatgatgattttgctagcagcagtgtttacataatgacaggattgggaagatgaaagatatttttgcaaagctctgaaaaattaatataaagtttgcactcggaaatgaatcctgtacaacccacttcatacaaataatagttactaaaaatatcatgatacttgtgaagttacctgtcgaagagtttctccattgtttcaaactgcttctctgatgaaagaagagtttctctgacattaacgagagtgccgacataggttctgagagactcgaagtcatgcttcacacgactaagctcctgctcattttcagccgcacgttgcctttgtcgagtggtctccaacaccatgtcttcaaccctctgcctcatctcattcagcataccattcgtacccactgcaaatttctccatttcctcaactttggccgacatggactcaacctgtatggtcttcctcctaatctcttccagacccatcctcaccttctctttctcgttagcggcttccgattcagcaacaatcactctcttcacaagggtctccatgacatcggtcaccacatgtatcgacttcagaatgtcttcgacatctacatccccctcattggcatcgccatgttcggcaacacgactactatccgccgacgtttcatcatctaaaccctcgcaggaagcggactcgccgcccttggaccaatcagccagtggcaccccgttcctgtcgacgtaccccacgccatcctggtgcctaatcccgcaggacgtgtgcgcgaggtgcggtatcgccatgatcctggccttggatttgaggtaggccagcagcgtggcgatggtcttcaccctgcggcagaggtgatccagctccttcctcgagtcctcctcggagcacttcatcccgaccttgacctccacgagcctctcccgcagtgcgtcgacctgcgactgctgctgccgcagctcctccctccattcgctctccccctcctccgcgccactccgatcagcagcggcacgctccatgaaaccctacggaattcaaaccccccttaaaattgcatgtaaaatcggctagaaatggatctattcgtccccccaaattcgaccggataataaacgcgtaatcagacggatttgcgagcgagacggtggggatattggggagccatgtaccttcggtataggaggcaaggagcgcgtcgccggcggcgaactcccgctgcggcggcgctcctcgctttcttcgccgcgggttgggttgggttgggttgcgctctcgcgtcgcgtctcgcgaactagtcgctcgcctttcccctttcttcccccaacccaaactaatgaaatgaaatcattttgtttgcttacttatttcctaatccgatgattagattaggtgagtacgctaatggcaaaaagaaagattaataaatgcggacgcgctaaagcatccgtatgggccttgggcctcttctgggctttttttccaaaaaattgagcacatttgtaacacaaaaatcaaccattgtttttgtgcccgagaagcattgtaaggcagcacaacaatagcaactgtaaaagagaacgtcaatatttgtaggaagagtttttctcgtatccttgaagagatatatactttctcacaatttaagaggtaaaaactgtactaccagttgaactgattagaaaatatttaataaatgtgtagtcgagtggtaatgtaaagggtaggtgaagtaaagcatacccttggattccacttccccacgtacccaagttactggactatcaataatgagggcattatggctaccgacatctaaaaatgacatgcattaatttggcaaacagaaaatttaaacctgttttttttttctcaaaagtgttttggtttggtaatgtacgtctcctgaacaattgagatttgagagtcggtggttaaaactaaaccgtgagataaaccaaccggtgctttaattaattttgcacccccaatataagcaacaacgaactcctacgtggcggatggtcgagacggtcatggcgagcctctaactccccaccaactgccgcctctcgtcgcctcgcctcgccggcgccacctccgcattccgttccgaccagccgatcggtttcttcctcgccgttgcaaccttcgagcgcgatcgatcgaggcggttgaccgccgattcgccgcgcggcgttgcattgcacgcggctttccagttgataaatcaatcatcatccccttgatcgatgcgagtggcgttcttgttcgatcgagaggaggagatcgtgatcgcgagcgatccgggcggggcggcgcgccatcgatggcgaactgcgtgcggtgctgctgctggctcctggtgctgatgctcatggcgctcgcgatcaccgccgccgtggtgttcgtccgctacaagaacggcgagggggtcttccccttccccggcgtgcccggcgccgtcgaccacaagtacgccgacgcgctcgccgtcgccctccagttcttccaggtccagaaatgtaaggaattattctcaactttgcatgcattttttttttttgcgtttgatctcgatcatggaagttcttgatcgatgaagccgggaagctggtgaacaacacgatccactggagaggtgactcggcgctggacgacggcaaggaggccgggattgatctctccaaggggatgtacgacgccggcgaccacatgaagttcggattccccatggcgttcacggccaccatgctctcttggtccgtcctcgagtacggcgacgccatgcgcgccgccgaccagcgcgactccgccattgacgcgctgaattggatcatggattacctcgtcaatgcccacccctccgacgacgtcctctacatccaggtgatcatcatcaaatgatcgaataatctttatccaattcttgggaaatcaattaatttcttctggcattctgatctccaggtgggtgatcctaaagcagaccacaagtgctgggagcggccggagaagatgaaggagaagaggccactgaccaagatcacgcccaagtcccccggcagcgacgtggcggcggagacggcggcggccatggcggcggcgtcgctggtgtacaagacgatcaacaagacgtactcgtcgtcgctcctggaccacggcgagaggctgttcgccttcgccgacaagcaccggggatcctacacccggacgttcccggagctcagcgcgttctacaactccaccacgtaccaggacgagctcctctgggcggcgagctggctctaccacgccaccggcaaccacagctacctcgcctacgccaccggcaagaacaaggacttcgccgacctgggcaacccgagatacttcagctgggacgacaagcgcgccggaaccgaggtgggtgataatgaccgtgacaccgccactgattcaactccactgttcatggcaaattttgaaatcttgggatggttatgaagtgaatttttgtggtgttttgtttgagtttcaggttcttttgtcgagggtgagcttctttgcttcgcaaggatcagacgttgcacaagacgatgttcttgggatgtacaagcagactgctgatgccgtcatgtgcattctcctgccggattcagagaccgccgctttcagaacagaaggtaaatattcacaagattcagaagcaaaaataaaaaaagcaatctcaggttcaccatttgtgtagctggtaataataataatccagtagtatttcagatagcttgcaacgatttatttcaggtggtttgctgtacgttgccgagtggaactcactccagcacccggtggcatcggcgttcctcgccgcggtttacagcgactacatgcagagctccgggaagacggagctgagctgcagcgggcagggcttctcgccggccgacctgcgcaaattcgccaagtcccaggtagtaacaagattcagaatcatccatgaaccagagttcacaattgttcagactaacatatgttcagagagaacagaaatgttcagaaatacagtacgtaacttggatgtgatcacgcactgatcagtgatctttgttcttggcaggcggattacttgctaggcagcaacccgatgaagattagttacctagtcgggtacggcgaccggtacccggagaaggtgcaccaccgcggcgcgtccatcccggaggacgtcgacaccggctgcgacggccacaagtggctggagacgtccaagcccaacccaaacgtcgccaccggcgcgctcgtcggcggtccgtacaagaacgacagcttcgtcgacgagcgcgacaacgtgatgcagaacgaggccaccacctacaacagcgccctcgtcgccggcttgctctccgccctcgtctccacctcctccctcgcgcgatccttgtcatgatctgcattgctcggattctgacggtttaccactcattagatggcatgcaaatgctggctcaaactgatgaagaaatggtagggaggatgttgtatcatggatcgaagaagtcggtgatctgtatgtgaaaagggtaattagtactgtactagtacttatacttactaacaaaaataatcattagaaactacttttgtttgttcaattggtgctcattatactatcattgaactctgaatcattttagcacattcagttctctctgttacacttaagatgttacatatatcccaagttcaattgactgaagaaaaataaaaagaacgaagcatggttggaacctgcacggtgagatgagattaacaaggaattcagcatgcaggagttctcgcacccacacaattcccagcagaagatctgaactttctaactccgaattgtgcactgcaatttatacattctgattcctcgatcaatcttcgccagcacagcaacagtagtttacatcctctgcatcctcgaccaaatgatccacatttccttaatcatacgctacactaggtaactaagaacatgcaaaaagtgaagataaccagggaggaacacaacaatttcctggttaataattgtagcaagatagcaggaatactcacacccacaattcgcagcaaaatatctcaaacattttaactccaaaattgtgcagtgcaatttatacattctgattcctcgaccaatcttcgccaacacagcaacactagtttacatcctctgcttcctcgaccaaatgatccacattttccttaatcatctgctatacactaggtacctagaatctagtagagtactcgatctcgatggtaatcaagaacacgcccccggcgacgcgctcacggcgagccggcgaagacatcggtgggcgcgagcggcggcgcgtcgagctggtagaggccaatggaggggccgacgaagcggaagaggatccaggcgccgaccatgatgaagatggaggcgtaggcgaacttgttgagccagaagaggagccccttctccccgacgtacagctcgccggccttctccgccatgctcatctcctcccactccttcctcctcgtctgcttctccctgcgcgtcgccgccgaagccgaagccgacgccgacgacttcgacgcagccggcctcgacgacgacgacgacttggatttcatggtgatccccaacggcgccggcggagtgaactcctggacgcggcgagcttggttcctcgcgcggaggcggttcttgacgccggtgggcttggcgccggaggagggaggcgtggcggactgagcgtccgtcggagcatcggccgcggtgggggaggggtcgccggatgatgcccgggggatggatgggcggcggcgatggcggaggaggaggaggaggggttgggaggggcggtgggggaggagagggagcaggaggtgctccatggcgacgatggcgaggtgaggctctggaaggaagacgatggggtttgggtggcgcgggattttcaggacgggatgatcaactgcacgagctgtggaccgtccgatggtcaattcaacggttcggattaatccactggtatggaaaatcgtaacctattttatctgatgaataaaatactttttttttcaattccaaatactacaaactagaaagtaataaaggggatttgtcctattttcatttatttttatctttcttttttcttattttacaaacttatggttatattatatctcacgacacaacttgaaaatatattccatttccattattcaaaagttacaaactagacacccgtataatgcagacatgagcgcgtacttatcactgtaaactaatataggcaataatatgcttgtggtgacttcgttaattccaatatatactgggctagtctttcaaatgtactcatacggatagatgtgcgcgtgtgcgtttaaagcggagagtgtgcaggaaggatcaaaagatcgattttcatccttaggttaggttcttcgcgcgtgttaattgtcatatgacatgttctcagttccgcttgagaaagtttctcaaaatttttcctccggttttataattcttgatgttttatataaggttgaggtaaaacttaattctagctttaactggcaataactaatatttagttagaagcgctataataacatatattgttttgtcttaaaatataatactataataaaactataaatatatttattatatatattataaaaaatatagttaatgatatattttcaagacgttatcattatctaaaagataatatgaaagcattgcatgtggatgccacaattgtaaagacatggtttggtagcaagaagaaaaagcgaaatattgtttattcatctcaatgttatgctggtttcctcacctttaacatatactccatagtagtaagttatatcctcttttttatttggagtagtttgaactaggggaattatgtttctagagttctagtacctgattagtactaagtgattagttagtttagacacgatggtcagctaaaacagcagaatttccggggttgcttgatgtgatgttagctcatgctaggttggattggcaccttctaccgaccgtgcacgttcatcatctccaaaaaagaagaacacaaaatgtcaagtcaaccaagaccagatccattaccctcataaaggacacttataaaagagtgcaaacattttatcttggaccatgtgtaaatatatctttttaataactgttttacattctatttttcagaattgtgtaaatattcaccagctctgttgtttacttgcttcaccaacataccgcctgatatatcccgtgaaaacaaaaacggtaaaacggaaattcagaaaatctttcagggcgatttgattgatgctgaccatctcacctcaaccgtcggatgcagatcgtacggccgagagagagagagagagagaggatacgatgcatcagcaacaaaaaatggtcaagaaataattccagcatcaacgagctagatactagtggtagtagtaaagcgaaagcgaacaaaaaggggaaaaaaaaaagaaaaacaagagcgctgtgtcggagaccaccgccggaccaccaccgcgacccctcgatcccggcgatcccacagcattggtcggtccccgtcgatccggccgccgtggggtttggtctggtactctctggtggtggtggtggtggtcgccgtcgtgaacgattcctttttctgcttggattttttttgttgcttttggttgttgtgatccctgtggggctcgggttccggccggtgtaggggaggggagatggatttggagtcggtcaacccggagctcgccgagatcgacggccagatcggcgacatcctccgcgcattgcagtaagctccgaatcttttccgccgtgttctgaaatccgtttctccattttttccatttcaaatttcgatcgcttcgcttgtggtttatgtgtgtttttagtagaggtaatattcattggatctcttgcttgcttgcttgctgtaatgtttgcttatgaaatgcgagcctggaaatcagactgttaacctgcaaaaaataaaaataaaatctttgtagtgtaatgcggcaaaaagacgggtttgacttagatgatagattgataattaatctgcttcatttgtccacagaaatgggttccagaagctggataagatcaaggatgccaatcgacggagcaggcaactcgaagagctcactgataagatgcgggattgcaagaggttatccattcttttcacacatattacgctgcttagtgtagaacagcatcttttgtacagaatgtgggcagttgaaaactatgattacaaatgtgtcacttggaaagagttgagatttggccatagccattgcattactgaattcagtattatacaagttctgatgctgatcagtatctccaaatgcaattgatttttgttcttttgggaaaggatggatctagcagtggcggcatacaatcatacagacatttggttgcttaattttctctgtatacatttttaggcttatcaaggactttgagcgagttgtcaaagatatggcaggaagtaccgatcctgagactgctaggatgcttcatgataggaaacagtcaatggtaccaccgcagaaccttatactatgatataattttatacattcagctttcctgagtcctcaactccctcttaacctgactcttcgtgttttgcagatcaaagaattgaactcctatgttgctttgaagaaacagtgagtttatacctatcccgtgatgtgaaaggctcatattaatggacatgaacctataaggggttgcccttgaactaataatcacttcaccaaattagtctttattataaacttgacagatactgctttggctaacattacatgatacttacatgcaaaagatcgtttggacttcagatatgcaagtgaaaataagcgagttgatctttttgatggcccaagtgttgaagatggctttggtgaagaaaatgtcctgttagcatcaagtaagtagcaactctagggcccttttaagtgcatatggaggtggtctattttttctcaggtgaaatgataagaatattctggcggatatgccatcactagcatgaatatatgcacctctttagatttaatggtcaattatttcttttgtagatatgacaaaccaacagttaatggatcaaggaaaccaactaatggatgagactgatcaagctattgcaagatctaaacaggttatctttactatgttgtgcaagatctagacaagatctaagcaacttgatatatcttcgaaagagaagtgcataatttttttatttcttattggatcaactaggcattttcttgcatttagtatcatgtaatttttctgtgttttgtccctcctataggtacaaaatgtagcttctttcagtttatatatatggcttctaactgagcttgttgcatcattttccaacttagcacgtattgatctttttttgttatttcagttcctttagcttatacaaaaactctttattagggtgtaattttaagtcttacagcaaattgatgtgctctttcccacaaactaagtcacatcattgctttctggcactgatttgttgctgacttctgcagaccgtccaagagaccatcaatgtaggtacagaaactgcagctgctctcaaatcacaggcaggatttctttgttcttctcaaaccagccaatcatgctgtgtaacctggatataccagagctaacttcggttatttcttattgaccagacagagcaaatgagcagaattgttaatgagctggattccattcatttctccattaaaaaggcatcacaaatggtgaaagaaattggtaggcaggtaagtaccctctcaacgatatctattaaaaaggcaccgataatctgtcaaccccattattgtttattcatactgttcttaaatgtaggttgcaactgatcgctgcatcatggccttgctttttctcattgttgctggagtcatagcaataatagtcgttaaggtgagtgcttagattttccatatatctgcttacctgacagttaattttggcattccattcttccactcttggaatcccttcacacaatcttaccatttcactgcttattatatatttttttaaaaaaaaacaaaaacaaaatggcgatagaagtgtgccaattaagcagttcatggccccactgtcagctatggaacagacatttccatttattctcaatataacggtgtaaggtttttagatgagatcagtcaaccatttctcgatcaatttatccttggtgaacttcccttatcatggtgtctatctccgtcctttgtggattgaacttttttgtacagttagtagtaaacaaagaggtcataaggcgagatgaggggatgagagaactacccttgcatcaatattatttttgctttggtgaacagctgttagccctcccctagtgagaagctaaaaaaaaacccagaaaggaaaaataatttttggccctcttctgggtttcttctggtcggaatattcagtttttatggtgaatggttcatgatcatagtgtttcactgcagattgtaaacccacagaacaagactatccgagacattcctggtctcgctccaccagttagcagaaggctattgagtattgtagaagacatctgaacttcatacatgtgaacaaatcaaccaagagcagcttgtgctgtttaactcgaaggtcgcaactactacttgaacatgatgcacagtgttgtaatactatacccatgggatccgtgtgcgaggtactgtaaaattgtacgagtatgttatgactctgacaagcaggtttgcttgtaagaactgtattctgtgaacattcacatatgtacacgagcatatcaatcttttttaagagtgacagcagcgtatggatcatccaataatacagcgttttttgcaaatagattacaggatatcggtgtgatatgtattatgtttttgttacgatgggtttcgattatatcgtcgtttccatacccttctcatcggattaccagatcgggtactttacacaacagatttgttagcaaagtgtagcttagttaggacgttcatttctgttttaggatttctacttgcctctccttactatgaaaactacgcataggcaacctttgtttcaaatttacataacctagattctctttaacacagcttccaatccaagatttcttagagctgagtattactagcttcacaaatacaaattcatagatctagtttgcgattagcatttggataaatcatttcactctattttagataaaatttaaaattttaaaccgctataatttaacatagaaatatcaaatctacagttgatttgatctggagctatgccatacaaggccttatctcctatatttcccgaattgtttcagcacaatattgtaggaaaatagaaaacattccaaaccattgtaaagaactgaaaagaaagtgactaggcacaagaaagctcacaacagcagtaaaattaaatcgtacctccttccaataaatcagcactaataagtagtacatcaagaaaaaacaaagaattactaacaagtgtaacaagaagagtaagttgaacatgcaaactatttctcatttattactcatctatttcctgtacaccaagtgagcacattttacagtgacaaatccatttatccattttacagtgaacatatcagcaaagaaaaaccttaactcatctgtgttctggaaaacaaaggtgcttgctaaaaatagcaccaaccgcttctggatttagccgtaagcaaaactctcacagaacttcaaatatgtttctgggactaaattaattagaaatgtactgctgtgactggacaatagtagtcagctgcttgaggttagctaatacatgcctcgggccaagactttcagcaccaatgtgattcagaagttgttcaatatcctgcaaggaaacagaaggggagggatgaccaaatgaaaaataaccatgcacaactttatcgaagttgcaagaattttgataaccaattacgtataggaattacatagctgactcagaattactcacatgaaaattccaattttaaactgctaactgcattatcgcataatgatttgttattaaaagggtgcactgatatttttgttcttcagaactatgcatgttgtcatacaacaagccaaaattttcacaagctgacacttttattactttcttatgctgtcaaattcatttgagctgatcatttatcctaattagatcaacatagcaaacacaactaatggtttcttaggaataggattctaaatcaccaacgtgaagctaactcaagggccttagaaaatattctcttagaaaatagacttacatgcgacttttcacaaataatcttcgcttgattgtagttagcctccaatttttctagtgataatgtgatatggtgatttgggaaaacaatttacagatcttcaataagagggcatcaagggaaaggcatatctttccttttgccattttactccatcatggttatagctattcatgttaatcaaacactttttcattaaataaacgcgcaacttagcaagaagaccaaccttgtttagcaaaaatattgcatatgctgatcttgttgtctcctggctttcaaaaaacagagggaattccattgttcgcatggttgtactcagaggagcagaacttatagcagaagctaaggacgatgactcaactgaaggcgcgcgatcaagaacatatgaccgtgaacctcccaaccgcagcggatatcgaagaggaacatcaagatatgatgcaataagggacactgcctatgatccaaaaatgaatgaataaaaaaacagcagtaagtaaaaagaattgcatagcgtagtgccacgtctatcactgtaaaattctaaaatgtgtatgaccagcaatattgggttatatatatgtcaaattggtctaaatgtctcttcatcctatcaatctataacagaatataacctacaaaattcagagaacttatagaaagaaactggaatcaaatttgaatgcctaaatcaatctccaatggacatatatttcagtttcaattatacatacatgtgcaacataacccaatgcggtggcagaattctgaatctcagtcttgtcactaaagtagccagtctttttcatcgtaagcttcgatagttggagacccaaaattgccaaaggtgcctgtccattttgagaaccattcggagccattgattccgcatctcctgcaaaattctgatgcattcaaatttttgacaatagtttcaagattaccatctcataccgaagaatctaaacattttgctatgggagaaaaaagtaagtgatcactccaagtcttcagcttgtttggctaaggctcatccattgtagagttgtagactagtatagttgccagaaactggaagctaaaaagtgcaaatgacttcatgtttgatgttatcaacaggtgatatctcaacaaaggtaaaattggttttctatagttatcttcacatcagagatacagccagtagcctagcaacgaaaatctaaggactacttcatgactaaccaccaatgatacttatttctaacatataatggcatgcattacaatagttcatggcagaccttaattctggttcttactactgaaaatgaaaaggggcatctcaattgttttaaaaaaaataatttaaaaatgtgtgacgacgggcctgtgtgtgcaatattgtttggacaaaattagtaatcagacaaatattctcaaagtgcttcaatgctattcaacgatagaagaaatatgaatctaatgttgcagcatcaggtgatgaagaacattgtcatcatacagagcatgtccaaataaatctgatttacatcaactacaagtgaatgttctggatagcaagattctgatgttatcaagcataggcagcattggatataaagcaggtataccaacttgacagagcttggaagttgtaacaggaaaaggtaacatactggttttgagaatactggagttcaagaagctaggcttgttagctggagatcgctcaatcaagggtctcacaggatataaatgtgctacttgtgctgtcatatattgctgtcttgtgcgcaacatcctttccacagttttaagacggacatggagaccattttcccctgacagcaatttatcagcttcctacaaaaataggttcaagaaaaattagttaaatagaaaaaggcacatcatatacagtttaaaagcacatcgtatctttcttgttctataaaccacacatttagatgtgataattcttatatcataaggaacagtcattactactaaagggcactgggacaatatggatgaagaggaggaattaagagaaaaaggagatgatacagcatttgaggagaaggattaattcattgttcttctagcttaatcataatgaatacaagagttatacctatatagaggatgaactaggatgcctaacaggaaaccaaccttaacagttgatattcaaaatgcatgtcaccaatctagccactgatccatctcctatgtggaaagtaattgtaccttaagtttatttcgcgctgtgctaagagtattgcttgttgttgacaaggttcggatcttgatgcggagttcctctcttcgatcatccacatcctcggtcattttcttagtgtgcattttcaaatcccacatgaaatcagcacgtgcttgcactctttccctgatttccgccaactcattatcctgctgaacggaagccttccttgcctgctcaaaaacacatagcaggtcatacatccatgcaaggactagtaaccgcaatacaatccatgcatccatagcatctcatgagacatgtagcatccagaatttaaccctgaactcctgattaacaataatcgtaacacgacaccaacattaagaaaagagcaccacgcagcagcacagctaacaaattatcccccagagactactactcgagaacattaaggtaaatcatcgatcgttccggttccagatcaaagttagaagacacctagggttcctactatccgcatagaatgtgaattcggaagctatagaacgcgcccagtgatccgcccattccatcaggagttataaacccaaattaatcgagcaaatacctcgagcgcggactggaggcgcgcggcgagcagcgccttgcgttccctggcggtggcgagcgcggcggagaggctccagacgcgtgcgagctcctgctgcaggtcctcccagtcgatgaccttgggcgcgtcggctcccgggacctcgctcgccggcacgaccacccaccccctccccccctcctcgtcctcctccggcgccggcgtggggtgatccgcgcacgcggacgacggcgacggcgacgaaggccccggctccatcggcggccgctgcggtcatgccagcgggcggggatccgcgcgtgagctcgccatgggcggctgctgctgctgctgcggctagggtttggtggccgcgtcgtctccgacagcggagagggagatcggcggcgactgcggatgcggggaaggtggagatggttgggaagaatggaggaatggtggatgacgtggcgtgacgtcacgtggatccatgcgtgtgaagaggccggcccagcccgggagcaccgggcccgttgaattcaaattgggccgaattttgtagcgatgcgtgtccggcccattagcaggagaaggcctaattgccatccggagatgtagacttgtccttccccggcaagcgcctcaggggtagagaccaaagtgggtcaacccacataggtcaaataaatagtaaccggtggactttcgtttcaaagtctggtttgccataccgagttgacctgaactcacttatatcaatctattttttttaaaaaaaattagctaataattaattaatcacgtattaattcatagttttgttcttcgtgtggagggtacgggtttcttttggagaacataacctaaatatattagggaaaaatggaagctgaacagataggaggaaaatattatgaagaaaaaaattgaaaggtgagccgatatggaggggaaaaaagaaaggtgaaacgattcgatgcacatatcatataaaaatatttttttctaacattaaatttaaaaagttattagagataatgaaattgcacgtaatgttcaacatgggcatattactagttagtagttaactcacccgtcaattcgtgggttacccattatttttttttaaaccccgggttacccactaaatatgtctgtaagtagattggcgggttagttcccatgcatcccagctcaagccgcaggcgtggtggtggccggcagagccatcgcggaagctgccagagtccggggggacgaccaaggcggcggccggaaatggcgtgtcaacatttcacccgtcgctgcaacgtcttctccggcaagcgtatccatcggtgacggttgagtttcaaggttctatcgttgaatcattgtatctgaagagagaattaggaaaggataatacaagaagaaattggcgatggatcgagctctgaagatgacgagagaattgtcagagttgtcaccaaactcaccacgctttgccgccgggttctacatgaaatgagtagcacaaatggcgaccgacgacagctcagggggatggtcctcgttgcaatctccacggcgaatattcttctttggttaattagtggcttattattcgccgtcttagaattaataatcacatcctgtaattaaatggccaaagacagtacagtacactagttctactgctcatgacacaagtctcaacaagtcggcaaatcttgtttgcatcgtccactccaccgtcgtctggaacgaagaccatatgccatcttctcctttgactactttcttcagcttcaattagcatcttactcactacactaatcccatcagaagaaggttctaatgcacattaaggaaaaaaaatattggatcaccaagttgttgtaggggaagaaatctagagcactgatttttaatctggttcggtggagatgtggctgtaaagtaagttcagcaggtcatggcttgatggtgacttgtctgaaaaaaatctgtttttcaggagggtttacttgtctgcttctgtaactgcaagcacttgaggttcagacgattggatcaggttgaggttccaactgattttcagatcatgtgggacttttggttgcaccatgaccatactacaaggtagactagtgagtgctattactttcgatgatattaagatgatgatgatgcggcaagtgccggctactgcaactgaactctgaacactgaaagatgaagatgtgccctgcgattacacaggagttttataggatttttcacgtgaaatcattctactttccagtgttccaaaggacccctaaggtagtacaactatgattcagacatcttttgaacaatattaggccccaaaatggtcacaatttacttagtcagatacaaataccatgtttcatttgttatccttcagcttcagctataagggttttgttttgagcttcctttacctattgttagccaaatcgaattgcataattgatttcagaaaaaaaatgaaaaagaaggtgcagaattagtgcgacgtgtggcctcgaattcttgagcgcgccaaggactgtgatgatgtgaatgaacgaaacaagcacaagactgtccacataaacaagtcaagctgccaagttgttttcgtccccgatcgacaggagaagatgacgacgatggcgagagtggcaaaaaggtcagacaaaaaaaattcaattctgctggaaggatcatcagctacatctcctaccgtttcacacctcgcgtccttggttgccgcttgttgaatcaaatccaattttccattttgtcccaagcctggtcaaaaatcagttttgcaggtaaaagatcaacatgcaccttccctttcctgtaaagaggcatgagcatattttgcacactcagcatttagattgatggcccctttgtttctcaggtagaagaaaaagcttttggtttgaccatttcaaccaccaacaaacactttgaattttgacccaaacagttattactactactgccgagtttagttccaaaatttttctttaaactttcaacttttttatcacatcaaaacttttctacacacaaacttacaacttttccgtcacatcgtttcaatttcaatcaaactttcaattttgacgtgaacacgttgaagaaagaaagatgctgatatgcagatatggagcaatgaatcaggtgaggtaagtatattcattcctccatgctatgttgattgtaacaataaatttccttattattttatgattttatcctaagaaaaaaacaattaagaacagtacactctctcttcattgatcttgttgactggtgtacagttagtgtgatggtacaagtgggagacgcggcgtgtgcgttgggatcgccgcgaacgaacgacgcggaagcgaggcgaggcgaggcgacggtacgtgtcctcttttctctctcgattgattccacgcgagtcgtcttcttcttcttcttcttcttcttctcgccccccacttgttcatggattccaaccacatgatccatatgacgtcgtcgtcttcctagttcctcctcgtgttaatttttccatgcaattttagctgtctttatcaaagctaatttgagctctctctctctctctctctctctctattctatttgtttccttgctctgctctctgaatttcttctcttcttccttctaccttcttaatttgcctctctgaatcataccatctcgtttctactccatgaacagctttagcatcttgtcactgctcactgggattaaaagtgtctccaattagtagagttcttggtcttttttttcggatgctactctccaaagatttggttcttggtgtttttaatcagcaaggaggcctcctctcaggtttaatttgctagcccatcagatatggggtgcttcgcgttcaagagcaaggccaagaaccagcgggcggcggcgtcgggggccaggtcgccggcgccgacgtcggacgggcagaagagcaaggcatcatcggcgtcgacgccgacgaggagcatccaggagctgtcggacgagaggggcgcgcagcggctgcgggtgttcgacctcgacgagctcagcagcgccaccaacggcttcagccgcgcgctcaagatcggcgagggcggcttcggctccgtctaccgcgccttcttccgctccgccgccggcggcggcggcggccgggtcgtcctcgccgtcaagcgcctcaaccagcgcagcctgcaggtcagtacagtatcagttagctgtactcccatctctcctccctctgatttgcatttgctcctctcgaaaattcgccatggtgcatttgattttggctagatttgtcaaaacgtaccgaatttgttcatcaggacgattgaatggcaaaagaagaacttgaagattttgtcttttcagcttgggcactgaccacatggctgcatgttttttcagagtttcaaaaaagaacttcgcttttactttctctagactacattcaagactcgtagcgtacaatcttcacagaagattcagaaagacggcatgcacttaaatatatatttttcggattcacacattttggtatgctaacactacagatttactactgctgaaaatgttcttcaaccagcaatagttaccaacaagcgatcctgatttggatttggatcgagacctaaaatcaaactcaggatattgttcttttgcaccgaaatcatatgaaattcttagcctcgtgacaattccaacaaatagataaacacatcccgtaggacaaggacacccacacatgtcaacttcaaccacagatcacacaccaaaccacgtgaacaatggtccggacagcatcccaagtcaacctactaaattccagaattcagaatcacgttataaacaacgtaccaagcttaatcacgccaaaacttgatgccagattgccagtgcataggacaaaatccatgcaattttcaattgttaaatcaaagattgcatttttttttaaatatcaacagattgaaagttatgtttttctttttttttctgatttcaggggcacaagcaatggctggctgaggtccaattcctaggtgttcttgagcacccgaatctagtgaggcttgttggctattgtgcagtggattcagaaacaagcaagcacaggctgctggtctacgagttcatgcccaacaagagcctagatgatcatctgttcaaccgagctcatcctcccctctcgtggagattgaggctgcagatcatgatcggcgccgcgcggggcctagactacctccatgaaggcctgcaagaagttcaggtgccctccaaagcattgtcctcctctctgaatccataaaactcaaaatatagatgcctcacaggatacattgtctgaattctgaaactctgaactgaaccattagtttagcacctgcggtagctagtagtaagccttgtcctatctgaattctttaatgttcaagtatgatatgatcaatctggcatcttcccaatatctgaattttgaactctgaaactctgagctggaccattagtttagcacctgtagcagctagtagtaagcattgtcctatctgaattctttattgttcaagaatgatatgatcaatctggtatctgtcccaatatctgaattctgaactctgaaactcttaactgaaccattagtttagcatctgtagtattgctactagtaagcattgtcctatctgaattctgttaggttcaagaacgatatgatcaatctgaaatctgtgccaaatatctgaattctgatccgtagtttcttagtctggcaggtgatatacagggatttcaaggcagccaatgttcttcttgatgccgatttcaagccaaaactttcagactttgggctagcaagagaggggccaactgaaggaaagacacacgtctccaccgcggtaagtgtaaaatccattgcgaacaatcaattcatcccatccgatccatgagcccgagtgatgatgatgatgatggcgatctcgccggcggcgatcaggtggtggggacgcacgggtacgcggcgccggactacatcgagacggggcacctgacgaccaagagcgacgtgtggagcttcggcgtggtgctgtacgagatcctgacggggcggcggtcgctggagcggagccggccggcggaggagcagaagctgctggggtgggtgcgccgccacccgccggagagccagagcttccggtcgatcatggacccgcggctgggcggccggtacccggcggcggcggcgcggcaggtggcgcggctggccgaccgctgcctcgtcaagaaccccaaggagcggccggcgatgagggaggtcgtcgaggagctcgagagggtgctccagatggagccaccgacgacgacggcggccgacaaggacggcgaccgccgcctgccgccggcgaagaggtgacgtcagatcagtcaccggaggaggctgcggtcaacgacggtcaaccagtgcgtgaggaacaaattgtggagagatcgatcattgattcatttgtattgtagagagagatgatgatcaatgcgaataatttggagcatgcaaagtgtttcgattgcacaagatttcccagtttgctgcaagatataatcttacagttctgtagagttcttatgaaaaacctataaatctacgtaaaccgtgtgaaattcgtgcaaaccatgtgaaattcatgcgaacttgaggggaagtgggaacattcgtttctacgcacacttttgaactttagggaaagtaggaacatataatgcatagtaattcgtttctaggacacttttgaacttcagggtgttttttagaaagcttttctcaaaaacttgaataaaaaaatttccccgaaaaaaaaagaaaaaaaaggtaatcccaatcctgtggagaggttgggccggccgacggcccaaatcgcaatggcaaaccgatcggcccaacacatggtctccccgtgggccttaaccccaaaagcaagcaaacccccctcgccggcgaccgcctccctgggaaaccgacgcatccgccgccgccgccgcccggctccctcccgcgcttcgccgcttcagctcctctcgtgccagcgatgccgccggcgaagaagatcacgctcctgcagacggtggcgttcgccggagtcttctccgccgtctcctgctggtaccgtgattgatctgtatactatcccgtcgtcgccaaaatctgcgtcccgtaggttagcagcgtcttagatttcattccacccctctttcgccgctgcaggtatggattcatgtttgggagggagtctgcgcggcgtgagcttggtggaatcattgaagacctccgcagcagcggcggcagtggctgctccaccaactccgcggcttcccccgattctgacgctcattccaaaccctagctcggtatgctgctttttttcttttgagtaaatttcataaaactacatgttttatgattcaagtcgcagaaaaccacgcatattttgacacttggcacttaagtacatatattttggtagtttagtttcacaaaactacactatcgatgaatagattcacccgtgagatgacgtggttgttccatctagaatgaggacgtggcatctcattaatttcgcgcgatggctggtaatagaatgccatgtcctcgtcctaggtgaaacagccacatcatctcgcacgtgaatccatttatcgatagtgtagttttgtgaaactacacaaccaaaatatatgtactcaagtgccaagtgttaaaatgtgtgtggtttttttttgtaacttgaaccacaaaacgtgtagttttacgaaatttactcttttcttttcttttcctcgagattcaagagtatggatatgcctaaatgtgctcagatttttcggagtgatctgctagtaatgtcaggggtgatctgtgcatcactctttgggatagggtatttgagttttagtttttttgtataatgcctacatagctctactaagacacatatatggactgcaataacaaggtgtagatgcagtaggatctaggttttggttcattcatgcttgctgccttttgtgggtgcgtactgagtagtgagcctaaccaattttttgctcttaatttagcaatatgtttaggatgaaactacaactttacatggtaacattttgaactgggacctaagggcttgaaaattaagtttgggataatggcattgtgatggacaagcatgggaatataactacatacaaattaggatctaggagaagaagttcaatcaagttgggttttgatatgtgtgttcttgcggccaataggacctcaaaaactgaaaaaactcagacttgtaagaacaattgcttggtaattagatctaaggtttgcttgtggttatgattattagggtggtaatttgtatgacttctaaaaatcactaaggatatttgatgttcatcatgttaggttagggttactccagcttattcaacataatattttgcttccataagtgatgcagattaataaagagtaaagactgctagagtttacagaaagactaatttggtcacttttttatgtttacgaatcctgtttcacaatatccagaacaagaatgtatgttcatcataaatgactaggtgagatatcagaggagatttttagggaggaactctgttaaagatttaaccaagtgaacttctgttatcctgtttagtaggtttctgttttaccatggctgttcttcaaatgcctgaaaacaagttatgatttaagggattttaggcttctctatttgtccacaaatctaagggattttagagtactactttctcaatccatccaaccactgcatttattgctcaccagtagtttcatccttaggcgtgatctttcccaatcaagtaaactcctagaggcatcgaagtaattccacctcaaccttaaactctgctaaacaacctagaatccatctgtccatggctgcctacacaagcaagaataattttagtatgaacaagccatccataggtcgagagatatcttgtaagtacctgcaatcttttttctgttctatgggctgtacccttttaaatacagatcttgtcttcaggacaataatttgatcttactcagtttcttgtgtagctagtggagcttgggaattttgttctgattcatgctctgtgtaccttttgtcatctttcttgctgaagtgttttcctatgtgcttgcttgagcttgccagttggacttgtatgttgtaattgccacagcccacatgctaaagcctttagagatataagttgccactgttatgatttggaccattgagtgcagatcaaaccggcatggttagcggcttatcaactagtaggttacagccttacaggaatatatactatgttcccatggcccatgttaaaaggaccttttagtctttctagtgagctacagctgccttatagaaattcctgctttggaacttggcctttggttaggaaatggactagaatcagggaccgaagcatctagttgcttgttcatttagatctctgaacttatttgaaaattctagaaaaattgaccatgttgtggcaatcctagccacagaaatccaatttgccttatgttccttggataatttcatgattatacaccattttgaacaaattaaaacagctgaacagtgctgaaattttctgctctggataaacatatcagttcttatctacatcgttttctcttggattagaaaggagcttgactgggccagaattggatgggttggtactgaatagagcaatcttgtgttacctttttatcttttcccttttggttttggcctcataatcctaaaagcgcatgattgtgtcctgctctgctgttattgtttcattgttcatctgttatatatcaacatgtgtaccactaccacattaccatatagtttgaaaaatcttctagctaacacgattctctcatgctttcttcatacctctcttttagcatacactaagaactggagttctgttgtcaacacacacatgattaaagactgagagatatatgtaagttagagaaactacaggcagtaagtaacctagttaaatctgattacagagaacgcgtgatactttctgaaacttctagttcttctgcacagtgctacagaatcctagaatgggactaccaccaatgaagaaccctcaaatgtccctctcttgaggtgataacaaggccaaccagagataaccacttcataagaaaaggtttgaataaagaggacatagctatcagtagaggaatctcttgctctttaatctctctctttctctctctctctctctccctattgatgtgcactttcagtcctctccttttcaagcacttgatacaaccttgataggctctcttgtccttctcatggtggtgagctcatgtcaggatgggcccttgactttgctcttttcttgcagtcacactacatcttttggaataatctccagtgccgtggcactatgcagaattcgcatatgtcactaaatataaattgtcaatggcccatcgatttgtgatctagctctgaagcatccatgagaccatgacgcattccgtaaccttgtttagttgtatctgcttctgggacttccagtaaatatatggtttcttctcctttcttttgtgtgtgtttgttgagagttcattgtcttcactcattggctactaggatgtcttgaattagactattttggattatgcataagattaatcagttgcccccagaaaaaaaagagagtacaaaatgggtgtgccacttacctattattttgctgctaatttgtgcatggaattctctagtcaaaacccaaaagtgcaactgggcaagtaataggatcatgaacgtgtgttagttttgttccattatctcttccggcacaatgatttattgtgttgactgccaaaacactggaaaattactctcctaggatttctttggaaaaaaccaaaatgacgtgctaaatagtctaactgatggataaaacatgatgtcaaagggaagaaaaaaagtgcaattagctagataagacatcaactctacctctgcccatgttattgattgctctaggcgatgggacgtaaagtgtcctctctgttttagttttttttggaacatgcaagtcgtgatcatgaaatggctggttggaacatgcaagattgctctctgcttaatcagtttgctgcaaaatgaaggcaacatgatgcgtatatacgcaactttggtatctcgtaccaatagtaccttgattgcagaaatatcttggtgcgatgatgagtcatgggaaagtaaggacataaaacactggcaaattggatgtgaagtccgggagagaacatgactgtagagtggagactagtcttccaacataagccttagaaaaagtgaccaagttgtacgatagttctatgataaagttagttggcatcgcccggacttgaaggccaagtgtactgtgccatctccatccttagtttgttgcataataatcgtacttaagttgatcaagaaatgaaaagtgagaagagcaagaacttaaggaaaacaagagcaatcttgatctcataatctctcgtagcatacaaaatttaagttgatgatttgtagtagtatgtacaaaacgaatagtacatgcaagttaggagttgctcctggtaacatgcatggatgaaacagtctctatgatctgcacacatatcgatcagaccacgtccaagattacaagttgttcatacaacatgtccagttattcatctgataatctctcaccgtagctgttgctgcaattaagtggtaatttcatatccctgcagatctctcttccatctatctgaatatctcttgtgtagaagagaaattaacaaaccctgcatatgtatatgcaactatgcaagatctgatcccaaaatctaattaacaatttaccaatccatggccgtagctagcctcaactgatcacacatggaaccgtgtgaaaaccacaaaacaaacaaaatgaagatggcaaaaaaacacggatctatgtaatattccatggatctacaactacctaggctacatacatatatatatgccaatccacactgtttaatttaactttggcgtttgatgatgatgagcgatgcgtgcatgcatgcagttgatcatgaacgcagcggcagattcatctctcgaccatgttagtataggagtacacaacactagctggtggcggccactggagtgcgtgccgcgaagttggcgatggtcggccggcggtgcatcatcggagacctcgccggcgccgccgctgctgcctcggcggaagccggcgccgccgacgaacggaggcgatggcggcgcgccaccgcctgcagcgcctcgtccatgtccatctgctcctgcctgcagtcgtcgctgcagaacgctgcatcccctctacacatgcaaattaatcaagatcaattccttgttgaactttgaacacacaaaatttctgtgaaatttattaaggatatatatcaattgatttgcgaactgaattacctgtacatgaagatgtcgcggtcgccggcgatgctgctcttgcagaggaagcacgactcgaggaagtggagacggcggccgccgccgccgccgccggcaccgggcttcacgcggtagaacctcgacgccacctccacatacctctcctcctcctccatcgccggcggcgagccaccaccggcgatctcttccatctctaatcaactgcacgtcgtagctaatcaaccatgcaaccagctctagctagcttattaatttagctagctagacatggtgatctcttcctgtcttgtatcgatcgaacttgcacatatgtgtgtgtgtgtcagtgtattaaatcgttaatggtcctctcctggtagctagcgagtttgttggcagatggaggccaaatgcaatgaaagatgtgtgcatatatatgggtatatatgagcattttgtttggcacatagctgattcgagggccgaaggtttgagagaaaaccgtgggtggagtagcaaatgggcccttggaacctattggctggggctggatgtgtgcgagtgaccttggcctaggggggactaacctactctgcaactgcacccaacttgcagaaatatcatttatatatgtattcatataaatatcacaacatcaattaataatgcaaaagtaatcactctcctgtgcgtggaaaatggaaccagattactgattagcagtgttattaaagtattttctgggtcagtcatgcgagctctgcaggtgcttaacgacaaattaagcttttataaactctgcctttgatccttgcgatagaaaaatgttttgtaccacatcggccagcgaggcggcatgggcacggcatatagccgttctcatgcggcatccgtttgtacgaccagggcccatcaccatctctcgctgcatttacagtttttttgggccaaatgtagtgatccatcttttggcccatataattcaacaaagagaggcccatgtgattccactgccccatgagaagcgctgcgcgatgcattcgcagatttgggccgtaagttgggccacggctatcattttgggccaaatttggatcgcagaccagaccattggtagcgatcgcattttgggccagatttgggttagtatgttttgggctccaatttcaatttcgatttgaattgcaatttcgattttactatagttaaaacttcgtcatatgtaaatatatatagcatcattgtaattacacggtaactttcatataatttaatccgttaaatcgtagattcattttaagattcgtgcaagcgagaaaggaaaaaaaaatcatagtgtccgtacgtacgggtgagggctgctcgcttcatgaaaatagtgggtttgccgtacaatttttaaaagctacatataagtacgttatatgcaatttataatacaattacattataattatagactatattttacatctataaaatttttaaagaaaattttgtccacacatatacaggtagcgtgtgacgtgtgcgtctccgactcctccggccggtccatcgcatcacagccacacatcacgccgtagtaggattagccaagccaagcgataagccactcatttcgtcgccgtgtcccgcgtggctcgccgccatggacgccgccgtctccctccacctccacggggcgctcccgctccccgcctcgcgcgcgctccaccatctcaacccggcctcctccgccgccgccgccgcctcggccaagcagcatcagcagccgcgcgcgcgcctagctgtcacgaccgcgcggcccagcagcaggacacgcgcgcgcgccgcggcggcgtcggcgccgccagttccccctgtcgttcatcagcagcaccgcctgtcgtccagccgcgcggcgacggggtacgcggcggcgctggccgacgcgtcgctccgagccgggacgctggccagtgccgcccgccacgcgcgcgcgctgctcgtctcggacgccgccgccgccgtcgacgttgctgaggattcgcgggtggtcgcgctggtgaggatgctcgtcggcaagggcaaggccgccatggtcgccgacgtcatggccgagttcgtcgccatctgcgaccgcctcctcctcctccccgcgcgcccccacgccgccacctcttactaaagaattacattactctgtcagactctgctacgctgcaattaaacctcgcatgttcagaattgctgcttgttcattgcaacacttgcatattgccaattcatttctcagtaaaatatcagcttaaatctctactcttttttttttgtcgggccatacatgctacgtcccaaaatatagtaatctaggatcggattggatatatctcaatgctacgaattctagattgatgtattttagaacgaatggagtaatttacataatgttattcctgaatcatcatacatcatgtaccatgaccttcaattctaaatactacctccgttccaaaataaatacagccgtggatatttgtgcccaacgtttgaccgtccgtcttatttgaaaaatttgtgaaaaaattgaaaatatttagtcacacgtaaaatattattcacgttttatcatctaatagcaataaaaatactaattataaaaaattttcaaataagacgaacggtcaaatgttgaatgtgaatagtgcataactgcacttattttgggacggagagagtatgttgtactgtggttctgcagttcttctgctgcaaaaccgctgccaacctctaaataattcagggaccttgatctttattgcacagaaaaaatttgaagctagcaagctgtttcatctgtcacagccttggggtttataaatgagttcacataataaaaaggacaatcatatattggtttggatgatgcactagccacattatgcataatgccaaactcataattctcaatagaataattgagtcataaagttgtggttgtgcaaccaactgaaacaggaaagcagaggaacgtgagacgccatgggagattgacactgccgcagcgtgatggaaggtacgtagtagcagttgagaacctgtactgtatattaattgagcagttgaatgatgttaacgcacacgtaatccatctctgcaatgtactacatattgattgagcagttgagctataagaatatatatatacagtagcgtagcatgagctgcatatccctgatttcattggattaacttttgtgcttctgtaagacttgacaaatggagtatcttttagttgtatacatacgctgctcatacactattgatcctatgaaaactgacataaggcatgattcatgaagcacattacaagcactaattgatggatatatgtatgtacgcgagtgcaagttcatgaaaggaacgatcaatcttgaaagagtaacagcagtgctccctttgcttgtgacacactactagcttagctattagcacgtactcaggtactctacaaatgaatgatgaaagggagagtacatatatacaggagcaagagagccacaacctgtctaccattagtaattagtaattaacccccatgactgacagccaacaggaactgatcttttcaatcttgttaagttaattgatttgccgcctccgatcgaatccattaagaaattaatggaaagacaatatacatccacagtaggagcaagatcaaccactctcctctacatctccaatctccatacgccagcatcttaattactctacaataatcaatcaatatcaacgcatgcataccgcatacgtgatctcagaagaaaggtacagctccatataagcacacaatacctcgctcagctgtgcatagtttgcatattttgatcaatcaatcaagctaagcaagctagtgattagtccattgatagatatcgatggaggaggaggattatgtgttcaaggtggtggtgatcggggactcggcggtggggaagacgcagctgctggggcggttcacaaaggacgagttcttcatcgactccaagtcgaccatcggcatcgagttccagacgcggacggtggagatcggcgggaagcgggtgaaggcccagatctgggacaccgcggggcaggagaggtaccgcgccgtcaccagcgcctactaccgcggcgccctcggcgccatgctcgtctacgacgtcaccagccgccggagcttccaccacgccgcccgctggctccacgacctccgcgcccacgccgacaactccatcgtcgtcatgctcatcggcaacaaggccgacctctcccacgcccgcgccgtcgccgccgacgaggccgccgccttcgccgaggaccagggcctcttcttctccgaggcgtcggcgctcagcggggacaacgtcgaggaggccttcctcggcctcctccgggagatccatgccatcgtctcgcggaggtcgctgctggagatggacggcatcaacggcgacgccgccgccaacgccaacgccgcgctcatgctcaggggcaccaagctctcgctctccgacgagctctccatcatggagaccagcgccatcaagagagtgagcaggtgctcatgctcttaattacttactttagacgtcatcggctcatcgccatcgagagagtactcatgctcttgacatcatcatcatcatcgcaagttcataatatacatggatgacagatcttactgcagaagctgagacatcttggtttccaagacacataattgaagggaaaagtatatattaattcagctcttgggtgacaagcaagcgttagtttcatctcatcgtgtatctatttcaagtcacagcagagtgctccgacaaaaaaacaagattgtttgtaaaccatgcaagcgggcctttcttttcttcgttatgtatagagtctaccctaaagtagtttaattaaattaaaatacaaggtgatgataacaaatttcacagaaccatagaatcctgactcgggccatataattctgaatttaacttataacatcagtgcaaagcattgccagctgccattaacttcaaaaaccagcgcagcctcgcgacgctaaatgaatccatacaaaccctgaatcttgcaagctgcattagaaaacctaacgatatcgaggtaatgcctgcgcttactcctttggattttcatgagatctagcaaaaggattagattaaggtgaagatggctcttgcggttccgactgactgttctgaactattcgagacatcagcttagatatctcaaaaattgcgctctgtacctgatcgtcttctgaatcagagggccgaatccacaccggtgactgcaaccccgtagatgttccattcgcggcccttttcccctttctagacgttgataaagctttctccagatccgattgcctcaagggtcttggtttctgaaccagcaatcaggaggcaagatagtcagaaccaacatgtaatgggcaataatcaatctgatgttgtttcagttattactgtatcattaaagtccaactagaaactgtaaatgaaatttgaccatgaaatccaattaaacagaatcagcggctatgctggcacaagtggattcatgcatgaggtttgccgttcgcaaggtcaactggtgtagacaaacattacccaaaggaagtaataatgaactaattaatggtggtagtaatactaaaaaaaatcagcagtgaacacagtaagcaacaagaaggaatgaatactcacatctgcttttcgcccatctttctcattgttcaacagctccctgatagggtagaatgctgcttgcttgcacagttctagaatgtctgatccagtaaatccctcgcatagaccggcgatgtaatcgtaattaatgttaggctcgacattttctcccttcaatacaaccctaagtatcttgcttctttcactctgaacaggaatcccaatttcaaatatctgagtaaagcgcctgaggatagcctcatctagctcagagggtctgttagtagcagcaaggaccataacacgggcattttctgcaaagccatataaataaatcataagatgttgcacaggagtaaccaggaaacttgtttgctagttacaaaataagttgctccctatgtttgaagagactatgtctggcaccctaaataataagacatgatcaaaacaaattacgacagttgatacatcgatttctatttcttgagagagaagccatgtgacggtccgtgtattgtaaaaaaaaaatcgttttctcatgtccagcttagacataattagttatttcaagaaaaaaacaaaagctaaaaagattggaaaaaggtccaactcaattaatttcgttgaagtttatatgtgttgatttcaccaatttgacattatattcagattgcatggtaactctatacactaacggtctgccactttgggtgcatggttatcacaagcaattgatcagattacaacaatgcccataatagcagggatatgtggtaactggaataattattagtactaacttccagttcgaaattctaaattgtaacaattgtttccccttatgaaccactgccacctgtgcctgcaggcagcgattttcaaactttcttataaaaaatcaccccaattaacaatattgtgcacaatacatcattgtatgtttgtaagataacctatctaacaattaacttacataacttacatatgtttgaactaatgtgcaaggtttaagaagaatattctgtgctgaatgccaacaatgaaatatgaatttgttcagacttcaacgtaacaaagcattaagcatgttgatattctaacataagaaaacttgagcataaaattgaaggttatgagagataaatttatatataggttggaaatgggctcaagtttgatacaacacggaagtaaagctttggacagcactgtttagcaagaatccatatgcgatgcaagaaacccgaactaaatagcatatcgatgtcacaatgcacagtggaatgtcatgcggcatcataagcgagctgcatagtgcacttgtgtgttgcaacatactttttctcttaggtaatggagcacactgaacagtattccagactatacatggtctttttgatatatcttatatctactaatataaaaatcgaatgtagatataagtccgcgttgtggggaatcaggggcatattgagagaacgagtaacatggaattctagaaccaaccctcgtggccgccaacccaaatattcaaagtggcaaaggtatatcattacataataaagagaataggatatttgcatagttactagcaatttggacatggaatatgttcatgtataagtttgaagcagagtgtgtacttacgatcagtggtgaagccatcccagagggacatgaactcagtcttcatattagtcatagcttcgtggtccgttgtccgtcgctggcccaagaaactatcgacctcgtcgataaagataatagccggctgcagcttgtgtgcgagactaaatacagcagacactgcaagatgtttcataaatcagcagcgataacaacaaacaaatgaaaaggagcggcagttaaaccgaaggatttgcgcgcggagctgaccgagcttctgggcgtcgccgaaccacttgctcatgaggttggaaatcctgacattgatgaagacggcgcctgactccttggcgatggccttggcgagcatggtcttgccggtgccgggggggccgtagaggaggacgcccttctgcgggctgaggagcttgccgaaggtgaagagctcggggcggcggagggggaggatgacgagctcgtagagcgcctgcttgacgtggtcgaggccgccgatggaatcgaactcgacgtcgatgtggtcggggttgatgacatcgcaagcaatcacatcctagggtagagtgagattgcataggtgagagaggagaaccctagaatcgaatcgatggattggggattgggggtggaaacaatcgaacctcgtagggggtggtggagacgagggggcggccgaggcgcttggcgatctccttcttgtgctggagggccttctgggaggcggcgcggttggggtcgagctggcggaggccggcgaagaggacgaggcagctgagggcggcgctggcggcgtagagcaccagctcctgcacgaaccgcgacgactccgacgacctcatccaatccaatccaacccaatccaatccaatctgcgggcggcggccggcggcgagggagggaggagggagaggttctccccccacacaccggatggatctgcggccgccggagccggagcgggaggaggggaatcgatgggatgggaaaagaggaaaaggaagaggaagagacgaagggggattagtcggtttatcgggaaggcgtcttggggaaggggtttgtgttgcctttgcctctcctccgatgcttctggtctctcgtctgtttgccgcccctcaaccttcacggaaacgagtcgccttgggccattggattggattacgattacacctgtccttttttttctcgaaggaagatcacacttggtctcttattccgtggtagattaatagttaattaattgtatgtatccttttttttatcagaaatacaacaaaatggtagtactccctccatccacaaaagttacacctatttcacatttgatttttttttcaaataagttgttcctatttgtagtctttatgcattcaagacttaaatgaagagataaattaaatgttttattagaacccaaggagtcatctaaatacttattagttgcatgcttgtattcactccttaattttgtaacattcaaggtgatttaatttctccttagtcttggtgttaaaagtaatatgtgtaacttttgtggatggaaggagtattacaattcaacgagacaacttacatcatattgaatctgatatctatatggtatcatatttggtatcgaatgtattagatcggtatctacgatatcgtgctgacatcaactattccgttacaaaccgttctgaagtctttctcttattttatacttctattttatgaataggacagtcaaaagtttagactcgtagtattatatgcatatataatagtctattcaagtatttttgtacatttactatatattttaggagaatagagtattatgtccttactaatactactctcatgtaacataatagaggtgtgcagagtatattttgtttgtggtcttataaaaatttggcaaggataaaacttgaaaattatgctcccaagttcagattttctacaggaataacatcagttcgagcgattttgaagggagaaaaaaaaatacagtgtcagagatgacactgggccggccgacgacaaagatgcagatgtgctccacgtcggcccaatatggccgtacaaccgaataaacagaggcccatgtccgctcacgccatctccaggacatcccgatgggctgattgggccgtttgatctccaactgcaccggcctagccagcaacggcccattaaacgccaagcataatcagccgtacagcatatgctgcatctgtgtggcgtgtaacattggagaactaggaacataaagctcatgctactgccatagcaataagtagcatgatagagcagcatatacattttctggacaggaacgaaaagaacaacaaaaacagaatcctaagttagttaggactcccttcgtcccattttaagtttatccataattattttccgtgtataactttgaccgtccgtcttatttattttttttaaaaaaaatttagaaaaacataagtcacatataaagtactattcatattttattatctcataacaacaaaaatactaactataatttttttaaaataagatggatgattaaagttgggcacggaaagttgcacttaaaatgtgacgaagggagtagtacaaatttcccatatatatatatatctagctactgcctagctagtagcttattcgatatgcgattattggtctacttaattaattggtccagtacaatgctgatcgaattgaattgaacttttaaccacaaaccgttatggaatcatataatcattcaagctagctatagctagagtacatatgacattactgatcgcgtactgcattcgatactcgcgaagacgaagaagaagaaaagagaggaaatcatcatcttgccaattggtcgatcgagaataaaaacggacagacgcccagacaggccatgcaatgcgacatgcactctccaaaaaagcagttcgatgtcatgtatgtaaggacaaacagctagcagaccaggggaagaaccccatcatttgcgtccatctagctagctaaccctttgattgccagccagccaattaactgcctagctcttgatttcttgagaaaataaacaccatcaattaatattaattgttgctttctgaaaacaggttttgctgctttctgaaaacatgttttgttttgcatgcatgtatgtaatgatcattaattgcaatattaattccacgctctctcttctgaaagaaagaaaaacaagaatgtcacattttcagtaaaggaattcgctatacacgatatatagactgaaagtctctgaaacccaactcctgctgagaactgaagaattaaactactgtttaattaatttatcgcggattttaatagggcgtaggattgcaacctctctgatatagtacacgtctgtgatcgatctatttcagggtctttgcattccttttgagacgaagctagcgcatgcagctgaaacattgctaaactgaaaaggaattgtcaagtcagccagcagagcatatataatgcccgtttttttttcctgaggtactagtatcaagcgatgcatgcgttcgtgatgcggcgaaagcaagaatctggtgccgaatggagtacagattctactccattatgatcatacacagcctcctgcatgcaagaaattcacctgtaaccatccatgcactgagtctgatcgatgcatacatttcaggcaaattaaagtgtggcagcagcagcagcagcacgtagcagcatgcatggcatccagtgcaagggaagaaggagatcgatggacgagtgactcgtgagagcagctggcctagctctgaatgaatatactactgtatatatctgcagcatgctgccatgagaggagatagctagctctgaaacgaatatatttatctgcacacatatcagtatatatatatgctcgtgtgtgagcagtgcaaggtatggcagtttggcatcagagcgagcttggcatctgcatcaggggggctgcgtcgcatgcgttgaagtggcaatggcgccgcggccagctcgccggccggccagccggcgcagcagcgcaggcatggggcttcgtcctgcgtcgtggtcacatccatcaacttatcgatcgatcagtctctctgacggaaaaacaaatttgctttgcatttgccattgcgtattcccgtttctctgcatctgcatgcctcgtccgagaagaaagcgatagagattgcgctttactactccatgtgtgtgtcttctctccttttggtccacgaaaccacgaatatatttctggagtacaaaagaaaaaacatgagaaaaattggcagtaagatcatgcaatacccggccaggccaggccatggccatggcgtcctgcccctcctcgtcctgtcttttactgcttcgtcttctttccaaccaggcacaggcccagccggcccccccccccccccccccaaacacacccaaatactcttctctttctctctctctctctctctctctctctctctctctctctctctcaatcatgtccttcatcataaactctgcatttaaacttgtgtctcaactctgaagaaacagtagagggatggatgaaaagctagagaaatggatgaaaagaaaaggctgcactaactttctcaagtgtatagtatgtgagtcatgggtgcatgttccctctctcttgctagctgctgccatggatggacctcatggtgatcttttttcctctgaaacctttttcttggcctgtctgacagggtgggggtcaggcatggggttagagcttgaaaatgtgcactgattacatatagcctttttctctaggattaggaaaggtttatatgtgtagactgtagagtagagatgccttttttgaatcttgaccatcgattgcgtggcggtcagcaatcatccatcccccaaacaaatgaccacaagcttctaagctagctaatcctatggttgatgcaaacaggcgatagtgataacatttctttcttggcttttcttaattacaagtggtatacatactcaagattagtctcaagtaagtgctccattcatggagttttataagacatatatattttaatcgtagaaagtcattctttattgattttcaccaataattcgtcgaattgtaaagtacatttactttataaaaactatgctggtagattcatatttcaaaatactttcacaaatttggctctaaagctattaggagaacattttatgaaaaattaaaaccaaatcttgatgttgaagactttttaaaaataaaatgtttcttatagttaaaaatcaagaaaccaccattgatcatgtgggcaaaggtatatatccatgcatcatatatctcgtgtatgtttgaaagtgatgatggatgatgaactatagatgaaattaagtgtttcacaattattcgagggctcaaacgaacgaatggaagattagaaagccaacaagttatttttttaaaaaaaatctaagaaatattgttaaagaaaaaaattgcaaaaaaaaatcacactgtttaattatttggagctaggaagcatgcacatgataatctagtggtataatcagaaaagaatagggtcatatatagtgttgacaaatctctttaattgtgttattgagggagttctagttcctacaaaatccatatgagaaatccaatttcagacatgcctaattaataattccatcagttgtaaatttcaacacattaggtttgtaaataatggaatagtagacaagagaagagaaagtagaatggaaaatgcatggatggtaggccggcttgggggtgggtaggtgaagatagcaattcttgtgggcagaggtccactctaactgccccaattaaaagaccattgatcccctcctccccaagcagccacagacacagccaccacactagctttggacacctctacctagctccatctgcaaccatatgcatctccaccctctccatttggaaccagaaaaccatggcttctcctgcatgctcactactcatccctacacagaaagctctagctgctgctagtttcattctagtaatgatacaaatatcaagagaaaaagtgagagtcaaatagaggtgtgaggtgaggaagatgctgcaggtagaagaagctgagagaaagatatgatcaagcaagcaagcaagcaagcaaaagttatctagctaaagagggagccttttcattttgaggggaatgttgtctggctcggggctacttttaatttctctctcttttgatatcttcttttctcgatctcctagcttgatcttttgatctctcaaatcgatcttaagaaaaagatcagtcaaagagatgagagtagatgtctgtagatctcggaccaggcttcattccccccaaacagaagggctcccatgcatatcgatcatgagctagcttattaccccctgcttttgcctcttccaaatctgatgaactgggtaagttaactgaatattgcttaactaatcagctttttgtttcatctgatggatagataggaggagtagatcttggtggcatgaactgcatgagatgcagattggtgtaatgatggggggaaagactgcatgactgtacaattgcacacttatcagagctacttgggatctcttctcttctcttctctctctgcaataattagcctttgatgagatgaagggtgatgaggaaaaggctgtcatcattaaaggcctttgttccatgcagatcctatccttcatggttggaactagctagtctgtattcatcaggtacaaataccttgcttaatctttcttctttcatatgtatgttcatctgatctttacctttgcttgggtatcacaactcttagctagcttgactgatctaaaaaatgcttttttttttatagtttttggtgatctatttttcatcttcgtttttcttcatgttctaccttgcctggtaggataatgaaacatgaagtacatatatcatgctctgtagtacactccgggagaaatatatggatatttacttcctgttaatttgttgcttggagtagatctagagagaaaaaccaactctttgcactgtgcgtggattctttacctttttctccttcaatttttgtctctctccaaataatgttgcattgggacatattaatttgattccagtttaagggaattaataggtagctagcagatttccatttatactttggtcactgaggttaattaattaattgcctataaattgttccgataactgattcacactgttcaagagaaaaggcaagctagattcatattcttcagagtaatgctccggtgcaatctacttgcagtattctactccaagtagaataatcttgaccgtttattttaaagagcaggtaagtaatctcctaatatcgtttaggggtaattttggcatgggatgttttcttctgttcgcatcgtatcaggtctgaactccgttgcacgcagtcacctcgctattcctcccccggcctagccgccttgtccgccccctccgtcgccatccgtattccccgccgtcgccgccttgtccgcttcctcagtcgcatcgtccgtctgggagcggacgagtgtggtggcgtccgagcaagtgacgatcttgagcaggagttctggcggtagtaaaaattccagcctaggcttcggcggcagcgtcacgcacgcacgcaatgtcatttgcttggcagcgtcgtctcggctcattcgtcttcttgccgtttccgatcactgtgttgtttcatggattacatggatcgattaagatcttgcacgaccaactccgacgaggatgacatggtgatcgatctatggatcggaaaacaataataccccttcgcgaattatttttcctagacaaaaacacccctccacatttcacttccactaattctggtaggagtaaaactagatcttaaccctacaattaaatatgatcaagggcctagattactttttactccgagtagaaagcaccagagtaggactctattcttcattcatggtcaaatcatgacaagggtttgagatcagcagagcagatatatctttattaatttttggtggtaactatatataatttcagctaaaccggccaagtagttaattactgtgcctttttttttctcttctgtttactttatgatccagtagctaccataaatgctgtagaaagaatatactgcaaagggcacgtagatttttaccttctaataaatgaaatggaactgcgggaaactattctaaactctcgagtggatgtcttctcgttgtgcatatatacgagatcatgatcttaccaaacaataacaagttcatatataagatgtgcatttctatgacaatatatatactacatattgattttttatattaatttgcaagctacattcatgctgatcatgatgatgagatttaattttgttcattcaattcttagaacactaatcaaaagtaaacatcggacttttgattaatctgaaaacttaaatattatcgatatagctacagtatatgtttgtcagggcactagctagctgattctcgatcagctagctgcaggggagtatatttgacaccagtgcattggtgttggtgtaaaccttgttgttatgtatcaactctgagttgtttcctgtttgaagccttgagctctagcttccccatacagtactacacccattattttttgtgtcgagatgctcatacattgagttatgtagtgcgtgctgcatgtacaaaatggtgtttccagtgatcccaaatccctaaagattctcttgttatgttgtacattgtctttgattgctatagtagctcttaagttttaattactccttttttataattctttcaggatctctcatgttcaaatgttttcagaaaaaggaacctcccttttgcctctctgttggcagttttgctctcctttttttcttcagactgttagctgtactagtgaacatgtatatagttcttcataaaaaaaaaggtaatcccttttgtagctattgcaatataatatgaatcaggagtggtgttttaattagccccatatatacatgcatgctagctaggcagctataacagccagctaatacgtgtagttgcaaattatatatgaaatcaattaaagggacgctaaatcattcagtccagggaggatgtatatataatcgatcagaaaaattaaccaactaattaatctaatatatattgattgcgtctatagatatatccacatctatctctcatttcagagaggtgataattagcgatataagtgtacaaaaccggttattacgtctgacaaagagaggttccgttaattgcagagaatgactcgtgtgagcactgaccagtcaaagcatgtacagctcgttgagtagggcacacgtgtgaatagatgcctttgcatgcgtcgccatagctacttaattacaattataatagtgtagtacatgattacatctaaattggtaacctttctcctctctgttttgtaaacaagtacatctacacgttgacagcagtaagtgcgtgtgtgaatagtgattcttaaaaaaaaaaagactactgactactgcatgtatgagcaacaggactggtgttttctcaagttggtttgattgagtatgcatttgtatttgcagataacaagtggattccacacgcatctgttaagttatatttacgtgtaattattttacgcgttcgtgaaaaatacttggttttctttgacagatgattcgctggattattgttatagcggattatctagttggttataagaaatctaaatattaaatatttttaaaaataaacttatgaactacttcctccattttgctttaactttttctaaaatcaaacttaattagttttattaaactttacgtatgtttgtttgatgttgaaaatatatattgttatatttttctatagttataattaacataaaagaaattcaaatttagaaaaacaatgcatcttatataattaatgtggaacggatggagtagtttataataagtgatctaaccaacatagtagttttttttagaaaacatatttttagaagcgtagagcaaataatctacccctccgtgagaaaaaaaaagctcacttatagtgcggttttttttaaggacggagggagcgtacatcaataatccaatgaagtagtccctctcttaaaagaagttcaattcagaggatgaatactcatccctaatattgtgtttctagagggagtagcgtaggagtacatatggatgatgcatgcaacactaatcagaaaatccattccataactatagactaattcgcgagacgaatctattaagcctaattaatccatgattagcctatttgatgccacagtaaacatgtgctaattatggattaattaggcttaaaaaatttgtctcacgaattagctctcatttatgcaattagttttattattagtctatgtttaatacttctaattagtgtccaagcatccgatgtgtccctgatccaaacaccacctgagtacgcagtagtattactccgatacaagctgtgtttagatctaggggtgtaaagttttgacatgtcacatcggatatacagacacacatttgaagtattaaacatagactaataacaaaataaattatataatccacctgtaaaccgcgagacgaatttattaagcctaattaatccatcattagtaaatgtttactatagcaccacattgttaaactatggcgtaattaggcttaaaagattcgcctcataatttacattcaatctgtgtaattagttattttttcgtctatatttaatactccaatactctatacatatcacgtgtccaatcattcgatgtgatatggtgtaaaattttactatgagatctgaacagggccatactatctgcgtacgttgatggcagtcttgacatgaggtatcatgcagatgctgagatgcagaaggaagcagtagcaacactcatgtcagaagccaatttttaagatgtgtgcatgcaacagctagcagcttccatatccatgcatactgatctggctgcctctttcatgtcaccaacacagttcatggctgttgcatgcatgcatccatcagctactccagccttttctgctttagttttgcatatcctatgcttgcatttgcatacgctcttaataactggcccatgaagcaatccaattcatatacactccagcaaatgtgctttaatttgcaaccgcagaagcaaccaatttatactaaatgatcaatccgcacttgtagatcgtttctgtttggagtactgaaaaacttgatgaaatatactgcacgtcttcagagtttcacagcttcagattcgcacagttcaatctgcgccttacggagatgatatacatacatctagaattgtatttatatttcagcactaaattgcagatcaattagtccacacatatatatatacgatcattagatacagtatgtgtgtaagtgtgttgctgaatataccgctccgtatatgacaagtaccaaagatgaaaagatcgaaaggggtcggagttttcttctccgaacccccatgaattgccattttctcttacaatttcttttagaggctctttaattttattttgtcttctccactttagttcggcccataaaaaaattctaaacacaagcgtacgtgtcaaaaaaaaaagaaaaagagaaagatcgctagctacctgtagcttgttaatcatcagaggcaaaagggattgtcttaatttggttgatgcatccagtaacactagatttattaatttgcacatgtacggcttacagaaaatggtgccgacgtcgttaattaatgtaagacgatttgctgatgtaaatacgtaaatttgcagtttatccaaataggttcggagttttcgtctccgtatcccctatggcgttctccatttcctgcagattgtatatattgatccttttcccttgcttgatttctacccccttagatttctcggattcatttgccttcgatttctcgaatatgttttcgccgaattacaaacggaagccgatcaatgtttaaacacgcgaccgattttcttctgcaagggggttcggagttttattttccgaacctcttgatctcggcagttttgaaatgaagccccgaagtaaattcggcccatttaaccgttcgggcccaaaatccttgtggtatggatcgatttgcctggcccagctaaaaagaagagggaaggactgacgcgataatctgtgccgcacatccttgatcggacgtctcactgagatccaaagggtcggagtttttttctcctaatcccctcggatcaccatctagctctccgatttagccattgagttaatccggcccacctaaagacttcggcccaaaaagaatgtgtgtgtatatacacaaaaatgaaaccagatttgcatacatgttaattagtctgtaaaatgtgtctgttatgttcgtctacgtacttatcagaacctaacgagcatgggcatgggcatgccgcccttatctgaacctgattgcattgtgtaactaaaactcttttttcttctaatatattaacgtgcaattcttttacgcgtttgcgataaaaaaaatatccgaagggttcttagttttcttgtctatccccttgaggcctttagtaaatttggcccgtttaaccattcaggcccaaatgcctcgtaaatggatcgagttaccccgattttcaaggcccatatgaaaaaggcggaaattcatgatacgcaaaggaccaatgtgaaaattttgtctcctatctaatctctaccgcacatccttgatcggacgtctcacagagatccaggggaggtcggagttttcctcaccgaacccgcgtgggcatggtaacgctgacacgtgggtcccagccgtcagcgcaacgggtgacttgcaacggcgccactccgagcgccgccgtcgccgctttctctggagctctatgcatcattgcttccgatcttttcctttttttttcgagaaatatcaatcggatctcgtccagtattttctcatgtttgcattcaggctcttacgtttcttgatttcgttcgctcaaatctggattctgcagaccagtctaaaaaaaaaattggattctgttgaatgaacacaggtcaatcagatctctaaatgatcgatcgatgcaccaagcttcaagttcagaatgggcaatccgatctacagaaggtactgattcagatttgagattcagacttgttaccatttcttctactagtaggtagttaggtaccctaccctctctgaacttctgaaatatgatccacaattgatagagagattgaattactacatgcttaattagctatagcatcatcatgatcccacacctcaacgttccatttgcagtgtctgtccaaaagaggatggaataattccaaggtttttacaacggtttattaaccatccaatattagtcagacaagaatgcacacctgatcatgcagagatatcatgtatgatcatattttttttcatgcgaaatccatcacccaaagtgctccaattatgcattgacctttagttcaaaaaagatctcccctactcccccagataaatcgaatcgacgatcatggggaggagaaaaggtgtcgtaatctcaatcggaacagttcctgcactgtatcagaaatgcatccgcgcgtcaggctatactccactggaggagccagcaagggattatgggctaaagataatcaagtaaagaattgtcactgttgagagtttgattgagctagtagcttaggcaggcagccatgatgcagatgcagtactagtactggtgtgctagctagttggtaaatggatggctgggagcttttgctttcctagccattatttccaaagttcagatcaaaggcgaagaccggcaccatccatggtgacaatggtcaggtcccattccatgcttaatacccttgctcattattagattgatctcccttttgctaccatatcgcaattgtcctttctggcaatctttcaaattaagcctgcagatttttgtccccaaagttttagggatgtatattgtagtactgtgcaagcaagatcttcagaattcagatatggattgagttcagaagctgctagcatctttagagatttgtatcttcagccagaattattgggataaaaatatttccggatatgctacagtaaaaataagcatcttatatgctatagataaccagagagcaaatttcattttcacggtttcgccaatccataagtaataaccactcaattacaatttaattagcatccctgcaatttactttcatgaagacaaacgcaacgttgttttgatccctcttctgaattctgtacggtaagccggccatagtagtcctctgtgtactttctgtacttgacaaatttcgcaaacgaaagaggtgtgcattgacaaaaaagactttatgctatacagttccaaagtccacatcctgaagagaataattccattttgttgtcactgaggctttataataatggaggccgcatgaggggagggctggatgtttgactaccacccaccatggaaaaaccttagctttctctatgcagataactttggctaaattattggagccaaagcaaagcaaagcaaagtgattgtgagtgacctccaagccgaccatactaatggttgttggtgtgcacggtggcctgcagtacaattcaggattccatctttccttcaatgtatttctagtttggagttctttttcagtaaatgcaaaaatatgatttgaaatcatcctgcatcatattctcacagtttcattctgttgtggaggaactgatggttacagcaaacatctaactaatttggactacctgtgtgcagagtctgaaaggttttcctgcatgatgcagtgtttatattcagagagttggagaaggtgtccctatcgacaagaacaaatttcatacttatgtcggcaaagacaagttaatatgctctgtattgatgctagattagcactagcattatgcaacagtttattggcagaagagaacgaatacataaagctcattattagtgttgaaagtagcagaagcactgcagctagctagtgctctatatagcctctaccacatcaaagaatcaaaggtagccttcatcagccggttcacgagccgttggaaatgatgcattgagtcccaaaagaagccatttaagaagaaaaagaaatcaacggtgccaaaacattaattgtgtcgggacataacaaacctgcttcttttccaatttgtccttgctgtccttacttgttgatgagatcgaatccgtggcttcagctccgtcctcctctgcctgcatctgcatgtccctactgagtaaacatatggactgccattagagtggaattaatcaagaaaaacatgcaatcatttgtagtcatgcaggttagctagcaaattttgtatgggtcaattattgccaatatatatatggtcataggtcataactagtctgcattgtaatttgctttgtcacctatgtacataatttaactatcagctagctataaatatatactttctctagttttaaaaagatggcgtcgttgatttctagacatatatttgatcgtcagttttattcaaaagatttatgcgaatatataaaatataagtcatgcataaaatacctttagtaataaactaagtcttaacaaaagtaataataattatgacgaatggtcaaatatatatatatatatatatatatatatatatatatatatataaattaacaacacaatctattaaaaacagagagtatgtaacaatctacatgaagaactagaggatatgatattctatatgtatatccaaaatatatatgcatccaggaatattgctagttattgctacgaccgtggtgcactcatacatggttaaagtagactgcaaatataaaattctgcgcttatggctgcatatgtaacacttacatcatggtgttatacagaggatcacacatatattttctgtacattggatccatgtaccatctcatgagacggacttaagcctagtaaccttatcaaccagtattcttagacactcacgattaggagtaacgtgctcataagttgtaataggtcagtctcatgtaagtagagatgggctataagtgtgatagattgggagataaaacattggatctggtgattacgtacatatgttacacgtgtgcacggtggaaggaggggagagaaggaagacgacttcgctattaaggtagtagagatattgtgtatatattctagtagtttttaataaaattttgggcttgccatatcaccgcctatgttgaggatacacacactacacgttgagtgttaggtgtaatatatgacgataacactcatgaaatcttatctttcttccatcatctataacctgtaaatatctttgtaagtttattgatgatttgtctaccaacacatagagataatataatggatatataaaatgaatattcatattacttagaattaaccatgcaaagcaaataaaaatagtatctacctaccacaacaaaataatgttacatatttttctttggataacatatgagtccatataacaaggcaatatagtaaattacacacgggtatgagcttttggttgcatgtaacatgtatatataccatgggttatgcagattgcaagcaatatgtataccacatgtattctatcgccttggatagatttaaggcctgcgaccttggtcatcggcgtctagagacttccattgcgtattttgctaggctttaaatttttttatgcttgccagatcactacttatgtcgtttgtgagagactgcacagatacaatgagcgagcgtttggtgtaatatgtgacagtagcatacacgaaattctatctttcctatgtcgtttataggaaccacagatgtctcctaaagttgaccggcaacatctctagtgagagatagagatatccgttactaccaggccgaggtaggtgtaggtgggtataataaatgtatgaattacttcgaattaacgaagctataagatatagatattacctacagtaaaaaaagatataaatattttgctttgaataatagagttaatatacaacatggtaaattgattctaactaattctaatatgtatggtaccacattctcaaatctcaaacacatggtgttctcactgacacttgtaagcacacaaagcctaggcaacaccagggcatactggccagctacactctacggagggatcagatgccctctccgctgtagctaatacaaagctgtagagttagtgccttgctctatctccaacagctagctacacacaaaaaaaaaacacatttcttttaaacatcccaaagagaaagctaagataaataattatttctggattaattaatatcactcctgaaatggtggagtaatatttatggggagagatatgacatttatttctcaccaggaaaatcagcagctgcaggaaaagaaacagtagaagaaaaaggaaatcaataaatcataaatagtaaaaaagagtaaaaaaaaaattcacagatagaaacaaaagggcgcagtcaccggcctcctcatatacacgcgcaccctacgctctcctcctccaccaactcctcctcgagccaagaaaccatcaagctagcgaggccacctcaccggccgccatggagatcccgccgctctaacggcggcgcgttcttgctcgtcgtcggagctagagatcgatcgaccaagctagcgtttcttcgattagatatagtcatatctatataggtagaaggatgggtgtgcacttgctgaagaggcagcagtcatcggcgtcggcggggggctcgtcggcggggggagggatgccgccgaaggggtgcatggcggtgagggtggtggggcccggcggcgtgggcggcggcggaggaggagcggagggagagaggttcgtggtgccggtgggttatctgaagcacccgctgttcgtggggctcctcaaggaggccgaggaggagttcgggttcgagcagaagggcgccatcaccatcccctgcggcgtcgaccacttccgccgcgtccagggcatcatccaccaccagaagcaccaccacggcggctcccatggcgccggcggcgccggcgccggcggcctcctctccggccacggctcgtcgggacaccacaacaacttccacatcgccgcctgcttcagggcctgattgagatgatcatcagatgatgatgcatggtgtttctttggctagcttctctctctcttagatcgatggattaataatacttagggttttaatttccttttggttaggaatttagtcatggtttgtgatgatgatcaaaaaggatcatgcatgcatgagcagatctgtcatgcagctgcgggttgttctctgttcatccttataggactctctctctctctctctctctctctcctagttaagttagattgtgatgatgatgatgatgaaaatggagatcaaaggatctgttcaatcaaaacaaaagatgttccctttcttctttttctttatttgtgaattccgtttttttttcaattttttgagatgatatatatggttggtagtattctctttctattcagaaagagcatcctttttctattcagaaagaacatccttttcctaatggttgttgatcaagattcatatatggtatagggatgaaaaaaatatatgaaatttcagaaacaaattaaacatgtctatctatatgttggcttccaaaagagtggagaaaaagaacctagctccatagacaagaacaaagagggccagctaactagctagatagcaaatgttgttttttttttctttcatctcttctaggattctagcttactttcttggttttgtccactctcagtactaaacaacaatcatcagaatttacttagtgctaagctagctactccagctgttagtgctactcatcgttattctctaaaagaaaacttactaggacaataaatcgcctactgatcgacaggcgccagcactacccaatgcattccaacacattcagagtttttagttggtgaaagttgttggtgaaacagaaaccgagaatgaacgaatggctaaatagcttatttatgataattattataggaagttggaaaatggatttgtaatattgtttagtttgaaaaacgtccggtttaatccattatccgttcatcacgaaggcagtagtgcaacagttgtcagagcttcttgtggcagatagacctggcactgtcagagatgagatgagagagagtgagagaagaatctcgagatggtagtagggagggcggcgccgcagtaggaaatggagaaggggatggatatgaacaagcaaaggacacgttgtttggccaaaaggacaggcagtacgagaaactgagaagcattgcagatcacacacacatgtaccgtacacattcagaagattcagacagataatctagtttaatttattttcttggtgattttctccccttgctaattactcccaccatcccaaaatataacggattgatacatgttttagttaattgcaaaactacctcttattatgatccactgaacatgccagattagattttttttttcatctcaacgtgcagtgaaaagtaaaagtaaatcaaactgatcagagtgctatgcggtcatcatgtttatgagaggtgtatagtttttagcattcccgaaattcggagaaatccaatccagatcattcccgaaattcggagaaatccaatccagatctagctagtggcaccaaattaagttttcacaaataattaagcaagaattgatactctagtactagcagctagttagtggtaggtcacttttggtgatcaatagggaaagagagatgtgtatgtgtgcgtaggtcagaactccatgtaatgtggagaatgaaatagaatcgtgcttgatttttctttttgaaagttgtgttcgatttggatctctccatagctgctattaaaaccctaggccattgatgtggcagcatacttgtcctcagagatgtcattctacaagctacacttcattattcattagtgttcatcatcgattaagcatgtgaaattaggaactagaatgatgttgaacccaaaatttaaggctatgaccggttgaactatagctgaataagctgtcaaaaaatgaatgacaaacataaataatttatgatttttttatatttatattattagcaattttaaaaataaggctgaaaaatagactatatatggtagaaaaacccaaaataactttcaaaattcaaattttggttgcggctaataagtcaacaagctgacaatgaagacctcgtcatccatccatatgtttcttcctttctttatgtactatattctcttcatgccttctctttccctattcataagaggtaaaataagcaaacatctactcacagtaaaacattcttgggcgatcaaggtaaggaaagaattttcttttaagaaaaggtgagaacagaatatcatcaattcatatagtaagaacatactctaatagtataccatctcgccgtatctaaaatgaaagaataaagagggatgctctatatttgccaatagttttattgacctctagaagtgcacatgagacacagtcgaatcgagtggtttatcgacggcaccaactactttttccttcgaaaaatcaccaattattgggttcaacacatcgggagaaatagaataaaactaaagatgattgaaacagccaatggtgttagtacaaagcatgaacagtggtagagatgatggaggggatacggagagcatccttttgtgtacggcaaaagaagcagcaggtggacaaagcgaaggccatagtttttttcttacaacaagacaaatgcattgtgtttttgcctgaaaaaaaggacaaatgcattgtaccatgcgtgatgagactatcttgtgtagtggagtattccatggattccattctggactcttccattcccttgcaatctttgcctctgccttggaatggcctccactgcctctcctttcaccacctggatgttgactttgaggcaatatctctgaattttccaggcttgtataaaaactgaacaattttcgactcaaattttataagtccatgaccatgacaatagttcagaggaggttccaatatattctttaggacagcttaattgagtcatgtatgggaatttgtcaccgtttgtataaaaaccgaacaatttcatctttttttggtctttgagaggagctagaatatttttagtgtaaaagctggtacctccgatatctaacactagaaaacgtgacacccatcggtaccttatcaacaaccgtaataaataaaaatgtaagtccatgacaatagttcagatgaggtttcaatctcttgtgcagttagtcatggtctcatggacttgcagtccagaagagtttgatggaaagtgctgaattcaagatgtcccttctatctaatttagtgtgtggttggcaatttataagaccagcttgatcaaatatcaatctatcatgaatgattgtgttaaagaactcaacaacgcgtcagctatagatagaagaaaatgaacggactgactcactaacaccctcgtgtcgacattaccacgtcgacctgattaagacggggtttcattgacaggtttgtattcatccacgttagttgcattaattctcatccaatctgatcatcaccaaacattttactttacaagtttcttcatcgtcactgtcagacaagtttgataaggtacagttcaaggacggttccattgcacggacacggactatctgttcctaatggcagaatatcaatcgatcagttaattctcctgtaaagatgctgtcattctctgtatatacatgcacaaaaatatattcagtgatcatgaacagtaacctattctttgcaaaatgctgataaagaatgagtttttctctctcttttttctttttggtttctgaagcagataaagtagggttgaaattggaggcttcagtttcaagttcaacgattgctgcttggttcatccaagctgatgacctagcttctttgtctgcgtctacaaaccaattagtaggttcaggctatctgattcatatggtccatttccatagatgtgaactagacatagtttttagctgaggtagggtcgcaatttggcgattggtatgaattcccaagagtatattcatccaaacgccaagcgagtaatcatcacctaaacaagtggttagattttttgaatcttgcttcagaatttggtacagttgttcgatctttctctctctttcagttttgaccttgtgaagaagtcgcaatatcatgcgtgccaaccttgtcaagcgacggtacttttgcacagtatttagatataatcatttttatttaagaaagagatggcattaagtacaccctttgtcccaaaataagttcatttgtaggtttctttgttcaatgtttgattgtccgtcttatttttaaaaagttatgattagtacttttgttgttattagattataaaatatgcatgaatagtattttatgtgtgacttacatttttaaaaaaaattatattttttcaaataagacggacggtcaaacattgaacacaaaaacccacaaataaacttattttgcgacggagggtgtagatgatataatcacttcaattgatagcaacgcaccaatcatatactgtgacctctagactaggaatttgggatatgtatgctttactgtgcataatctggttcagaaatttcagaagttcagatgaaggagagggagaggagaacaactcgaaagaacaaaatacaacaaaagacttgcatcttgtttcctgtgggctgaagcctgaaaggaccacatcttttttatgacaatgaaatcatcattaaaaacagaccatctttgattaatcggcccgtttcttttctcatcgaaatggtttcattaacgagaggaagtgagctccttcatgaacaactgaagcagcatcaccgatcgatcgagtaattctgattctaactgtaattctctcgcttgagtgatgatcagtttgacgcgatcgataggagagatcatctctgtctgacatttacaagtgaaccgagcacgatctgacgcggcattgcagctcacggtgacagcaacagagtaagtgggaaagcaatttggtgtataattcaattatataatactatataagatgaacagacaagtactcctactccctccgtaccaaaaaaaaaaaacaaaccctaggttttcgtgtcaacgtttgactatctgtcttatatgaaaattttttataattagtattttcattgttgtagatgataaaacatgattaatactttatgcgtgacttatcttttaaattttttcatatttttttcaaataagacggacggtcaaacgttggacacggaaactagggtttgtctttttttttttaggacggagggagtacgtcgtagtctgatgagatgggtgtgtgtagccatctcccagctggaaacacagtaataagttgcagaattaatcccatttccggtcgatttctggaacccatgaaagcgaaaacgagaatatgtactcagtgacagcaccatgagtaggacagcaaacttgttcttgtttcttcatctcgtcagtacacaggcagcagcaagatcgatggcgagagcagcatagagagaaaaaaaaaattctctgctccaatggcattgcaggttggagatcgcagcgatgatgatgatgatgatgatggcgatggcgtgcagtggatggagctgagttcttgcagagataatccgattccaagaccgtgtttggcacgacgagaattttgcgtgtagaactggacaccatgggagaaaactttgagatgtcattagtatctgaatagtgaatactatagtaagcatcagttttagttttgactgacgacagagcgtgtgatgaagatggtgccatgagcagaagggagttcgtagcaaccaggtgcttcgtcagagattcagaggaggatcacacacgaacgtggcgttgctgagatgatgccttaagcagcagcttcaggattcagacaattacccccatcgcaaacgaatgtcgcggtttgtattctcagcgcaaagagccaacccagttaccgaaagaaagtactccccggtttcaaaacataggacgtattttatttcattagaatacaatttgatcgataattagtccattatgatattatttgtgtgataaaaaaacataattacaagtatttatgtgatacaaaagcataatataagtaagtacttttgaatacgaatataataattttaattttatgttaaaaaatatatccagacagagtattgttgattgaagcttgatctaactaaagtggttaaggggctgttcagatttatgtcatttcaaaccataccattttttgtaaagttgctaaaaatatacatacattaaatttcttgctaaaatttagtaaatacataagaaatcctgacaaaattttgataatattgacaacttaccaaaatttggttagatttattttggtttcaatatgaacagccctaagagttggtgcacttcgctttgccatcttcaggcccatttgcaatgctgcaatacggccatagaagaatctccctttgggctctgcagtctgcaccatggctcgtttgcaacagaatatgaagaatgacagcttaagagagaagattcagctaacaaatgtatcgacaatgatgcattcatggacaaatgatttgtattttgtaggaaggtctgaaattactgggcaaaaaagaacaacatgacactatatttcttgaacaaacatatcattcgattcattacaaaagatctttacatgtattctctacaaaaaactatgatgacaacagccgacagcagcacgaacaagaataatgatcatattgaccagagggataggagcaggaggggaaaacatcaatcagggtcacataatgagcggctttaaaattagaagagaaaagaatacattttcttttgcaaatcgcttaatgccgtcttgtatttgagccccttattgtgacaccatgtaaaaatttggtaaacccgagaaagtttagcttgccatcggattttctgatccagtcttgaacgatggagtaatgagttggagcaagatttaattcctgtacagagaaaggttggtcagggtaaccgttatagttacgagaaaaaatgttacttctccatggatcccacaaaccatggtagtgaaattgcaacaatattatccacacaaacattaccctaccaactaaggcagctgtggtgtcagatgggatcatggaaatcatcataaatacctgtgctaattcctcaactgatatgactcggttgccctcttgttcaaattgctggaaagctgttccagcaatctcctcccacctttccagtgcctcaagctggtaaggactgattgctgcggcacagaactcttcaaagtccattcttctgtatgcaagtggttccaactgggatagaatcaatatacacaacactgagatcagcaacttcaaccaccaatgagatgtattttaagaaattaaaaaaaaacacaggatgcaaggagttagaaaagaaacaaacaaagcaataatggccatcagttcatcataatagctttggttgtatggctttgcaacaaaaaaattcagtatatggctttcagcattaaaggtaatgatggaattcgtatagtaatataaatatttaagcaggtaccatagaagggtgatagtacaactcttgttgtgcatcacaaattaatcacattatggtcaatatcaatcaaaatatggttaatttctactacatgtacaagataaacagccatccagcatgccaaatgagcctttgcttgacaactggaaattatgctctctggtaactttgcatgatcttgtactttgaatataggtcaatacaaattgaacattctcctagtacttaaagtcgtcggtgaaatttccttaccgcatgcaaaaattcaagaaccctcgattccttcatagcatcagttaaatatcgcgttagtgcctgaataagatagtgaattaagaggttaaaactatgatttacttacaggtaatgtaatgcacattggatgacaagtgtcatgtgtgcctttatctcaatgaggtagtcagaaataatatggtaaactcaccgtccgaaagttgtcaagtgatacaaacccatctctaggttcgagcagtttaaactgcagtttgagatacaaaagttcatcttcccttaaagccttggatagtgcctgtgacagtactcagatttcagtaataaacaaatatatggttgagttgcaccacaatttgctggcatcagcaaatttataacaaggacttttaacgcacaagtttgagcaaaaccatgtccactaattgataccacccccacagtaacacatggaaaaatgcaaggccataaacgaaagacacaacttgactatcagtaaaagcttagccaaagcacatgtaaggacaggaaagggatccacacgctttataccacacataggaatgatactgcaagcatattcagtttttccacttggcagagttaatagttaacacagccttcatcttttatttttatcattttattatttttctcccaaattagtctagggagactaacttgggaacttgacagctccttaatatatgaacatccctaacaacctgacaatagtatataacatatgcaccgatgatgctgacaattattttgcaagagataagatatgcagtcctaaccaaactaggcccttgcatcttacatacagccagccagccatgatcttgtgcatataacaaaacatttagccagtccatgcaaatttattagccagagtacatatcagtaaaatcagtgaaacatcaaaataataattacagatgcagagaagatcatgataatctataacgaacctttaatgccaaccgtttaagaggtgtagcgcggaggtattgcttaattaatctgaagatgagtatgtccagcgggatctgcctttgttcatctcgcaaccaaggatgagctgccaaagaaaacaagtgtcatcctctcatatacgatttatgatagagaaataaaacaactagtgccatactacacaacagttatagataataatgttgacaacttactcagtgcttgaacagcggtcattcttttgcggtaatctttgttcagaaatctcttcacaaaatccttagcttcagctgatactgtaggccacggtgaatcatcaaagttgggatcagctctcaacacagatcggaatattcctgattctgttcgtgcccagaatggccgactgccacagagcagaatgtacgttatgacacctatactccaaatgtctgcttccatactatatgatctgtgtaaaacctctggggcaacataatatgcacttccaacaatatcattaagcctttcatctgcattatatagcacaaaatacaaagaacaaggtgtctggtcagctaatgaaataccaagcaacagtgaagagaaaaatagttagccaaagttcattaaaagcatcaggacacaagccacaaaaaatgaatgatgcattgtcaacctggaatatagataactcagattaacgtaaaatgaattagcccaggacaggatgccacagcacagaatgtaaacaataggcatgaacaacaagccaaggtagtctatataaatcaagattatccacaagccatacctaatacggaatgcatgttagtacacacaaagatgaagactagtttattacctggtctaatgaaatcagagagaccaaaatcaatcaacttcatgggagcattttcatccctggttgtgaaaaggaaattctggacaaaagaatagaactatgtcataaaaatagcctagcattctacaagtataatttacaaatgtgactgcatacgtatacgaatgtaaactacacataaattagttccaagatttcaaagcacacctctggcttcaaatcacgatgcactaccccctgaagatgacagaaggctactacgctcaaaatctgtacaacaatcgctttggcatcttcctctgtgtatctcccgcctcttcaatagttcaggttagcataattggtaaggattaacaaatatacagagatagtattagtttactactatgcataaagaaaaatgtagaaagtacctggctaatattctgtctagcaattctcctccctcacataatctgttaaggaaaaatgattggaaaatacttccttaacaatattaaataaggtgcgacaaatagtgattttctgcaatggtaggtagtagactagtagataacacaaacatcagtagatagaataggaaaaaagcagataataataaagtaactgtggagctcatagacaagatattttgcatgcgtgtcaagtaatctgagatcaaatattgcctgtagaaaaatcttaagtatattggttaaaattacatataaaagtcataaaaaaacatactccatgacaatgtagacattgaggccatcctcacatgcatcatagaatttgacgagattattgtgccctgataacgctctcaaaatttttacttctctacgaacatcctcaatggatattgccgttgtcatctgccaaacacaagagtaaattgttaaaagtaagttgctaaaatttttgtttcagttcgaagaactaggcactgcaataaatttataggtgccgttgtgaaggtacttgcaccattgcagttcacatcaatgaaaagagaacaaacaaatcaaataatacgataagtaggacccattctactacattgcatgctttcatttataaattattttataaagttggatcaagggaaccggagcaacaataggacacttgacaattagctgccctgcggaaatcccattatttatcatgttaaactgctgctaggttgagttgaagactgattataagaaacttgcgctgcatagagtaaacttaatttctaaactctaaggaaaccatttgtgtgttaaatatcatgtcggtttgatctttgacccaagaaagggtctcctgagatggttactaattgataagtgataacaagattaaccgtatgagcctcccactagggctactggacgtgctaccgaatcttccagttagtttaaaaatggtttgtcattatctcaaggtcccagatttttggcatttaatgcagtctgccagcaaatatttagcttgtgatatatttaactgtttagacaacaaacatccagaatgtattaaaaatatttctaaaaactatgaaacagttttcttcaaataattaaatgatttttctgaaaggctaaaagtaaagcagatgcctattgatgttcagattccataaataaaccagttggaaccaccgatactcagctatgacatatctgatatcctaaaaagcaatgtgaatatctgttgtggtggtagacaatcaggccaattcatattcagatcatgaatcatttcgaattatgtagtgcctgatccatgaagcccctgacaataaataacaaccaaagggcactctacccatttttgttgtatcactcaattaagtaacagtaccatatgccatgtgtctcctaaatcaactctaagctctgtagcctccttggatctttctccacttcaaatgtctttagtacatgtcagcctgcagttgctgtgacactacctcccactgattgtgaattgtgactggcaaatggtgacacccaaaacctctctttcctatgatgtgcttttcgaaactaccgtctcatatggactaaaaataccgataattgatcactagaccagtgtattcatgtcagcttttccccagatgtgtcacatgaaaatccacctcaaaatcgacaatccttaactaaaagccaaaaaggacagataaaaaaggtaggttaggacatgtactgctgattggttagaatatcatttatcactagcaacgattggctaagtcaccaatttaatcaatgtactagctgcatccaaaagcctcttcacaccacaaattaagacttgggtaactgttcgtccctcacaaatgcaactatcttcccctactgtttccagtcaaaaaagaaaaacaaatgtaactctctaaaggaggaaaatgcagaaatatcctggttcaaccttactgtctatttctctgaaagacaaactcctcaaaaaaaatgaaattgaatgagataatcctactccagaaactgagcaagattaaccaatcgccaatgtagaactaatgtggcaaaatccgagattcgcaatcttccatttgtgccagtatccttggggggggggggataatataataagacaaaattcctaaatctcagttacttctatccttcaatctcgatcatacgaatcataacactgacctagatttcagttatttcttcaaaaatggcgcgacggcaacaactaaattttgaattcatgaaacaaaaaggtgaaccagagcttaaaaaagcagcttatcaccaccagcagcagcgagctctgaccttagctttggcgatgatcttgacggcgacggtctgtcccttgtactcgcccttcttgacgacggcggagcaagtgtgtccgaagtggcccctccccacctccttcccgagctcgtacttcgcgccgaagttcttcgagaacccgaacgtcttgtccaatggcctctccgtctccgccccatccgcggcccctccaccgccgccgccagcgcccacgcctccctcctccggtatcgtcccttccttgggcttccccccacccagcctcttggcgagcgtggcctttatgtgcttggccggcgacggcggcgggaacggccgcttgaagaacctcctgggcgtcgacctcgccggcgacggcgacaccccggccggcagcgggctcgcgcccccggacgggtacgggctcggccacgccaccccaggcgtctggtgccccggcgtcgtcgatccggacttactcccacgccgcctcggcgtccccacctgctgcgcctgcgcctgcgcctgctgccgcggcggcgtcgacggcagcccgttcgccggcggcggcgactggtgctccgtcaccaccccgccctcatcgtccgccgtcctccccgacgcgcccttgccgtagcactgccccatggcaacaacaacaacagcctgtcggcgcgcgcgggcgcgggcgcgggcgcagcggaattagggttagggtttggggccccccgcaccgccgcctcgcgaggtggaggtcgaggaggtggaggcgagtcgctcgttggggaagaagaagaagaagaagaggagagagagagagaaatcggaaatggcgttcgttaccaatttctctctcctcccccacctcacctcgggcttacattacatcactccagggaggcgactgtcaattccacgttttcccaggggccaatgtgcaaaagtgccaggaaatatttttttattgtaacgcctttctggtggcgggtcccacgagggggtgggcccacgcgtcagtgacccgttcgtggcgccgcgtacggaagccgtgcgtgggaaacggaaaagggggagaaaggggaggtggcaatgaatgagtacggggtgaatgacaggtggggccgtgtggactcgtggcgggaggtgggtggtggggggagtgggtgtttggtgtttgtgtgtgaggtggggtggtttggggggcgctccagaaacacggcgggtggccggggcagttgatgcttccgttgtccacttgtgtgtctgtaccccgtttttattacacccccaaaacctgcctctctctctctctctctgctatcaaggattagtttgtttcttcataaccttgattagtttataatgaaatggatcactagtttattttccagtacatttgaccaccatttcaccgtggctttaacctctcacagtttgttctacggtttaggtggttttcttttctccagaaaatgaagatgatgaagattaagttttttacgtaaaacgaggtggtatttacgtatgatttattaagtataaattattacaaacttgaaaatagattaatatgatattttagagaaactttcatatagaaagttttcacacaaaacacaccgtttagcagtttgaaaagcgtgctacaaaaatctttaacttcatccgactcttattggagaaatgaacaggaccttaatgaaatggattactagtccttaaaagatgaacgaggcaacgagatataataatatatgggtaaattattatacatgtgttcttacttcttagcgatttactaaggggttgttcggatttatgtcattttaaaccataccaaattttggtaaagttgccaaaactttgcgtctatttagttttttttatcaaactttagtaaacacataaaaaatcatgccaaaacttggcgatattaccaaattgccaaaaatttgacaataatgtttattttgactataatcagaacaacccctaaatttcaatgctgaaaaataaactacgacgaaaaatgcttaaaattaactctaaaattaggttcgaaattcaaatttttgttgcagctgatgagcccacaaacaaactattcctctagagttctaaaggagctcttggattaaaaatgaggtattcagatattgctctgaaaattcaggttcaggcatgtactgaaaattgcatgacctgaaaatctttcagaagagtcagtgttgcagtaatcatttcgagcataatacgacttcgttgagttcttttcgggaggagtaacgaactgcatatattgatttctaaagtgcattcaaagaccggatcaaatgtgttcctggaatttgaccgcacggtgagtcttgttcgtttctgaatcttcctctccatcttttccatctttcgatgtgttcagttcatgaagacacttgcagtgacgtgccttcgatgcaagcgtgttgacatttctatctgctattaatcaaagatcggtttttttgactctttcgattcaaacacatagagctatgttttgctggactcgccaacaattgtttgatccgttgaacaatttatgttttaaatatatgataccaagtcttgagagccttgcctccttggcaggttaggcctgaaaacctttgaattgtcatgtaaataactcttgcaagatgaaaagttcaactgtgcaaatgatacaggttttgaatgtgtccatgcaccacctgacatttaaaaagtaaataaattgtatatgacaatttgtagcttcttcaaagaatcatatactcttttatgtttcataaaagttagggattccatcccctaaacaaaatgatttttgccatatagtagtagagtactagattgcaagctttgtctgataagatggtgtctgacgggattcgattagctttcgctaccataggagtttaggaatatcacagaagaacaggttgatagaacaagtaaaaaaaagaggcctgatagattgacagcggcagcttgacctgttgcaaccagtgatttcatcttttgctatctactgtggaaaggaagaaccatgtgccttttcaaaagagattttgcccttcttcaagacaagatcatctcagatgcttacagcgccattgattttcaacatatgtttaactatttgttttattaaaaaaatatgtactcattatttattttgttgtatattatttttggcatatctgtaattttttgttaaatagatgaatggtcaaacgtatatctaaaagtcaatgatatcgtgcataaaaaactgaggaagtatatttttttttacttcgtgcttagcatcgcgtgtgggatcatacaacaggagatgggagtgaaaaataagcagaagtggcaaaaggttttatattctgtctgcatgcttttctatctttatccaaaaggcttgattattaccatatcattgtcagtgtagcactgtacttatctccttttttttaggctgtcagcaaaagcccctttcattgccaaatgacaagcttctgtgcattaatctgaagaaagaaattacaggagaagatttcttctgctgctaaccagggcttagaggatcattaatatcctttgggtccaatatttcttctcctctggaatatctctgaaatttttaattacagagtatgcaccaagcctttcctgatgactacatttaactgtagatgaacacgacctcatcttgtttcagaatacatattctttttgtacttttatcttggtcagaatacgctgcaggacgaactaatccaataaaaaatatataaaattataaggactattaattaatcaaggcatgtacttagatactttctggtgatgaatactagctaagcacgtgtgtaatccctgtggataggttgatgactgacggtgacacttgagcacttgtataatactacgtagttaagattttgtatctaataatgtgtcatccatgatgcaattggcatgctttttgtatgcctacctgaagcttttgatgctaacacatttcttaatcttgcatatatataattgcagctgcaattggatcatatgatcgatatctgtgtgcatatttaagcatattcatgtcgcctaaccgcgtttaggtatagtatttgaaggctttggaaattttctttcttttggatttgaatgcggactgcgaagctgagctgcgccaacctttgagaagtcataaattttgctgacctaccctctcgttatgaatcagatcaatgtttgtctctgtaatgtagtccaaaccaagcttaaaattcattatttcacaccatgtgactatgtgagccatggccacctcaccatgaatggtgccagcaaatttgtcgattgagctttattgttttcttttagttgacacttgccacactgtacaattgattagtaccatgtattgacagacgatcaatgatattatgggaatcaaaattgtcgagtgtttccatttttggtttttaacgaaattattattattattattattactcgaagattgttatgtaatgtgttaaattattgtgccacaagaaggagcgaaattacatgatcttcaacaacttatgcagagttaggatgcacacagctaaacatattcacgcttgatgtaatagtgcttcctagttcaattagcccttaacttcatttctgctctcataaatgactagaggttttctgactagcttcacaaggtggtgggctaggcaacttgggttcgaagcctcaccccttctaattatttgatattagttctttccctaatattcacgttattttgtaacttcatttcctctctccccaacccctatggccgccgctgagtggatcacatcatgtataattaatagtacaaaattttcaatcctcctaatatatcaacacacaagccttttgtccattcgcgaaaaatgtaattatcatgtctggagagtttaaatccatgataggcacatggctaagttccatcagcaattaggttgagagcgtcttttcgcgacgaaaactcgcacctttggcatctgcttcaggaagaaccacagtgtatagtttgaaaagatccattctgtcctaatattttcttttgaaagatccactctgtcctaatttcgaggaattattagccacagttgtccattctaacagccacaacttttttgatcagttgagttactgaaactgcacgaaactggactagacttttttttttctagcagaagaacaagttaagcgtcttaatcagtggctgctcatttcagtggccaaaagtaaatcttgcgactacatatccagccgtttgtttttacctgctcaacagatttttcacaccagtgtagctgcaataggattactacctctgttctcgaaaggatgaagtcttaaatgcgtagaaccaaatcttgaactcttaaatcattaatagattacaaatattaggatttaatgtgtgaaaatgcactaataaatttgtcaggaaaaactctttcatacggttatattttcaataaattttataaatacataattagggaaaatgataatgataagacatgcgcattggagattgcttcgatgtccaaaagaataagtaaaaaagaatagaggtagtaataggataatttgtgcaataatttacacaactgtagctgcctcagtccgttttctgcatcagggaccacctgcatcgatctgtacctcagttaatctttttcttctatttaaataattttccaggtattctgctgatgattcatggcttgtcattttcagtgaacagctatcaacattttaatccagagaaaaagatgcacgcagcaaaatctggagaaaagctgagatgagctgctgataatggattcagattcaggcagagtcagcagtgttagctggaattctgaatttgtgtctgaactgtgaggcaaaagtacagttgcattgcacccacaaaactccagcaggaagaggcgtactacgagaagacgaactcgaacgagtaaagaaatcacactatcacaggcaggaagagaaggaagcaggtacacagtctacagattacagaagcatctatctcctcgtctccatctgcataattaacaaactgacactgcaaccacaccactccatataatactcctactgctccattggatgcagtaaaaaaattgtcagtgctagctgctcgtaattggcgctcattagcagttgcagacactgacagatgaaggttccaagccattaaacaagacccaacctgcagcaagattcagaagagaggagcctgtggtagttaatttttctcgctgcttattcagagcagatcatgaaaggtccgggagttaaatctcccacacccaacttgccatccacagagtaaatgcagcgatggacaatgcgaaatatgcaatggcatccttgtctgaacttgtttttggttggacaaacagagctagctttgacacttgctcgagaaattccttgcatgccagtctgccagcaatgaaccatctcataggctgtatttagatcgtgtggtgaaaatttttaccgtgtcacatcggatatacggacacacatttgaagtattaaatatagtctaaaaacaaaataaattacagattccgcccgtaaactacgagacgaatttattaagcctaattaattcatcattagcaaatatttactgtagcaccacattatcaaatcatggagcaattaggcttaaaagattcgtctcacaatttacatgcaatccgtgtaattagtttttttatctatatttaatacttcatgcatgtgtccaaacattttgatgtgatagaatgaaaaaaacttgacagggatctaaacaggcccatagtagagtgaagcagtacttgccacaagagtaaatgttgctactagatcagagaagaaaaaaaggcagtgctgctgctcataaattgggctactggtaccatgtccattctgcataccactatgctgcactgtatcatgagctgtagtactgcaagtctactaccactaccttagtaccatgtacacatatgtacgtttgaatcatgtataaatgtacattattctcctgctagtgattgtgaaggtgaggaagatgaacactgaacaaactgcactaactgaaaattgctctcaccagggaaaaaaaaaagagacagcaactgaaatactacaagtcacattttatatttttttttgccggatgtgctacagttgtttttcctattgcctcaccttcctagcttgtactgttcataactattttcatcttgatgggaagtgcagatattctccttccttaacttaaaaaagataagtacacaaactttcagtcaattgaagatgacggtgcagccgatctcgatctacctaccatatagatctgctcattattataatctttttctttaaacatagaaggattgaaaaaataattgtgagaccaaagaatttgtgtttctcatctaaatatctctcttgcagtacaaataagactactggcatatagtcaaaggttagcatgttattaggacttttgtttattcatcgtgctacatacgtagtattatattctggagacaacaacctcaacaagtattcaccaatactgccaagatgactatgaagttgagaaatttgaagtttctgtcttcaaactatcaatatctgatatctcaacatccacgcatttacaataatagggatgtccaatgaacattattgtacgaaaatagcataattgtctaagagcatttgatgtactaaggtcaacttgactaggtcaaaactttgacttcaacagtacattgcatcgatcagctatattggtttcatttttccaattcacagtacgttttttcgtatgtcaaacttttcgacatctgcacaggccacatgcagttcagtacacatgcatctaaaagaaaaaaaatgtgtttaatttgacataaattttgggctgtaagattttgtttcctgtttagacttagaggcaccactgtaaaaggcctcttagccttaatggtatattttctgtaatccggttgaaaattttcatgactgttcaatgtcatacgacatatccatcacaaaagaaaaaactgactttcattccttcgatgggagaaagctaattctaagttttctaacatcaaacttctgcatcctagttaaataggcatccagaaggattagcaaaactattttactcgcagacaatgagtgaaggctataccttaacattgccttaattatttagttcatcgatcgaatacaagtgagatcaatatcattgtacgtaggtgatttggaagagagctagacagctagctcctcttatgttgcattgttgctagctagtcactgtcacagcaatctcaatctcctggctttgtctgtggtgttaatatataggttaggctcttaactgtgctccttaattaaggtttgactaattggaaaagctaataatataatataataaaaattaggcgagactaactaatctccaagtcttcagacttcgaatgggtggcctgtctataattaatcttgtttcatgctttctgcacaacatgtacatcaaacttgcagttgaaggtttgaaaatttgaacttgttatacgcagaatcatagtctagtcaagctattctgacttgacctatcatcctatcatctcgaactatatgaagactcagcgggaaacagcttagttagtgtgtcgccgtcttttttcctgacttgtaaagaaaagaaaatatttaacctcaaatctgaaaattgttgaaacaagctggcactacatagaaatccgagacttaccgaagctttgcttgataatttaggctgtgttcggacatccattttcccaacctatctccctcgttttccgcgcgcacgcttttcaaactgctaaacggtgtgttttttgcaaaaagttcactggtggagaaaccatctttcgttggtcggccgatttccacaatagtcccggatgcaataaaaaccggggcaaaagatgatctttagtcccggttcaaaagggtaacgggcatatttgatctttagtcccggttcgaatgctgtcaggacctgtcaggcccccccgggatctttagtcccggttggtagcaccaaccgggactaaagatcttaacttaccaaccgggactaaagatcccggtgatctttagccccggttggtgctactaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgactggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaactagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacagctaaggcgtttgttcaggaacaaggggaatgctagaatgttgcgatggcacgctgaagagcgtcaacaggacggatgctgagacaccccgccgatggttcgcagtggcgaaacatctacagaaaatttaannatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaatagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgtcgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtctatcgcgacattccagggatatgagatcaatgggtacacattctacacgagagcccaagacatgaagagcatgaaccaaaacagcgttgttcgtgtcgatgccatgggacacgatggaacaactgccacgtattacggtgccatcgaggacatatgggaacttgactatggtcctctcaaggttcctctgttccggtgccaacgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcggttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggagtaaagatccaggggtatatatattcccggtgcgccctcgtcttcttcaccaacacttaaaagtttggccgatcgatctctctcggcctctgtccttcgccgccactgcctagggcaaatccccgcgccgacgccgccgtatctcgccgtcgtctagagctagtcgtcctggccgccgcctccgcctcctccgctgccgccgcatatatggggtgagagcccccgcatctcccttcatgcatctcgatctctccgatctcgatctctctccgtcgccttcaacgtcgtcgcgttcgacgccgccgctttggacgccgcgcaacgccgccgccgcatgccaatgccacgccgccgccgctgtcgccacgccgccgccgctttcgcagacgcgcgcgcaataccgccgccgccacgccacgccgccgccgccacgccacgccacgccaccgccgccagggccccacaacgccacgccgccgccgcggtcgccacgccgccgcgccaaccgccgccccgatgccgccacaccgccgttaacgaacgaaaacgagaacgatcgaacgaacgagagccgagaaacgaacacgtcaaacgtacgttgccgcgacaacgtgaacgagaac

SEQ ID NO: 66776 - DNA, 17695 bp, Oryza sativa
ccaaaaataccatcgccgtcaaggtttcgtccattttgcgccattaaaacacactgttcatcatatagaacttaacagcacggaatggacggaaacctaacggcgatggtatttttgagacaaagtcgtttgtacgatggcatttcttgaaactcacacttgtcgatggcatttctgggatttgaacgcttgtcaatgatatttcttggattatctctataatcaaagagtaaataattcaaccaaccaagtggatttaatgaaaaataatggcatatgtggtgcataatcctagttgataatacacaaaacaaatttaaaacgcttgaaaactacaaaaaaaaaaccataaacagcatgaagccaaaggtattgctcataagaaaagagcacacatatgtggctattataaaaacaatggcagccaactgcattataaaatatatgctaaacagttcttattctctactattataaaatttgaagatgtttttgccagtagtttggtacatcatccgtgtatgagtcagtttttaagtttgttcgcttttgaaaatacatatctatattagagttggattataagtttgttcgcttttggaaatactttttaagaaatctttttaaaaaaactcgcatgctaatttgacatgattttctagaaaaatatatattcaagcgaattctcacagtgaatttcacagtgagtaataataagattaaatagcattcacccgttgtaacacacgggcacttttttctagttaacttcaatatagaaaagttatagtataagctgtaaagttcactgtttgcctcctctttgaagtgcattataccaacctttataaaaaaaattgtgtaattactaaaaagaggatttgaaaggtattggacacgtatccactcacatagtgcaaaaactaatatgcttaaaccctaaaggacacgtagtaggccacacctgaaaaatgggttttaaattgccaatgggcctcaacccaaagatagccatttaacgatagccttaaaataatcgcagcgccgtccgtcgtcgtcctcgccagttcatcttctaaaatttcccctttcgtactcatattaaccgccgccgccgccgccatcctcaaatccagagcaagaaaagaaacctaatccaagttcccactcatttcacctttgacaaaggagagagaaatcactttcgatcatagggtagtttcatatgtcaatgagattaccttgaaggaagtggtgaaagaaggcgtgatcccggcaaaagaaatcatcggatggcgtccagcccatggtgaggagttcccgactccaaacaccatcgagattgtggtatttacccctttgttctctagtagcttctgtcttccgacatctaaattcttccgtggtcttgtttacttttatgggagtaagatatatcatcttaaccctaattttatcaatcactttgccatctttgttcgtctctgcgaagtatttcttggaatccatcctcatttcatcctcttccgtggaatgttttacctgaaagcccagtcgactaaagaaaacccttgcatcatcggcagctcttgttatcaactacgtggagctctccgcaaacgcaaagactatttttcccttcttcgaaaacttgcaagaaaggctggcattcctgtatggctaccttaaccaccgcggctttcgtctcgcacaattaacatgtgtccagagatgggcctagcgagcaactcaaaagctagctcgagctgcctcgttctgtctaacaagccaatcccatcgcacagcttgcgagcgattctaaacaagcctagccgaatgagctaacgagccagttatttttccagccccagcctcagccttactctccatggttcgatcgtgtcattgcttatcctgaaccataataatgttctgatagttttctgctcattcccaacgaattgggcgtgccaaagagcactgtattacagctttagcatttgcataatatgccaagatctgtggtgttgtagaggaggagaataacaatatctacgcgtgacacccatccactactatagaaaagaccattggttccggttgggaacaggccgtaataggcgtcagatttctcaactggcacccggtatacggtgctgatgacttcgtcaacaataccggttatagaacttccaaatgaaactaaacagcagtaaaggatgatgtcgacggggggctacagcattgccacgacgaaagcatccaaaagcctctattaacgatgtgcacatcgcttgacacactgactttaccttctcgggaacgacacaattcgaggttttctgatgagtcgtagattctgcttaggcatcaccggactcaaaaacatttgacatggagcactccatcaaatctgaggagcacaaattgcaatcctgtcgccaagagttaaacaggcggtctgcgttcaacccgaacggagtgctcaacattgttactgctacaagtaaatttagaagaagtccccacaatccagccaatttcaaacatggtcatatttggatggaaacaaacttctgcattgttacatccagccggaacataatagaggaattttttttaagagaagcataatagaggaatttgaggagatgacctgcaagtgtccccgacgactcatatctctgcatgcctggcctcaagcatcaatctagcatatcctgcaagaagcaagccttggaatctacaccgtaaaccaacgctagcactccaagtataccagcatattaagttgtgatccaaattcatttgtacataataaaggctagcttatgccggagcgaagcgtagggtttgtgcatttggggatgcccgggcccatcgttatcctttagggtttcaccttcatatataccttttgtaagccgttgttcagctgtaacctcatcctaatatagtgaagatattttgatggctggcacccgtggtgttttttcttctgctttggagggttttccatgttaaatctcgtgtcttctgtcattgatctattattatttatcgtttatttgcgtatcgttttctaacacctttgtgttgcaggaggagaagaacaatgaacacgtgacaccattcactgcataggattcaggccgtgttaattaaatttcaacttttttctacaaacttctaacttttccgtcacatcaaatgtttggacgcatgtatggagcatcaaatgtgaacgaaataaaccaattgcacagtacgactgtaaattgcgagacgaatcttttgagcctaattacgccatgattggacaatatgatgctacagtaaacatttactaattaggcttaaataaattcatctaacagtttatagacgaaatctataatttgttttattattagtctatatttaatacttcaaatgtttgtacatatattaacatacgatgtaaacacagaagaaaagggagtatactgcatggtggataggaggcgatacctgaccgaaatttgtcaactcgactgtcaaataaacagtatatctttgacgtttcttatacgcgtgagattctttatttcggccgccaggcgagccgatctgcttctctactagtactactggtgctacattcttactgaaggtgtgtttaggctgtgtttagtcccacgctaaaattagaagttcaactaaaattaaaaatttaaagaaaaaagttaaaagtttatatgtgtagaaaaattttgatgtgatagaaaagttgaaagtttgaagaaaaagttaggaactaaacaaggccttagttcacgtcaaaatggaagtttgattaaaattaaaacgatgtgacgaaaaagttggaagtttatgtgtgtagaaaagttttgatgtgatgaaaaatttgaaagtttgaagaaaaagttgggaactataccaggcctgagcgagtaatgctacattagtactattctctcgaatctatttatctattaaaatactttctcgtttctaaatatttaacaccattgactttttaagcacatatttgatcgttcgtcttattaaaaataataattacttaatttttttaataagacgaaccgtcagacatatttaaaaaagtcaacggcgttaaatatttagaaagggaggaagtattaagttaactgggagatgatattgattggatccagagaaattgatgctccaaacgttcattctcagtgttagtaaagtaatgaatttaatggatggcgtgatagtttcagctatatatggaccttatcaagattgatttgcacagtacaagattttggatatatataattatctcaataatagtatatgctataaggagcgagagagatattcacaagcattggttgatggtaacgtctaacagaatgctgccttgtattggcaaggtacattcttttcttttttaattaatcatccgtatgttcaatttgatttgcatatacgtatatgctttaattggagctcatcctaatatttctattccgggattgcctcggtatataagaatcaagtttcaacatcacaatatctatcaagtgcttattactctcttcatctatctcttcatctatttttgataggcatatttctaaatctgtaaaaaaaaaattgataggcatatttttaatccaaccacctgtcctcccaatgactttctcgaatttaatgcgtgactcttcattctttcacgtaagattggctacatggatatcgaaaaatgtaaatatcaatgaatcgcttatttacgaggaataactagtagcatgtttaaatggatgatatgtagaatttcttatccttgatcattgtattacgatgaaatatgactatgaaaaataaatgatcattgtattaagatggaatatgactatgaaaaataaatagagggagtactaattaacttgcttccataacccgaataaatgtcatcacataacaactgtgtcagagcatctttaatggcccacaacaaaaaccatataaatcacgccacataccccatcaaataaaaacttttaagttactcgggggacaacatccacttatttattatacatgctaaaatgaatataaaagaattgaaaagatatattatttgtacttcgtaatattccacttaaaaaatatgcaagtttttttaacttgagcttctaataaaaacaacatattgtaccatatataaatatttatatatacaagttatagtttaatttattttttaattgaaattaaatctcgtagtgatatatttcaagtaatatatatttttttagatttttaataaccacttagttataagatgccataaaaaagtggaccccacatccatttgtcgcaacagtcaaacctcagcgcaacgatcttatgatcagcatgcaacacgagaatgctttacgtccacactgcttacactgactgacacatcgacgttgccacgcacatgacgcatgccactactcatcgccaacgtccgatatttcgtcgtcgtcgtcgccgccattcgcagcgcctcgcggcgacggcgagcacaccctcgccgccgtgaacaccttccccggccggcagaagtagcccttctccggcgcgcagtgcgagtcgtcggagcacacgcagagcccctccatggcgcagccgtcgccgacgatgaccgggctcgccccgccgacgccgagcacctggtcgctccactcgctggagaagacgccgtcgggatcgaacctgtccttcaccctcatgaacttgccggcgttggggtacctggcgatggcgccgtcgaaggcgtagttgcggttcttgccccagtgcggcacgccgccgtgcttgcgcagcgccatctgctcgacctcgtcgaacacgtcggcgtgcgcgcgcggcgcgccgcgggcgtagctccggtagtaggtgacgtcgaagtccaccgagtcctccgccttgccgaggtacgccgacgacgccgcgacgtagcgcatcagcaggcccatcttggagtcgatctggcagaacgccgccgggttgaggtcgcggagccgcgcgacgtcggcgacgaacgccggcgcgcgcgacagcgcgatgctgaagccggagttgtagaagaggtgtccccggaggcggccgttccagaggcaggtggaggtggggatgtgcccgtcgtcctccatggcgcccgtgcacaagctcgacgcctggatgcggtgctggtagcccaccaccgggtaccccgtgaaggcctcgccgtcgttggtgagcccgtagttgaggtgctcgagcgtcgccggcatcacgcgcgacgccgcgcaccgggcggcgtcgctccctgatctctcctccagccactcctccgcgagcctgctggcgacgaggggtagcgtcggcgtcggccggaacgccgggtagtcgctgcggccgtcgccgggcgtcgcgacgtcgacgcggtcgtcctcgcggtacacggccacgcgccgccgcggcagccacgccacgtcgccgaactcgtggaggcggccccacgcggcgaccgtgtcggcgacgtccgagtcgttgcgggtcacgaacgccaccgaccgcttgaacagcggctgcagctcgagggtgacctgggagatggcgccgaggacgccgagggagaccttggccgcgtcgaggtccgggtcgccggcggcgagctccctcaccgccgcgaacccctcgctcgccggtgccggcgtcacgatcctcatccccaccacgtactcgtgcacggcgctccccttcccccacagcgagctcccgtgcgcgcccgtggcgagcacgccgccgatcgtgaggcccgaccagtacggcgagtgcggcagcgcgagccccgccgcggcggcctccctgatcaggtcacgcatcaccatgccgctctccaccgtcatcagccgccgcgccgcgtcgacgcgcaccgcgcggtccagccaccgcgtgctgatgacggtgccgtcctcgccgccggggcacgccagccgcgggaagctgttggagtacctggtggcgaccttcaccttccgccccgccgccaccgccgccgccacggccgcgacgagctcctcctcggtgcgcgggtacgtgacgttggcggcgcggcagatggcgcggtcggagaaggagccgtagatgttcgtcagcgtgcagccggacgtcccgttggcggcgcagaccaccggccccggcggcggacggtcgccggcgaggtgggagacgatccacagggcgagaatcacgaggaggccggtcagagcttggaggagaatgacaaggagacgtctcaccattgttgcttaacttggtggaagctctgagtttgacctggaaagtttgccgggtagctgcagcttaaatcagcaagcttcagcttgcccacttcatttctgtcggtggaagcatcagaattcagaagttcaccagatggagtactattaatattcagaagttcaccagatggagaggaacttatttccgtcttgaggccagaaccttctgcttgaaacatttaataaacggagaagcgttactttgtacgcaaatcgtacacacaaaatcgtacgaaaatcgtacacacaaaattgtgaataatcgggaggaatccctttttcaccggttctgggactgcccatttgctaggtggatttggcagaaattggaagagcatcgaggtgaggacattccacaaccgccagctgaatgcagaaacaataaaatcttatctgtttggctactggatcaactatcaatacagacacaagaaatctcttcagtgctgttagttacaatctacattatgtggtcagcacggaatgatgcacggaatcaacagatcccaggtaacccagacaggatggtggagagaattttgttcctcctggaagagtgggcaagtttgtttgaaaaatctgatcatactgttcctagtccgacaatgcactggaggttgccggaatcaggatggattaagctgaattcggatgggggatttgctgcagacgaacagatgggaagtgggggagtgatagcgagaaatgatcggggtgagtttatgggtgcgagcaggattttcttcagggaagtgttaagcgcaacgcatgctgaagcattggcttgcctcgaagcgacgcgggtgggtgcaagacttgcagcaaccagagtagtcttcgaaacagactcagctgaagttgtgagtttggtgatgaataaaagttttgatcggtctgaaatcgggcctgtaatccaagaactgaagaggagaattcagtcattccaggatttcaagctcatatggaccaggagatcggcaaataaagtggcgcaccgtttagctaaggaaagccttaacgcgcgtgcttcttctagctggatagtgtcagcaccggagtttttattttctctgttatcagaggactgtaatctggatgctgtaatttgagtttttctttgctttccactctcaaaaaaaaattgtgaataatgggaaacaaggttctgagaagataaatggctcggaaacgtggcttttaaagacaaatatccatctttatacgctattgtcagaaagaaaagttctactattgtcaatgttatcagatctattccactgaatgtttcctttagaagagttttagttggtcagattcttgcatattggcataaattgtgtgcgtctattgtacatattcagttgaatcaatcctccgattgttttagatggaattattatcagaatggtagattttctgttagatcaatgtatctagctctgattaataatggttatattgagagaaataagattatttgaaagcttaagatgtcgcttaagattaagatctttatgtggtacttgcttaaaggagttgtactaactaaggacaaattggcaagacgaaattggaatggcagtttaagatgttgtttttatatgaaaaagacaccattaaacatctttttatagactgccattatgcaaaatttgtttggagagctgtacagttctcttttggtttataccttcctattaccatatctaatatgtttgatagttagcttttgaggtagataagaagatgactaaactcatacttgtaggagcatctgccatatgttgggctctgtggttgagtaggaatgatatggttttcgacaaatcaccatctatatcatatatgcaggtaattttcagggcaacttattggctccggttttgggcacagctgcaaaagtgtgaagatgatggagagcttatgaaagttgcatgtcataggcttgagacgacggttatgcaactttttacaaactatggatggagatttacaaacagacttcaataaatgtgttctccttatctttgtttggtctttttattttattggatgtgtttaatttcgtttgaactacatcttttgttagagtgatactttgtaataattggctgtagctctgatgagcaaaggccgggatgtttattccattatctaaaaaaatgtatagcggtcctctcaatgctagacacttaattacactcgctcacttattatattgctggagtccaaaatactcgctgatgtatccctctgcatttagagtttgtttggttcttggccacgttttgccaaacctaagcttaggcatgcaacaagtgcttaggttggtgtttgcttttctactaaccataggcttgccttaacttgataggcatgtttctgcttgctcgctgtgtcttgttttgccaaatctgtggcgttctttttctctgccacaagtgcggcaactagcttaccttaggcgtggcaattttagtcccaaaccaaacaggcccttagtccgtccccctaggctcctagctatctctcctaatcctatatgtgcactttgtcatttctcgtgtttgcatgagcgattggtgttttgagttgatgttttatttatttctctatcaatgagataaggaaaatcttttatctatgtttggaaacagtagcatgtactacggaattgtctattcatcacttgagggaatatccattcatttttttaaggtctatgtgctacaccatatacgagttatatgactaggtctatgtttcgcaagaatattatattgcttaatgcctcaatggcgcatagtgcagtggtcctgtacctttcaccatctgttgaaaaacatgaaaattaatactaaaagaccagcttaagttggcctggtttcaaaaatatatacaaccaggcttgtctcaatgtaatatatatgtttacccactcagtatgggtgggcgttcagtctggaccggaattcttcattcccggttattcggtcattcagaactttggtctttcgaaacagaaaattgaggtaggcaacaaaaaatatggttgggagtgatagttcggttaaccggatagtctgtccggccttcggtttccaccgaactaactgaagcgatggtgatggcaatggcgcccacggcagcgatgacggatgggaggatgctagtggcagcggtgaccctaccctccctctctcatatccggtggtggaccgacaacggtagcatcagcagagggaacgaaagcaacgacccttcactcctctcccctcctagaaccaagcttcgggtgcatcgtctcgtcgacggcggctccttcctgcctcgaggtgctcttggcaacggcagccatgatggcatcgacgatggcgacggggggcggatctagtggcggtatggttggagaccaccggtagtggaaggagtagatggggcaccgcagtggcttccccactcccttccgcttgcctccctctcccaaatctggctgtagggggcgactagggtgtggcggcggcgatagcagccgaaggggttggtttcggcaatagctcgtccacggcagcttcagcaacctccaaggtcaccgatgatgacgacgaccagttttgatgtttatttgcatgatatttcatttgcatgtgttaatcttggatgtcaatttgaatctagatctctgaatgttgattgattttttttttccttagtgatgttgcctataaaaattaattttctcaggtgatcatcttaagtgtttgcaaacaaaaaatctattttcgtaagcggatcgcaacactgctagtcaaaatcatttattttcaatagcctttaggtaattagcggctaacaatgccgtcactaaaagccgctatcactaaaaatcagttttgaccgccgagaaaacactttatgaagtgtacaaccatttactctccccgtcctaaaatataggaaccttgtactgaatgtgatacatcttagtacaacgaatctggccagagaccctgtccagatttgttgtgctagggagtgtcccatttagtacagggttgctatattttgggacagagggagtagaaaaccagtcgcatgtttatctgaaccaagctccatacattgagggcggaatatatataatcgattgggagctttctattaagtcaattagatcaatcacaatcgcagggttgagtagattaatttatttgattattctatactatagaagacaaattataatcatttttgttgtcgaaatgataactgcatacgtcgaaagacgtggttactcaacagtggttggaaggaaacgaagtgtattgaatcttgaatttcttctttttttctggatccccccattacatggccctaggggactatttatagcccaattacaggttcttactactagggtttaggttgtacaggggaatttacatgattactcttacaaaagggacatttacaggggtacataatgttataggggctcatgggcccctgatgggccgtctggcgatcgccggccctatagcccctaggcttgatgggccggaaaggcttcttcggccctcgcgggggcgaacttgccatggcaaagtcgtcttccttcggcagatagtcttcgccttgcacctttcgcttgagacgcctctggtctggcaaggcactcgtacgactcttcgcctcacgccgttcttgctccatagccttcgccacgggtttcagcagatgtggtcgaagggtctcatgccatccgccaacaagcccctcatgggcaagggtgagattggagcttcggccgagaccgtgcaaaccatgtggtatggtatgcggcgccccctttcgaccgatgctcctgccgaaacctacattattcctgcgaatgaagtttgttacttgtgcggctattattattttgccgcgcttcgcctcctgcgattggtggttatatattttcttttcccgggccgaacggaacagtattgggctttcccttcgtgggctttttattgtgccgctcggtcggtgggaatttaccgtttcgcctacccttgcgacacgtggcgctttattactggtgggtaggcgaacggtcgcccaggtgagctatatattcccactgctctttccttttcttccacagcatctctcaacccctcaagcgtttcgcccattctctttcttcgccaccgcaaacgcaccgttcgccatggcccctcgcaagccaaaccctgcttcggcgaaagggccggatctcggccgaatcgatgacgacagcaccgcctttttgggggtctctcttgtggacgacgtcgagctggcgaagctggtcagctttggggcgttggtcgaggggcaggctttctccccagggaaagccgtggtgccgaaacctatcgacaatcggacggtggtattcgccgtcttttttgaggcagggctacggtttccctgcaacgtgttgttgccggagatccttcgcctcttccaggtggaacttccgcagctgagcccgttggcgcttgtttggatcgctatcttcgactaggcgtgccggatttccaggtttcagcctaacgccgagctcttcggcgccatatttttcgccaccgtgaactcgaagacggtgcgtcccagctggaacgaagaagacagtgttcgggagcgtgaactttaacgttcgtcccgagcggtccgatctctggccggtaaacgctgccatgtcgaagtgggactgccattggatggctaggtggttctatcacaccatccccttcgaggctggcactgactcggcgaatgcccaccgttgccgacgtagggcgatcgcgcctaaccggaaacccaagatcaccgtggacggcgctatggaggcgcggttcgttctgctgcggaaggtttgctcccgccttagctgccgtgacttattggaggaattctgtatgcttcgcatctttcccctctcccagtcatggcaagtcagagttgatcaaggcgaagaggttgacggtttgccgaacctggttcttcctgaggggacgaacagtaagactgttctcgtgctatacactgttgtgctttgttatcttgccttatctgactgttaacatagctacacactttacttttgcagcgttgaccctcgaccaggctgaaaacgaggcccgcaggatgatcggcgacgtgtcggtcatcgagtaaagccagttgctaacacgacaagcggctgggcgggcgaaccgggtttacaacggcgaattgcctcctcgggcaaacccccacaaagctgatgacgatgcagggccttcgcgaaagcgaatgcgcggacacgtgaagcttgcccctaggaagcgaagggttcctgcttcgtcggactccgacgctgacgacgaggacgacgccgaagaacgcgacggcgaggaggaaggagaggaggaagaggaggaggccgtggccgataaggccacgaacgacgcgatcgaagaccgcgtcgacacccccggctacactcctaccccaagtccctatcacaacgagaccggggtggagtcgaacagctccccccttcgacggaaggatttggaaggggcgaaggccctagttgcgttctcctcgggcaaggcggcgaagggaggtccggtgcggaaggtctctaaaaagaaaggactcgtcgacatcgcccgcgttttcagcgactacgaatcttctgacgggactccaacttcgcccgttggccgcagtttggacctttcgactgctcccctcgctctgctcggcgttgctggggcaggcggtaacgccgccgccggggcttcagcctccgccgaacggatcgtgtcggctgcggcgagggttttcgggagccctctgcgtgagctagctatttcgccgctagtcaaggcgaaggggaagtgtgcggccgccgaagcatctgcctcggagtattcccttgcggcgcccaacttcgcccctggtgatttcgagactcgggcggaccttattccctttgtggagggggtgagcaaccttgtcttgcccgccggcaccccgagcttgttcaccgaacttaatgagttcgacgaggggtgttccgccattaaaagcctggcggttcgggtatgccttttctttcgtcttcgttttcctcttcgtccccttttttttcgtctgacaattaaccttttgttcttttcgcccgctcctatctttcatctaggttcttgtggctcactgttcgacgaagcgaactgtacgggcccgctttgatggttttaagagccgtcttcgggccaaggatgacgaaataagctgcaagaacctggaggaggaggccctggccaacaccctcaaggaggcgaaaactgaagtccaacgccttcagtctgagctggatacggggaaagaggctagggccgaggttgatcgcctcaaggccgaactggagaaggagaaggcccattcggcggtgctgaatgactactacaaccttactgagccgaagatggaggctcttcgcctgaaggctagtagggctgaagcgagcgccgcggaggagttgcagcggttttcacaggagatggcgaagaccaccgaatctgcgagaacggcttgccaaacgctccgcctcgcccttaccgacatgggcgcgaaagtgcggggggtccctgctgaggatgcatcagccttcgacttctccgagtggacctagcaggctggcggatcggtttcggactgcgccagcatgtacggcgattgctgtgcgcgtgtatcggcggccttcaccttaggcccatttgcaacagttcggttgtgagcacgtcgccgaatccctacctatgtgaagggggactgggagattagggcgcaaaacatttcgcctgctcttcgcgcgtggcgaaaacagttctggcagaaagacggccggtccgctgccaaggtgcgccttctggagcaactagcgaaggcggaggcggcagatcggtgcgaagaagagggcgcagtgggcgaagaggttggaggcgatgcccgggatcacccagaggtgtgaggccctccgccctttctttagagttttgtagttttccaccctcttttgcgtttgcctggagaggcgaatgatgtacattcggcaggctaccaccaatccttaaaaaaggcttttttgtacatttggaatatatgacacaatcttaactactttttgatgatcaaagtctttggcatattattatttcgctcatctcacattatgccatacctcccccttcttccgcctattcttactatgtaagctgtgttttgctttttctgcactatccatcagggggttcgccgaaagtcgtgcatccggcccccttccgggagctggcgaagtcaaaacgagaaatttgtggcagtgaagggtctgccgaaggtgcgatgtccatttcggccggtttatcgcgaaatggagataaacggtcgcagctataaggttttcaagtttgccgactagctgcgggcgcaccccgagcgaaccttagaagattacgattttgttcattcaagacgtttggaggatatggctcgcttttggcgaaaccatcagaagactaaacgtcaggaaacgatctttcagcgtcgttacagtttagtctgtgtttcgccccctactcctcttaaggttgtgtatgatattagtagtgatgacgaacctagttcgcctgatcatgccttagggagggatagtgattatggggacgaagatgtaatttacttgtaaggtgaattgtatcgtgttgtgaaacttctattcttcgattattttttttgaagttaataaagacgtgttttatttccttttcgctattgtttgcatcgtcacattttgtgcttttgttaggtcagaacatgccggtccctttgcatatattagcgaaataggtgtactgacttttcagcttttcatcgttcgttttcgatctatagcgttctgtgtcgagagaaacgcttttgcttttatgctgatcggacgtaacgtcattcggctatttattttccgagacaagctgttgcggtttcaacgttcggcgagcgatgcttcggccgattcgtttagcctccctggcctttttcgctgatcaggcgtttgccttggggtttttccacaaattatcaatcacacgagaaataaaaagaaggcggaggacacagagattttatactggttcgggcctccatggtggataatagccctacatccagtttttttttctttttcctctctttcttctttttttttcttgccgaaaggctttcatagtgccgaagggcttacatagtgccgaagggcttacacgacagtatgcacatttttacaagttggcgatttgggtgccacccattctagtgggcttacgtagtgccgaagggcttacatgactgtatgtacatttttacaagttggcatttgggtgccacccattctaggcatagaagcgcttgagagaggcggcgttctaggaatggtcgaactcctcgccttcgagtgttgctaggcgaaaagatcctatcctggacttgtgtttgatgaggtatggtccttcccactttgattcaagcttaccaaccgctacgcggttcgccttcttccttaggacaagatggctagacatcagctctgtgggtcgaacttttttgttataagttgtcaaagtgcttgtggcgtacttgtgcatgtgctcgagcgcttcgaccctcttcgctcctagagaacataacccttggtgagttagcccctagctctgctggggtcattgcctcatcgccataaaaaagcataaacgggctaaacttggttggtcttgtgggggtcgtccgaagggcccagagaaccgatagcaattcctctggccatttgcctttcactgccccctcgagtcttttctttagtgcttctaggatcttgccatttgtacgttcgaccgccccatttgactgcgggtgcgtgactgacgcgaacctgatttacaggttaagcccttcgcacatttctctgaacttatcagagtcaaactgcttaccgttgtcagtaatgaactcttttggcactctgaaatagcaaacaatgtttttccatacaaacttctgtactgctgccgaagtgattgccccaaggggttcgacttcaatccatcgagagaaatattccacagctacaattgcgaatttatacccgtttcgccccatcgggaagggcctaatgatgtccagtccccatctggcgaagggccatattggcgcaatgggctgcagatcatactggggcgcgg

SEQ ID NO: 66777 - DNA, 9718 bp, Oryza sativa
  unsure (1)..(9718): unsure at all n locations
cctacgctgcctacggtctactgccaaacggccgcgccacaaaaccttacccacggaaacgaagacggtgaaaaccagacgacgacggcggccacggggcggggctgctccgcctgcagcctgaaggagaagagaagagagagtaaagaaaagagaagaggagagaaggagaagaaaataggagaaaaaagatgtgaagctgacatgtgggccctatgtgtttttttaattttttttttgctgactaggatggcacgtcagcaaaaccgggcaaaaatactaccaagggacctccggtgaatggtttgagtgagtttaggggtatacatttctagttttgtggttaagggaccttaaaaaatctcgctgttaagttgagggacctccggtgaacttattccttttttctttttccccaaaatatggcccatattcttctcaaagaaaaacgaggcccatgttgcgcaatacgcacactagtattttttttctttagtttttttttcttcaccagattatccccactttcttaggtcacgagatcctaacaaacaaaacaaattctaggttggtagacttctatctgttttttttaaaaaaaaatgagctttggtcaaaccagatattcaaacaacccgttgctgtctaggacttcagttacaatgacacagaaagtgaaatttacaggattttgaggccgaattcttcgagctcggtatttggcaatcgttagacaagcagtcaagcggatagtcgtgtgcatgaacatacgtgtacgggggcaagtatcttatgttggtgatgacatgggcatgatgaacagttgaggacatctgtgacgatataaagtactgtagtcctctcaccgtaccaaggctttgttcatgcgagagaagaatatttgcgaaacgagaaaactcattaacacataattaattaaatattaattattgtaaacttaaaaaagagatttatttatttttttaacaacttatatatatatatacacacacttttggaaatgtgctaacgagaaagttgaagtttataattggagtatagaatggagcccatgtaggcaatttctgtgcaagaatccggcattaggttcgtgtttctttccaaaaataccgagtcttttgtactgtctagcgtagcaacttactacacactgaggttgactggtcaagtacatgtgcgagttttttaatttttaccccctttgcaagggaactacataatttgtctgagttagttaacgcatttaaatggttgaattgctatagggagacagctaattcaacacacaaatgcattgcctagctacccattttgttgacagatgcaatactagacatgtagatgtagtcaactatgatttggaatgaactatatagagttaagtgtttgcatgaacactttagccatagaaacctctagctaaagagtaaatggcatttgatctttttgctagtgggaagtggctagaaattatttatacggtctactttattcaattataattaatttagaaacgtatcctatgtacacaagttttccgtacgcaccaactagtaaatgtcgtaaaaaaatatataaaaggttggactcatactttcaatagtattacacctatgtgtgaaatcttatcttaaaactattatatttttcacttttttttgttacgactaaaatataatgaatttgaatacgagactttgcatatatgcctaatactattagaatacatgtccatctttttgaaaaaaaagtcatgatatttgatagttagtgtgcacggaaagctcgtgtgtacagtatatgttcccaattaactaagagtgtgttagaatgtgagtttgggctgggctaatacgcacttaccgtgagcacgcttcccaaactataaacaatatgtcgcgtgtaaaaaaattatataacagttatattaaaaaaagataaaccctttaatttagaataatcaatacataattaatcatgctctaataattaatcatgctctaatgactctcctctttttcgtgccagtattcagcctattcttctttcccaaatgcaacctaaatatcaacataaaataagtctgggcataatcactttgagtgtgagctagataaactatgtaggtaatgacatacgagtaaagcctaaaaataataaacgccaaacaaaaaggtaattatatgtgtagcatcccacctacaatacaggcaactaacctagccacccaccaacaaaatagatggtgcgagaccgacaaaatgcaaagcgccagtagcctcagatgctagcaacaacggttagtgttattgtcagcaattccaaaaggcgattgacgtagaaagtaaagttttaagtacacgcaagcaagagataatcacaacacaataagagtaatgtgtgcgcgcaccaactttcctatcagaaaacaaaatgctccaagatataccttttgctacacaaatatcagtatacataccaaactatcaacgtacatcctacatcctgtattgttctacatcattccatcatatatataataacatggaaatttcatagtaatatggagatgttctggaaaaaagttataaaatggagatgatcaaaatggctaaaacctatgtagtgcattcaggtaggaaaaacaacccaaaagaaacttgtaagaaaaggaaaaaactaccctaccctagggtacgcatagcaattctcctaggaccctagaagttgccgtcacctaggccaacgacgaggctacgcaccacaagcccattccggtcatttccccctccccaatccttccacccgcccatccctccccgcacatatctcaaaacgagggaaacaaacccgggattttgccataccattctcggggtggaaaggcagaggagggaggaagcggttagggggtttaaaaagggggatgcatgcaacgccttctcccccactcatctccacaccacggacaaagtagagggaggagaaaaacaaaggtagcaaaggagccaagaaaagcttagtgactaagagataaaaagggaaaggggagaaagagagagagggggtggagagcttggcggtgcgaggtggttggagtggggcacgcacgcaacacatgggagaggagggagagagagaaggatggaactagcggtgaaggcttggtggttggtcatcctagggtggcagtgcgccgtcctgtcatcgcaggggggagaggagagagagaagggtggagctagcggcaaaggcttggtggttggtcgtcctacggtggcagtgcgccgtcctgtcatcgcaagggtcagcgaaggtgaggccttgtttcctctaactcaattatgtgaacaacacagtttttatgtctataagacggtagaggtaggcattaaattatattgcacccatatcaaaccaatgtgaaaggggtggggtcagcaaaggtgagagtaaggccttggttccctaactcaattacgtgaacactgcattttaactcaattatgtgaacattgcatttttatgtccattttatgtgaacggtgcatttttatgcctataagatggtagagacattttttggaggcattaaattataccacaatcataccaaaccaatgtgaaaaatataataaaatattttccttttctattaccaatccttgaactcaagaccattggcaaatcattttatgttcaatacgctaaccaactcaatcccatatcattacttatatgtttgtgcattgtgttacttatatttagtcccttagtgtacattatcattctaagaagtgtctctaaagagtttaaaatgtctcaagaaaatacctttacatattagacacatttcaaagtactaaaaaaatgcctctacaaaatgtctctaaaaaaatgtgctgaaaaaatgtctctaaagtgcctctagagtgaaatatttttagacatttttcatgtgcctctaaaaagtgtctctacactataaaactcatggttttagaggcaattagcaaaacgcctctataaaagtgcctctacatgagatttttgttctagtgccatatcaaagtaaagcaagtccggtgataatcacttcaactatgaactagataaagtatgtaggtaccgacatagaaatgacaatgaaagcttaaaggtaagaaacatcaaacaaaagataattatgcatgtagcagttcacttgcaaaataggcagctagcgttgccacccgcaacaaaacaaatggtgcgagaccgacaaaacgcaaatcaccagcagcctcggttgctaccagcaacggttagtcttatcgtcagttccaagaggcgcttgtcgtggacagatgtaagtacacgcaagcaagagataagaacatcaaaacgagagtaatgtgagagtgccaactttcctaacataaaaacaaatgctctagggtatagctcttctcgatgaaaaatcaatatgtgtaccaaattactgatatatacatcgtacattatctagtaaatttatgttgttccatcgtgcaaataatagtatgggagttttatggtaagacggataatcacatacgaatgacgagtaaaacctaaaagtaaggaacgcctgacaaaaggtaattatacatagcacccacctacaaaacaagcaactaaccttgccgcccaccaacataacagatggcgcaagatagacaaaaatacaaagcacaagcagcctcagacgctagcagcaatgttattgtcagttccaaaaggtgcctgacttggaaagatttaagtacacgcaagcaagcgataaacacatcaatacgagagaaatgtgagagcgccaactttcctaacagaaaaccaaatgctatatggtatagctcttctcgatgaaaaatcaatatacatatcaaattaccaatatatacatcgtacattctctaatagccttgtgtcgttccattgtgcatataatagtacgagagtttttatggtaatacggagatactcttgaaaaagttgaaagcatggagaggataaaaatggctaaaacatacttggtgcattgagattgaaaacaaccgaagagaaattattttttttagaaaaaaagtgaaatatagcactaccctgcctaccctaccatggggttcgaatgcgagtttgggttgggctaaaacctcgcttactgcgagcatgctctccaaattgttaaataacacatcgcatgtaatatatatatatactgaatgtagcaatccacccacaaaacatgcaactaaccttgccgcccgctaacataacagatggcgcaagaccgacaaaagaacaaagtattagcagcctcagatgctagcaatagcggttagtgttatcgtcagttccaaaaggtgcttgacgtggaaagttctaaatacgcgcaagcaagagataagtgcaataaaaagagaaaaaaaataagcgtgcgccaactttcctaacggaaagaaaaagctccgagatcgctacaaaaaaaaaggtacacgtaccaaaccattaacacatgcatcctgcatcctataccactctatatcattccatcatatataatgataacatgaaaatttcatagtaatacgaagatgttcttgacaaaaaaaaaggttatagcacggagatgatcaaaatggctaaaacctacgtggtggtgcattcagatcagaaaaacaacccaagagaaacttgtgtgtctaaaaaaaaacaaagaaagaaatgtcactaccctaccctggggtatgcgtagcaactcccctgggacccaggcagaattccccctgccgtcgcccaggccggcctaggaacggccagggatcacaccgtacattaacgacaaggcccctcgcaccccacaggcccatcccatcccacccgcccatccctcccgcacgaatctcaaagcgggggcaaacccgggattttgccgcgccccattcccggggcggaaaggcggaggaggcgggcgagaggcgaggagggaggaggaagcggttcgagggtttaagaagccttctcccccaacctctcctcggactcaaagcagagagaggagaaaaaacacaaaaggcagcgaagcggccgcgaaaagctcgactcggagataaaagggaaagcgagcgagaaaaagagaggagaagcattggtggcgtgaggcggttggagcggggcacgcgcgcggcccaaggggggagaggagaaaagaagccggggtggccccgacgccggcggcaaaggttggttgtcctagggttcctgtcgttgctcgcgggaagggtcagcgaaggtgagggcctttggttacccctaactcaattatgtgtgaacagtgcttctccgtttgtgctctgtttatgtgtgtgtgtgtgtgtgtgtgtgtttattgaggctttgagtttttttttcttgagggggttgcttttgctgtacaggagaagatgatgtttaagtttaatttaatttaatttattttttttactcgctgcggtttgagcgttcgtggagtggtatgtgttgcgagcacacgggtgggtttgtggttatgaatgtgtgtgtgtgtgtgtgtgtgtgtgattctgtgcaatgcttgatcaggtggcgagttcctcacttcggtatgttttaaatttatcctttttcgggcttcgtttgatgttgctctgcggtctgcaccctctagcttggtttaggcatgagattgtatgcaaggtgttttctttttaaccaatttcgtgatttttgggctagttggagacttgtttctgttcagtaataagtatttggggcagtaaacttttcttttttggaagatgtaatttctgttttcgatgggcgaatgtgtgcgtgatctcaccagcaagtccccgcctttggtgtgcttcacgtggtgtcctccatggcctcatggggcaggtttctctaggcggtggattttatctgctgtgctggatcacaaaaaccatgggtaaaaactaaaaaatcgcatttatttggcattttgctatgatgatttcgatggttaaagttcttgagttttttttttctttttgggtaatggagcttgcatatttgcttgctttgtagcattacatgtgtagttagtctgtactcgtataggttctaaaattgaactgaacttacagaattcagttgagaaattatcactaaaaatgatcaccttttgttgtccagcaaaatggctacagagagtgctcggccgttgagtggaggaactggagcagggaagtggccaccaagcaaggacacgggttcctatgattctattccagctagcctttcagaagatgagttagcggagttggccttcatgccaaatagtggcggcatttttgggaagtggaggggttctgtcctggaacgcagtggaagcgctcctcctaccatggaaggttctttagttgcacttggtcacctcacaggtcaaccgagtggcaaccttggggccatactgccaaacttgggcactgaagctaacaattcagagtctaaggagaatatatattatgattcggcatgcgtcaaatactatatgtccaaggtgaatttgaacccaaggtttcctccaccactcgtttcaaggaaccagtttggcaagtctgaagaacgaaagccgttctcccttgatgacagcagcagcaggtccttacttcttggtcatcctactctgccaacacacaaggaagaacctgaggacgaaaagtcaccaagtttggattcaagttcagcagacgatgctcaatgtgattctgcccaaagcacatctaacttagggggccacagtccaaatcttgtagattcaattaaggtaattcccgtattaattcaagaactagctctgattgttttttccacatgcactcaaacaaacttcgtggcgctgttcggttgtgggttttgcagcagctgcacctggtttctgcggctgtggtgcacagctgtggctactagtagcagctgcagccgcagccaaaaaaatggcagccggagaaggctaatgttttcatccgtgacataactccatctttgtatcctcaaatattaaagtcaagaaatctttatgcacggctatacagtagcagtcggcttcacagaccacaagaatggcagtcagctaagacttagtaaggtgaaataatacagtacaacatatgattaatgccccctgtgatatacaaacaaacatttccaatattcagtggctaagacgttttccaaaaactcacttatttgaaatagtaactggaaattctgatttaaactaattgatctttattatgtagtatctgctaaataaaatcaaaacatgtttttgtttcaaggaaatgtgatgggaatcgcactaaaccttgcaattccttaatacaagtacgacaagaaaagaagtattgattgtactcctccataaacattgttatttaccaactctcatgcatgcagatgaactccctaatatcttataatcatgttctgttttgctacagagtttgttgctgcagtctgcagatacttattgataatgatttctttttgtttaggaaaactttcatcggagcaatggtttgtatgataattcttccgatcttttaaatgcaaactctggtgatggagggtcgatttattctggcattagttcattgaagaattcctcactttatgttgtccagtcatcagacttgaatggatttccaccagatgctcatcagcgttcccctagacctattaggactccagtcagtacaaaacttactagcgacagtctgccagcttcatctcctcccacttcatcctgttctgactacagtactattactgaagcttgtcagcaaagaaatccaagcatggccgttaaacctggtgaaccagttggtaccatgcttgatagttcagacttcagtctgaagaatttgaatattagtccggatatcctaagtagttcatatgtcatgcaacagtggcagaaaaatgccccagtgtggaatggcctatcaaatgtagtccatggcgatcatgtgccaatgattcctccaggaattaatcttcctcaagttccatttgtggacaattccggttttggtcatatgaagttccctggtgatgttcaactgatgtcccagatcgggatggcaacacctttttgtacaccaaattcttttgggataccatgttatcctaatttgcagtcgcctagtgtttgggttcctccattcggaatcggcggctatggtttgcctggtccatttgtcccacctgttataactaacttcactcctcaacttcctggttttccttcagcagtaaatcttgctgcagcaactgacttatttcacccatataagatgtatgagcatcttggggtacctatgccatcccctgttcctgatcagagccttacgcattattttcaacagccccctatccatccgtatggtgttggaaatccatatgatacaatggtttcaagtaataattttgtagggaatcctgctggcgtttttggttcaccaatcattcacccatcagagcagaagtttcagataccggttactactgtagctgctaatgcctctactcccatcaaaggtggaaaggggatcctctagagtcgncntgcaggcntgcntgggaggngttntcagtcaatcaatgacac

SEQ ID NO: 66778 - DNA, 11321 bp, Oryza sativa
  unsure (1)..(11321): unsure at all n locations
aggtgggttagaatcatcntcacnccagcacgccngcaggtcgactctagaggatccccgcaggtccaacattacatgggcaacctgcttctggaacatctcctcgtgacaaaaggaacgatgtcaagggattccaaccccctcgaaaaaatatgcctgttagttccgagatacaaggtcagaaagggagggagaagtttgatgatcccaaggcacacttttctgttgaagaactaatatccagcagaactcatagggttgagctggctgacatcaaaggacagatagtgaaatacaggttagttttgattttggttgtttcattcactatctagatgcacataacccaatgaaaagcttgagatattaattgttattatgttcttgtcctcagctcggaccaaaatggtagccggttcattcagcagaaactggagaattgcaccattgaagaaaaggatttactttttgccgaggtccttcctcatgctttggaattgatgactgatgtattcggaaattatgttattcagaaggtatagtatttccttttcttatatgattcattttatggtaatttttttatgaatagtacacctattgaacttgaacaattgtacccccttttaagatattacagtatcatagcagcaattatgaaaaataatttatatttgtatgaaatgaaaataacatgtagtacatgcagttcttcgaaaaggggagcccacagcaaaagagagaaatagctaataagcttgccggtcatgtgttttctttgagccttcagatgtatggatgcagagtaattcagaaggtagtcttgacttctttatgggaagtataactttatttctgcttaatgttttggataccatatcatgaaaaccttttcagtggcacactatagcatgtattgtctgaggcggtctgagcaaattttcttcacactgttatgctatccatagacttatttattctcaatatcagttggcaaagtattatctgagtaaaatttcttcagactgttattctatccatagaattgtttattctgaacatcagttggtaagttttaaagtggttagcctgtgggacatcatttctcatattatgcatggtaatcagcatacattcttttaataagttgcaatcccactgtagccagctattcatggattagcatgtgttggaaatgaaaaataatgtgacttataagttgcaatcccattatatcccgttattcacacattttacttgctatattcctggagaactcattttcagatgagttttgtgttattctcatatataatggatacatagaaatgctctcttactaccacacacagactaagtggttgcacattaatgtaattaaactgaatcacaactaaaaagatgaggaacacacaccagacaagacaagtagtcaatgtcaggttatgtgtgttcgcattttcatcattcgtcgtaagtttttattagcaattatgctatttagacagtcttgtgaattgtttgttgacactgctacactgtcttttctggacgttatcgctatttgaactcaaatgccaatttcactgcctacttcactgctacaattgcaggcccttgaagtaattgatcttgaacagaaaattgttcttgttggtgaactcgatggacatgtgctgcgatgtgttcatgaccaaaatgggaatcatgttatacaaaaatgcattgaatgtattccattggaacatattggttttctggtgtcatcttttcagtgccaggttgccaaactgtcaatgcatacatatggatgtcgtgttattcaggtgaattggtaacgatgttgtatttttgttaatttcttgtcattttcttgtggtgttgatcatattcacattctgcttggcagagaatcctcgagcgttgcagcaataattctgaatgcctttgcataattgatgaaatcttgcagtctgcttgcatcctcgcacaagatcagtatgggaactatgttgtgcaggtgattttcttcttattctccaaaacttagtggctgatttgactaaattttcattaatataaaccatcagcatcttgttgctgtaatacggatagctattttgagttagagcaagtgtaacttaagtagctgatgttgaatttggcaacctgcagcatctttgcctttattataaccatgtgtattttgcagcatgttttggagaaagggaatgaacatgaaaggggccaaatcatcactaaattggctgggcaggtagtgcccatgagccaaaacaaatttgcgtctaatgtcatagagaggtgttttgaacatgggggcagtgcagagcgggaacttttggtcaaggagattctgaagcaaactgagggcaataactatttgctggtatacattattactgtaactcaccttttgttttttttcctttgccattccatgctcttttgagccaaatagctaaaagctcttgtttgttcaaaatttgactaatgttaaactcaattaaaagatatggtaggtaccttcatgatccaaataattgagtaggagttttacttaaattgaaacatataacagaagcccgtcattttttttggataacagaagtaatcctcataaaattctggcgcggctactgtttctaaggctacttggtgcaatacaaataacggtgtttccagctatttttgtttcgttatttgtgttattagtctaaatctttactcaagtaagcgatttacgaattacctgcactgctatacaggtgataatgaaggaccagtatgctaattatgtggtacagaagatgcttacaacatgcaatgaacaacataaggagatccttcttcagtcgtgtgaaaatccatttgccattattgaagaaatacacctatgccaagcacatcgtcagcctagtcgagcgcctctgcggtgacggggagtcgtccgcgtgccactcctccagccctgctaaatttctcctcctgatcctctacttcaattggccccaaaatttactgctcccatatatgccatttttcaggagctgtgcagtccgaatccaaaaaaactgtaaccaagggctgctgaattcgccacaggaaagccgactcttttctgccaaccctgtcaagttcagcgtagaaggcctatcagtcgcaaaagtggctaacaaagcaaccaaaaaaaaaaactgtcaacctgtcaccatagatcatcatcatacagatatagtcgttccaagcggtttgtccgtgtatttaagctaggaaatgatagtgtcatactataggaatggtaataatcatctgtgtgggctgtggctgtggatgctgcgtctcacagaagagagtctgagtgtggtggtgcgttgccgtacagtacatatcccgtagtcttgagtcttgtacccctgcttggtgatgtgtagttatcgccgcatccagcttgcttggtcacttgcttctgtgtgcttccgtgcttgctcactggtgcgcgtgattgcgcctaccacctcgcccggatgcaaatcctctacagcactgtcgatgtagtaacaatggctgacatgtgggtccagacccatacgttaatatctagtgcatgagtagtactgcagacaatcccggccggcaggacgatctctcctactcccccgtcctataaaaaacgagtctaggaccggatgtaatatattctagtacaatgaatctggacatatgtatatccagatagtactatatatgtcacatccggtactaggtgccggccaatctctcctactccctccgtcctataaaaaaacgaatctatgaccggatgtgacatattctagtacaataaatctggacataaatctggacatatgtaccggatatgacatattctagtacaataaatctgtaccggatgtgacatattctagtacaataaatctggacatatgtatatctagatttgtagagggagtactttccatttcataatacaaaatgctttgacttttgtaagtcaaattttcttaaatctgaccatatttataaaatattatagaacatctataatactaaattagttttatttaatctagcactaaatgtgtgtttttttgaacactaaatgtgttttgatattgtattgaaagtgttgctacattattctataaatttttattgaaattaaagaagtttgactttaaaaaattcagaacattctaataatataaaacagagagagtacccacgcagccacaagcttggaacggagatttgagagaaatttcacaggatttgatagtattcacctgaagatcaggtagaggtacatgccaacattttcagccattctcgtgtgtaaaccccacggttaacacttagacaacatgtaattaatcaggcattccaaattagcgagaaacaacacatgctctcccagccaccagccaaaaaaaagaacagcgtctcctatctagccactttttcggcgtcatccagggtgggactcgaaaactgggaaaagatcaggaatcccaccgatacaagaatcttgtaactcattattgttttctacgttgcaaatatgcaatgcgtcaggttgcagttgctcgatgccacattccccttaagctttgcgcttgtccttgtccgccaaaaggatgtccttacaggcctcgtagaacatccaggtgatgccggaattgggcatcaccttcaggcagctggccccccacccgcggtagagccccgggaggccctcctcctggatcacttctgccagggccgcgatcatgtggggtgggcacttcccttgcagggcacccaccatgagccgcttccgcgccacctccagcgggaagctgattgtgcttgcggtcaggcctgcagattcaacagccagatatgagcaatgcaaccagctgtttggtcaaatttcaagctaacattttgtttgaaggagcagtagttttgcatcttcattgtatgtagatagtagagaattgcacaagtcaaaacaggggataacctggtacacagattttaagacagtgctgaaccggctaatgaagatggtgaaatgatatagatgtagatgaagcagaatcatttacctgacagagctccaataactagaagctcaggccgagtcaaagacgtcttcttatgtaagcggcagtaagaagtcttgattgtgtcgtacataaagtaatagcatgtgctataaggaagcatcccaattagtgttggacagaggccagcatagagaccacgaattccatcagttcggtatatcttgctgaaggtgacgctaatactaggatagacttctcggttaatagttaagcgatcctgtcataaaatatggaagatatcaggcgaagttatactgttccaaagaaaatgaatatatggaatgacaaatagtttttattttcaacaggtcagttcagcaatcaccttaatgacttcaagaggatgacacaccaatgtgccagctattccagcagctgcaccagctacagcaacaggagataaaaattgaagtggaaattcaattttcactttaccaatttgtatctttgggcatccatcttctttccatttctcttgcgcttccgccattgtccttttgacacactcgaatgttccgagctcaattgcttgagttggaataatacggatcatgttgattgtgttacctgcccaaagcccttgccatccattttgttcgatgatttctacaaagctaccaccgatatgcctagatcctactcctacaaccattcttgtcctgaaattaataacataccaacatattacgacacaggtacaaattagtctttgatatgcaacaaactgcatgcttgaacaacacagttgggaatcatatatctaaaatgatgtatgcatacagagactacaatctccactgctcataggaaagcaaacaatcctacaaatactggttatgttatgcactaaacaaagaatatgtttacacgtgaaaatgtgactattgaactttgagactagaaatatttcctgtttaactattaaatggtgaaagttggttacaacattaaactatatgcctcaaggagttaatttacagatgatgaattttggagcatatcattgcgatggtgtttgcaaaggttgtagcacgttatatcttttggtttttaagatttacatctaagttgtaagaccatgctcaaatgctttattagagagagagagagagagttcgatagatacctgatagtctcgagaggagcaagaacagctttagacatagcaccagctaatgctccactggcaaattctctaacctctcgactcctaaaaaaggcctgcaatgaaaatgaaagggaacatctcaaaaaacagtgtatattgtataggcatcaaaatcacccatggatattattaaaccatgcatatctgtgtgataaggacagattcagagccattcagttaagtacttggtcaaatttgttttatatagacaggcgggttcagaataagaacatttactacgttatctaagcccatcatcaatcatcaatattacagcaaaatctctaccaaaggtttggttggtcagtggttaagaatgaaaaaatggaatgctgaaacaagagctagatcacaataaaggtatctttagtaaattcatagtcacatatattataacacaagtatgcaactcaattttgtagttggaataagtaattgtaaaaaggactaaaagacaattgattttccacatgtttggacgcattcaagatactttggatgaaaatgacacagaactttagcaccgaagaagaaatattgttccatctgtgaaaggaacagctttgtccaaacctgtcgtcgtggagaataaccccaaacatagtcaaagttctttatatatgttggctaagcgtataaaattagttgactgaatcaagtataataaaacaaaatcaatattgaagcttgtttttttccatttgactctttgaagccccttaatctttcctaacattttctgtctccataaaccagggtataaagtggggattcgggattcctctgccgttaattgttcagtatcactcccgcttgtagcaaacactacgacgacacatcgctatctaaaattctgaaatcagatccgattttcacctaaccagcaacgtaagttaacaaaaagaattgggaaggaatatggccacaggagtacatgacacatgcgtgttggttgtacacatcaatatggtcctaacaagtagtaaagtctcatctgcatctcttacgtgtcaacattaagtcggcagatgatgttgggtctctcaaccaaaagaacaggatagaacttgcttttctttatgaagctagactgatatgaacgcctatataagcataatagagagagaaaatgaactacgcaacatgagaccactgccgttgacgagattagagatgcttgcttgttcgagagtaatctctggtaagaacagataatcaaccatggatcctggtcgaaatctttcacatgttctgcagcaaaacagctcgttcatgccacgaaacctgtgaatcccgagcaatgtttcgaatcgtcgtaacaaaaatcctaaaaacgaagcaaacgcgtcgcatgggggggaacagcgccattcgccctctcaatcggattggagataaaaaaataatcaaaccgagcaaaactgccaagatttcccacctttcgccgcacgagcaaccaagaaacgcaggcagggatgggcgagggctccttaccctcacggccccttccacgtcgggcagccggaagccgaggacgtcggcgaccttgccggcgtcgaggtcgtcgtccttgggaagcgccatcacgagcagctccttgtaacccccttcctcatcttcttcttcggcttcttcctccaacgccgccgctccccccgcccccggcgccggcgaggccgacgctggcgagcagcgacagcttcccgcccccggcgccgccgcggctcggcgcgtcgtggagacccatggcggatggcggcgcgcgtgcgtgaatccgcttgcctcgcggggcttgccctttggatttgggagggaggggcggggttattaataggaggatcccgagggggcgaggcgcaaaacgctgtcgctgactcaacttttttggctcggcggggtggggggagtgacatgtgagagtgtagagagtggaggggtgagaatgtaaaagggatccagggctacggttttgtgggaacgggaactctggacgaaagcgtatacgtacagtacagtggtggggcggacgggcggtgtatttaccggttttacatctatatatactccctccgttgaaaaaaaatcaattatctctcttgatgcaatgaatttgaatatattgaatctgaatagaccatatgtccagattcattgtatcagaagatgtcatatccttttataggttgttttttttaagaaaatatatacttactgtatctatcagatgtatttttgtttatgggccggtcccatctgtcagcccgctttaacaatccagctcagtgtgccaccgtagcaaaatcatcttgggggttaactagtttaaattgagactgaacatggctataaatagtatttgctataaaagttatatttttttctctagaaacttaatggattatccgttaacgagctcggagagctgcacgtagtaatcgggcgtaagtggcgtcacttcagcatttgatatcttttgcgagttgtgtagacttatttcttcaatctattggataataaatttagccataacgtaagcatgttttattgtgctaaaatttgattagcgatgtggtatgcaaaaccataatagcggagttatgccatgtgacaaaacctcgtggtttactaacttggatcgtaaactctattttatttctattacacgaaagatgcatgcactttgtactactatacatgtgtcatactcacacatatgtgaatgtactttctaagatcatctccaagagaggcctaatcctgtttctaaaagttaaatttcagaaattaatggtaaaaccaaccctccaacgcgaaaaggctaagccctcctccatgtggtttccttttttagcaccgcattgcttttctactttacgcacctaaaatttgtacacctcaagtttacacatctaaagtttagagacctaaagtttataagtcaaaagtttatatattcgattcaaatttgaatttaaattcaaatattttttatatatagtatttctatatatctaaagtttgtagacccaaagtttacaagtcaaaagtttacatacccgattcaaatttaaatttgaattcaaatattagtttatagacccaaagtttataagtcaaaagtttacatacccattttaaatttgaattcaaatacttttttatatatagtatttctatacataattttttccaactttgttttttatttttttaaaattttatagtgtagtaggaagagaagaaactgaggagaaagggggagaggagcgtataggaggggatagggggtgatcgctccaagtgatcgatcgcccgttaaccacacccccctccaacaggctcccaaaggaggtccaatagttaggtgcatccaaaatctatccaaatatgagctaattctgggcacctccatgcactctcaactggagaaaaatcagtttaagatgacccaccagtgatgacatggtagattttaaagttctcttggaatcaagtaatgggatactgttggagatgagggtgatttttgagcctaatatttttggttagtcctaacacatgtcttttaggtgcctaattttagacatcttttgagatgctctagcacatatttatagagctggggattagcaaaatctcttgccgaattatccgcaacatcatcattatccttaaaaaaaactaattgtaatatctccaaatataaagattgtgaatcaataagttttcattattgcgccgtcatgtaatgtaatgtagtaaatactagtaacaacgatcgaaaaatccaatcaagagcatataagtataccatggttcaaggacttgttcagtttgccactagtattatttttcaacccaaccaaaatttagtacgcgacactgacgccaaaaaatgataatgaaacaattgaatcatattcaaataccttatcataccattccataacaaattttgataatttcctaaaatctcccacaaaagaattggtaagacatcaaaccgaacatcacaccacgcacaacataccttctaaccttactaatttttttcatcatcaaactttgctaagttttgggtagggtcaattttgccatcaaactgaacccatcctataaatgtactccctctgtcccataaaaattgtatttctagatccaagtctttatcccataaaaattgtatttctaggcatgtggggcccaaccaattgattcatctatataactttccttccatcccacgtaatttgggctgctaatgcttgtaattttattaagtatgctaattatatgggttaattctctcaaacttctttttaatcatttgtatatatggaatgtgtgcatacagtgggttcattaaataaggttattgtggttattttccaatcctactattttgtcttaaattagctagaaatgtaatttttatgggacggaggtagtattatcttgccaaagttttttttccccacttggtgctggctgagatacggtcatattaggttgtgtttggcagctgagtttcttaatttatctctctcgtttttccatacacaccttttaattagttaattgatatgttttttaaaaggtttatatacgaaagctgttaaaaaaacgtattttcattaaaaaaatacgctaataagtcgttctttttgttgtgcgcaggagattagatcccaactaaaagaacgaacgcagccaaagtatatacggaaccccggcgtacgatacgatcatacgggcatgcggccatacccaattcgtcttctccgcccgctcctggcgcgcgcgagaacgcccgcggcctctcgcggatttccccccaaaaattgcagcgcccaaaatccccggaaatctgctacgcgcacccaacccncactaacccccttttccccttccataaattccccggggcgcccgtttccttttcccctttcctttcccccgtttagaaattctctcttcctaaatatatcgcctcctttctctct

SEQ ID NO: 66779 - DNA, 2082 bp, Oryza sativa
caatgcattttgttttctataattctttgaaaattaaggacctttattaggtgtagggtttgaaatctagttacaagggaagaattgatagattgggcgcagatttaatgtagttcggaggttatcaaaccatcacagaatacaaaatgcatggggaattttggtggataggccagtgtagtccatgcacggaaccgacctagacaccaaaattctccatgcattttgttttctgtcataatttgatgattaaggaaatttgcagattatctaaacttgttgatttatataccctttttgtctatgagtaggtcaattgtatgaattgttgtttatatacatgatttatatacccttgctgctgctgccacaatgattgtgggctgttttattatctagacttgcttgaattgaatggatgaattgctgtttacatgaagttagtagtactgtctccttttttatctatacccctgctactgctgttattgtgggctacttgttaatacacctgttccttgttttatgttgttgctgcccctctccaagtatctttgcccctgcttctgctgcccaatgtgttccttgttaaatggccagtgatgaattgctcaataagaacagattatctacacttgttcatttttttatctattcttctttttgcccctattgtggctcaataagtgatgaattgctcaataagtgaatcttgaatgtggatttaagtgcaactgctgctgtctatgtttgcccttgctgtctatgtttgcccatgctgctgcctatggttgcaactgttagttaagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatatctctacacttgttctttttttatgcataagaacagattttgtgcacttgctctttttttatgcataagaacagattttctgcacttgttcatttttttatctacaataatatatgcatgatttatataccactgctgttgttgcccctgtacttcttgttaaatggccaaggatgaattgcttaataaaattctatctatacctgttcttttctttatggataagaacagattatctacacttgttgatttatatacccttgctgtctatgtgaatttccctctgctgttgctgtttatgtgaatttccaccctgctgttgctgtttatgtgaatctccccctgctgttgctgcccctgtggcatatatacccctactgctgttatatggccctgctactgctcttattgctgctattatatggccatgctattgctactgctctaatttcctgcacttgctattttctttatggataagaacagatgaactacacttgttctattttatggataagaacagatgaactacacttgttctattttctttgggttgctttttcctcctagtagctgatttcctctttttatcccttcatgcaaatgattgtaattgatgcatatttctcagcaaaactgaggccatatctttcatagtgtaccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccacgacaacggtggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgggacaagtgcaagtaggtctagtagaaatccgcggtcacaaaatatatggccgaccacagtgcaagttataagagagg

SEQ ID NO: 66780 - DNA, 23614 bp, Oryza sativa
  unsure (1)..(23614): unsure at all n locations
aggctgtgcatattgtgattgtaatgtctcaggtcattttcattanagtatcccacggacggctcgttgttcgctctagatattctatgtgcacgactgttttttccgtccttaaggactgtgttatcttccttgttttttgttgtgggtgagccacccccactaaccccctctccccctcccataacttcgcgcggccgccgcttccctttccccctccccttcccccgcttggaatccccccctcccccactcgcgcgccgccgcctcgtcggaaccctaggcccacccgatcggtggcgcggcgatggcaatgacggcgcggcgggttcagctcgccgaccggtggcgcgggatccaggaggccgaggaggccgatgacgacggcggcggcggcgagccgtccgcgcccaggcagcgccgcctcaaccaggccaaggaggaatggtacggccacgccacgcatcgctctccgctacacatcacttcgcggcgatggggggcgtaacgtactctacgcggattagcgcgggtttagttagtgtttggtgtgtgggtttaggactttccgctgatcggagcgagacgacgagtaacgcctgtgctgacggggaatcgccgaatcgggcagggtagctgcatgttagcacgcttgttttgtttgcgtggttgtttgattagataatgcgaatgtaggttgctatgggccgatagactctcaccttcgtttcagacaacagagtggattgatatattgggtggaaacctctgcagggctcattatcattttgagcgtgagcactgttatgcacttatgctattggtagttttgtcactccgtcttgttaggggtatgtgctatcgatatgcagaactgagcaatcatttgattacaatgtagacttattgggatgtcaacagcatttcttggagtaatgttgattagaaatgtacatagctgtgtgaagtccgacttatcatggaccaaatatatatcactactcccttatggtcatcccatttgccactatttcttacactagcgaagtacccatgtgttgcaaggacgttgaatatgttcttttttcttctctctttccatagcctggggaatgaataatctacatgcttcactgttcaatggaacccacatgtcagtttatagtgggagttggtggtggcagattcaccaatttcaagtccccacatgtcggtgggtggtggtagattcaccgctcaccaccaccattagagtttttttttttttaaagagtgtagattactggcttgttgctgtacgcctccaacgctgtattgtactttgtagtcatttggttgaagtaacttttagttaacaatgatgtgagttttcaaatgtaaggcatatagaaagtcacagagtattattttgcttgaagtttttacaccacatgaaatgtgatataatgtatatgtttgtgtctaaaagacatttagtttatttggaatttagctgtgttggaacatcaaaatttatgtaaatggacagttgctcttcttgcaacatgccttgtttctagagtcaagagtcaaagacatgccctaaaatttcgcttgacagtcctaatgagatttgatgtttgtgtaaccacctgcaggttttcacattgttttaattttctgggaagtttgccaaaagaagagcatatttggtgtggatatgctgatattatgggaccatttctggagaccttccttggttactttgatgaccaagaggaaaactcacctcctaggacaatatggaaacggatttctgaagagctgaatgtttgcgcacaatgtgtttgcgaacaccaccaggcacagaaggattttgattctgaatatcggtctggcgttgacgccctcctgaaagtgttacggcttctcgatgaagagagggttacagaacatcttaggcagatgaatgcaaaagcacaattaaaggagtacaaaccttcatgccatgatgcagaagttagcataatgtttgaagtatgtatcgtttatgtgatactttttagttttccacatatacctcaaataaagatactaaattccttctaaaacattttaatttcttccttttctgtttatgttccttttgcatgcatatatatttataacagcacactacggctaccaacgttgtacaaaatctctcggcactagtatttatttgacccttttcaccgtaattgcttttgtagacatgtagtggcttacagaattgctcttagagtgaactgaatagagtgctctttttatctatcaatataatataatggcatttgtccagttgagttagttgggcttattttgattagcaggatgttggtatccattgaatcatgtgcattcctgttctctgaattctcagaatcactttgctaatactgagaatacaagcagcacataattagtctgcccctgtgtttctgatcagtaatggtgcagcttattttctttctttctttttcctttgatactttctgttatcaagcaatttcaatatcttaacgagtcacatttgttatatataccatcacctaggaaccagaaccctaagtttcatgcagccatgataaaccattgctcttctatatttgcaggttttgatgtatcccattttgttagatgacctgtcactggctaatcagttccagacattcattgaaagaattgatgaaatatttgaagtgagcctttctactaatcagcaataccctgtaagtcacttctttccttgaagataaacttagttttttaaataatcaagtaatccaggatactattttttattaaaccaggatactctatttacttctcaccgattggtttttgggctgttgctcaaaatagtatatattaagtttctttcctcctcatctatcaagttcacctgtctcacagtatctccgaacttacaattgtagggtgtttatgcattacttttcttcaaaagttgtaaagctcgagcaattgggcttcgcttagcccggtctatggggaaattgaggtaatgtgcttgccactttcctgttcattttgaatcaataaagttaccaattagatccatacacggaaatgcatctacatagtgtaccatgtaggaatagttaggcaatgtcatagaactgtgcctgaaggtggaagcttccaaccatgtgtttgatgatgctgtttgactttgtcatagtctgatatttgttaatagcatattacatttacagcttttaaacctatacaccgaacatttaatttgctaccatatttaagcaggatcccatttcccttgttttccccagatcattacaatgtttgaacaaaaatacttgccaatctgactactgatgttttccgtggccaaaatttgcattaaaccatgcatgccctatatggtcatgaaaacatgccaaaattatcaaaatgccaatcttttcttctttttctgctttaactcctacatagtgtttgtgcaacagcaaaattaagctttggaaagccagtcaccttgtttcatagacacgtaactctttagctcttggcaaaataagtaagataagagatagaattgctaataggggtgggcgttcggtttttccggttttatcggttcggtttgttcggtttagtagaagatcggtttcacataattgctagctgaaattcctcctagaaaaattaaaaccgaacctttttaaaccgaattaattcggtgcggttctttcgggttaggtttataccgaacttgattttgaccactccatcagttcatcacgctgccaacaataatcaggaatcaacaacatataaaaaaagaagttccatcatccatcttaggggaaattaagagtattagtatataccattggccatagaaccagaacaacagcaagatggcagcaagatgtcagagaatcgaaaagccaggagtccaagattagcacctgctggcctatgaaggaggaattgatcgatatctgactgccaccgctatggttggctgagccgtctggccagtcgtctgcgagggccgaggagccaaggacgagctcgttgggcggtgctagggttggataaagttgcgctatctcttgggctggatggaaggggatgagttgggccttgtatagttgtattaccttgggctgtcccttcctcggttttctcggtggaccgatttattcttttgaagaaaccgacgcgatgaccgaacaccgagctacgttaaaataaaaaccgatggaaaaaccgtagaccgcaaaacccgccactttggtgcggttcggctcggtgtccggttttcggtaatttcttgcccacccctaattactaactacaggcctagagccttatttaagatatcttagcaagatccaaaacagtgattacatgcaaaaacgttgcaattaaggacatttgtttgaaagattgtggttattttttcttagaaagatatgatggttttaggaaacagaaacggaagtctgaaactgtgggtataatacataatgccgtgaaaaagcttcaggatggaaaccacgattatatccaacttgtaccattaatggacttgcttctggctttgacttagatagtggttggcaactattaattttatggaccaaaaactgtttcacgccacaaggtggtgttatgtgtaataccttagctgattactcataagattttcagattttgcacccttttaatctacaagaagaatcaaatgctttgttctcatattggataatataatgcctctttccatatttaacactggaaagttctccctgccattccttttacatttgattcaatcttcaatgttccattagtatcacttatattttttttgtttagtaagaatattaagtatgttgaaatctgtagtaggatctgacctctataattcaactcaatgtacaagttgtgttcgatcaagtgctctaatatcatgccaggaggcatgttgagattggtttagccttgtatggctttaacacatttggtctgatttgtctgctttaatttcttataactgtattaacattaacagtaatatgcaggaaagcagttgacttggaccctttgcaacccttactgcaaaaatatattaattttttggaagccgaagttcttccatctacttcagaatctccaaggcctagggtgcagctcaaaagagccgatatatggcttggatttaaatcactgtatgtaagtttaacacatgtattacatatgacttaccatgttgcttcttccaattttttacctgtcaatgtattgactttgtttttgcagccttggatttcttgatgcacctgctttcgaagatggaatcttggagagataccctatattcctgaatattgtacttaaccatgtcagtgatgatagatctgatttatcatgtgctgttagttgcctgaaagcatcatttgaaatgcttggtaagtgtaactactatgagtttttgctgtcctatgaggctatgatgaacttttcctgttgcaaacttacacattttcttgttttaggttgcaaactttggttgagaacaaccctatcacctaatgtcatgcggaacacattgttgggccattgttttcatactagagatgagaaaagccacaaagaaatttttgaccttttcctcccatttctccaggcatgtttgttgttcctttgaatccaatgatattcgcatatactgatcattagtgcattatgatgtgctcaatcttgtatgcagtcacttgaagcactgcaagacggtgatcatgaaaagcaaaggaggaacatactgtattttcttctttatcaagtaactcggagtagtaacttcagttctctgatgagaaaaaccgctactaaggttagcttcttttgttgctaactggatattcactttagttatttgacttcccatgtaaatgcttactaaaaataacttgattgtattcccttatttttactattaagtacagcatatttgggacttttaaccatttgtaatatcgcacattgtttgatatcatacttcaaatcttaaagatgctagctgtataaaacagtacaagacctatacccacttcattagttgattacatatattagtcatcgactttgctacagttggtgatgaggtgggtgagtagaagtattcatggaaagccattagagccttctaggttttgtggtctgttattccttcagtgctgaaaggattattccacataagttaaatattgctgtcagtactactgttgtacttgtggtcatctttgttgttgattttttcactcaccatgattggtgtgcttgctgctctccatcgcaatcactggtaacagttgtcgttggcagctccatgggttacaacagcagaggacacgcaagggggagggagggaaggagagattgcatttccctctgtaattgctgctgcatgctgatttttttcctgctgtagttgctgattcatgctgtttatatgcttacatggtgtcgattaagatggcttctaaatcgcctagatgcccaggcagtgttgcagtgcctccctgcgctcatgattatctaagtactacatttgtattgcaaggagaaaatgcaacaaatcattttgagtagttttgtagtgcgacatggtagttgacagttataattgtttctcctaagttgatgctgtgctttaagcctgtggtttgaactttcaaccttttggtaggttacattgaaaatatcatgtaagtccacagtgttagaatgcattctatcactgtttctaggaatattataaaaactacagatttcctttcacattaatattttcatacttatttataactaactaaatatgaaattctgaccaagctatgtacaacaaaagaaaatagcctttttctacatactttatactgtaccaatcatcaacctccccgcagtcttggtttactggaatatttattatgcacacttgccatttaatgccctgatgtttttccgtgtttccttccagattgctcttcttattgtacaaagagggtacacaatgaaccctccttgcccagcatctgaatgtgtccatatgtggtaaggaccaaacatacttctcttcacaacgtggcaaatatcctactcgttggatgacaataaacaagttttactatacaagttttactatggtggctgaaccgctgaagtcaaaactgcttctatattttattaaaacttatcatgtatgaaaaccattgttggaagttggcccacttctagatatcattgtccacatattcgatatcttgtattcttgtttctagctaacctccgtttttatttgctgctggatttccctatttaatttctattatgaggttacatttatttctctactgttgcatatcatcccctgacctggattctgtacaggggaccatctttgattggctcattaaaggacaaatcattacataattctttgcgtcaacctgcactcgatctcatcaatatcctcataatttctgatgcttctgctttgatctcttttaaaatgaagtatgagtctttcacaaagggcgatgtaatcaattctgtcatatttgttgatgatgacgatgaattgcctgtcttctgtgatgctgaagagatggattacggctgttggaatgatttcaatgttctgtacaagttgacatgtcgggaatgcaaggattggagatgtgtccctttgttatggtacctcataatggttcagttggaaccttctgaactgcccatggccttttcaaaagcagtgttttgggctctatctcatatttctgtgttggagcctggagtatctacagagtcttcagtgcctgtgaatgattggttgtcatcacatgctgaagaagtattgccaacattttcatggcaagtcccaaatggtgcagatgatggtggagttggaaaggagtgtatcaatactctcaaggtgtcacaatcttgtaccctgctattaaaaatatttaaaaggttgactctattttaccagttcctattcatcttaaaatctttccatgccatatctcgtacttattgtaatccataaatcctgaatttctccagtatattgcacttgaattctttctagatttgccattcatgtcatcatgcaaattgagcaacgtgggcttctaaagcaatgggcttgggaatcaatgatggcggaaagcttgattttgacactagttgatcataatgatgtaagggtattgctcttgtcttccattctaccccttgcgcatctgagcacttagtatttcttcttcttgctatacccactgtagaatctgcggcaagttgggcgagctgtcttggagcttgcgtcacaaggacggggtttgacatctgggcttcaatttctgtgctcgagtgcatcttccctgactgccacatttttgggtctaagatatgcagttcaatcggtaagattttgatttttttacatttatttttattgatgttgggaatttcctggttgctggctggtgggtacaggtttctggcgctggcaggaggaaccccaccaggaataatagttaaaagttttaggctcaaatttgaataagaaccaattgcctgatgagactgtccagttatcaactacaaaccaatgaataccatgaaagatcagagcacagagatttgcaaacagatttcacattgcagttcatttgatgattcatctttgctagtttctaatggttcattcaataatagttccgcaatagatgtcatattagtgtctcatattgtttgctttggcaccaatttttttagcatgttttttttagacagaaggccaacggcccagcttatattgaaagctagaggttttacatcgctgggggttacccagttcaacagctacacaaaaacagggggggtagtgatccttacatcagctttatagctgagaaaaaagattgcacgcaggccaaaacacaaaaaaacaaagccctaagaaccgtgataacatgtcatcccacaatcaatcttagcaactgcacggcagccatcatcttctcttccaactgctccaactggttccttggcgccttccttagtctacgccactgtctcaaaaagaaaatcactcgaaagatcagcgtgagaggcgtagaagggatcttcttattgaaaatcatgtcattcctgggtagccaaagtgcccaggctgacgcccccaacaacattagtaacaggttattagatttatgtcctggtaagccaacaaactcttcaaaaaactgttgaaaagaagagggaggggctcccaatctagtgcatctcttagaatacaccacaggaaagtggccaaagggcaagtgaaaacaatgtgatcagcatcctctgagctgtggcacagggtgcagctgtcctctcccccccattttttcttagttaattgcgaagtggactgaattctatctctgatggccagccaaagaaagtgcttaactttcagatgtaaagtagcctgccagatgtctccacacacgtgatcgtcgcctatgtcttgcatttccaaatattagtcacaaatctttctgaaaattgcaaattggcaactaacttgttgcagacctccttgttatggctgtcaaaactcaaaacaagaaacagtttccaacgctcacgtccaaattgtctgggttgagcaaagtatttctagtcacaactgttataatacatattgtgcattatggaacttaatgcctccaaaatccatttgctaaacatgcacccaagtaatttgctaagcgtgatttgcaggcaaaacttggcgatcatttcctaatggttgaactaattgttgttatatcaagtatatgttccacaaattgaagaagtgggtggacatggactgcagactttgtattctaaaataaaaagattcagacttaaactttaaatagactgccgtgtaagcattccaaatctagcccaggaaatccagtttgttctggttatcactatgccaggaaactgatcctttgcatgaataacacagaaacatttatttgatattcaaagcttcatttatttacctgggtttctgaaggaaaatagcattgctcattttaaggagtgaggattatcaatctctttggttccaatataagcatggttctctgagagggtctaaaaaaatattatttcaatctctgtagctgttcagtccaaacattttttcctttaaactggaattttttttgagaattttctttaaactggaaataatcatgttctaccttatttgaaatgttcaggtggaaacaaaatcagttttggcagattttcctagtcttcatcacttgttttttgtcatatgcaaactattaaaggatgttgttgttcaacaaccttcagttgcactgcaagcaaaaccttttgaagggggtttcctgcgccagtccttttcaaatgtatcagtcaacctaccacaacattcagttgacattatttcttgggagaagttcagcaccttgctttcaggagctctctggccttttattttcacatgcctgcgaaagggagatgatctaatcaataccaaacagtgtcaggtacatctctattgctttgacttactgtattattgctgtgcacatcttcatttctttgtttcatcatgatctcaattttatttcagatatcatgtgttcgattgcttgagttggttccccttgtgtatgaaagggtttcttcatattcttctgccaagtcatgtggcgtgccaacaatggttctggaccctactgatattacgtggctttttcacttgattaattggggcaaatcatcactccttgtaatcattagacattggaagcagtgcatgctatctctaattaaaatattaaaaggttcacttggtggtactgttcaacactacattgaagatcttggtagtatcatttcacatggttagacctctaatattttcagttctgtatgttgtttagatgtttcaagaaatgtttggtagcaacttatataccattctttcagatgcagtcaatatcgatgaactcagcgagaaaatttcagatctcaaacttgcattgtccaaggaggcttctgcaaaatccgaaaggagagtggtagctggtgtatcaatgttcacagaaccaattgctggtattccttctccagctactcagacggctcaggagagaaatactggcagggacaatgttgaaaccatgaagtcttctcgatcgacatgtactgaacatataattcttctgtcagatagtgaagaaaattcattgacagctgatgtgtctggtgaggatgttttgtcatcagttaaagatagtgatggatctggtacttcagatatgcagaaagaagtcgagcattctgaaccaaggatgcctactgaagatagacacgtgtcactaaaacaacagatttgcagcccggccagtgatattgtagcatcttctaaacctgtatcaaaagatagaagtataattgctgccaaagaaggattgggtagagcaaaaattccaactgttccagtgaatacaaatgatacttcccttttaccaaagaagattaaaccacccgctagcaccatttctcagccatcgcgttctaatttgtcatctggtgctgaaaaatttaaatcaatcttcagagatttatctgatgacgaagatgatcctttagaacatgcacttgatagctgccgaaagccacaaattcgtttaacaaagtcatgcttattggttcctaaaagacaagtagtccagcttcctttgtctgctgaaaagagacatacttctggaagaccagatgctagttctcgaagactgaaacctcctaaactggacagctggtttaagaacatcttggaaatggattattttgctgttgttggtctaccttcttctgagataataaagaaacttgctttgaaagaaattccggtatgctttgattcacaagctcaatatgttgagattttccagccacttgttctagaagagttcaaagctcagttgcagaatgcttatgtagaaacccctgctgaagacatgaattgcggctccatatctatcctctcagttgaaagggttgatgagtttcttgttgtacgtggccgcccagataaaaacgactgtctgaaatccaaaaactgtatggagaatgatttaatattgctcagcaaggatccactgaatagctctggacagcaagttcatgtgcttggaaaggtatttttgttgcccatgaatatttgttgccccaacaaagtatttttgctattgcgtaacacatttactatattttcaggtggaccggcgtgagagtgataaaaccaaggcgttaattcttgtaataaagttctttctctctaatgagaatgcacgtctaaataaagtgaaacgtcttctcgttgaaagaagtaagtggttcctgaataggattatgagcatgactcctcaagttcgagaattcagtgcgctttcatcattgaatgatataccagtgcttccagtaatcttaaatcctgtttcttgtaagtcaatccaccatggatctggaaaagtgcatcttgataaactttcacaccctatgcgaaaagttttgaagtcatcatacaatgacagccagcttgaagctgttagtattgctatcagatcaacaagcttgaaagcaaaattcgatctctctcttattcagggccctccaggtttgtcctttagttacgtttaccagcaatttgtcacaattccaggcataaacaaaggaaactttacacttgtgttttctgcaggtactggtaaaaccaggactattgttgcaattgtgagtgccttgctttctttacatgcagccaactcctcacaaagaaatgaatccttcgctagtgctgaatttaacaagccaagaccaaggctaagccaatctgttgcagtaactagagcttggcaggatgcagcccttgcaaaacaacttataaacgattctcagagagaagtcccaacagatcggctttcaaaaggaagggttttagtatgcgcgcagtcaaatgctgcagttgatgaacttgtgtcaagacttagcgaaggattgtatgacactgatggaaagctgtacaagccttatatagtacgggttggcaatgcgaagacagttcattctaattcagttcctttctttattgacacacttgttgagcaaagattggcagatgagttaaagaagaataatgatagcaaaagtttatctgatactgaatcctctagctcacttagggctaatttggaaaagattgtagacagaattagatactatgagttgaggcgaaaattattggaggctgataaaacagaaaatgactcacttgttcccagtgattacgagacagatgaagtttctgatgatgcaattggtgcaaagctcaactttctgtatgcacagaaaaggaaagtttctgccgaacttgccactgctcatgcacgtgaaaagaaaatagctgatgaaaacagatttcttaagcacaaagtgcgaaagtcaattcttggagaagcagaaattgttgtgacaacactcagtgggtgtggaggtgacatttatagtgtttgctcggaaaccgcttcagctaataaatttgtgaatttttctgagcatgctttgtttgacgttgttgtcattgatgaagctgcacaggtattatcgcaatactaacttttttcttctaaatgatgatcgcactatgttttattgaattaaaactaagtttgtttgggcttattctgtaggctcttgagcctgcaactttgattccacttcagctactcaagtcgaaaggaactaaatgtataatggtaatttctgttacttcttttcctacaccttcatgcaattgtatggcacttgcttttgcttactgatgtcttgcttgaaggttggagatccaaagcagctacctgctacggtgatgtctggattggctagtaaatttctttatgagtgtagtatgtttgaacgcctacaacgagctggttatccagtgattatgctcaccaaacaggttattttccgtgatatgctccgtgatttctatagtatagattttttatctgtaaattttgcagtgtggaagtaaagattagtgaagtaaacaggaaattttgcaggttatttttgatttggtaaaatactatatcgtagctcagtgatgcttggttacttgtgtcagattgcatggtcccatgcccttgttagactggttcctgagatttagttctatgcgctaattttgtgcatggactcattcctatatatgagcaaaccttagcataccatttttacaaaacagactcagttgttaacatgattaaaaggaaccaacatgattttgttttttttcgtatgttaaaaatatatccatacttcatagttcatacagagttccaatgtcttttagtatgcagctacgtacatctgtatgtgagaagagcagtcagtgtaaaccatctgctgatttatgccaattattatttttgactgcagtaccgaatgcatcctgaaatcagcagattcccatcgttgcatttctatgaaaataaattgctggatggtgctcaggctgctgacaagtcagctccattccatggtcatgactgtcttggtccatacatgttctttgacgtagctgacggccgtgagcagtgtgggaaaaatgctgctacacaatcgctctgtaatcaattcgaagcagaagctgcacttgaaatactgggatttttaaagaacaggtaacaatattttcttcttcaactacatgcttaaggattttcattctgtagctaagtgagactttatacttgcttcatgaacagatatccatcagagttctcctgtaggaaaatagggatcataactccatataggagtcaactctctttactgcgttcaaggttcaattccttttttgggcctgaaattgttgcagagatggaaataaataccgtggatggatttcaaggtcgtgaagttgacatcttggtgttgtcgactgttagagcctctaattcatcagacagcagacatcacactggtgaagcgcgcagcattgggtttgttgcagacgtgagacgtatgaatgttgccttaacacgtgccaggttttctctatggatagttggaaatgcaaagacattgcagaccaattcacattgggcttctttattacagaatgctaaagaacggaatctgttcatctcagttaataggccataccgttcgttgtttgagaaagttcgttcacattcagaagatattcatggttctaggcatacctactatacaagtcattgtaagaagaaggaaagtggaaaaaccagtatgaccaactcacagaaaattgatgcacgaccccacaaagaacatgcaagacatactgtcaggactgtggaaacagcaaatgaacgtttaccaaatgaccaagcaaaaagagcatcacgctgggatcggaagagtccaaaagctcatgaacccttccatagaaaatctagcaaggaaaaggaaccagtaattcaggatactgaccaggacaatgcggtgagaaaggaaaaggaaggagaagggctgactatccataatgataatagcctggagcttgctaatgttataaggcagagggaactgaataaacctgtcaaaccgaatattcatacagatgctggtaagaccttatgtaaccaagattctcttcagaattctgaggttagaaaggatgtcaacaaaaaatatgataatggaaatgtgaagggctcacaaaatcatgatacaaaagcaacagtcatgaaaattgatgcttctccaccagcacaagacatgcagaagttaatacaaaaggctaaaggagcaaggaagttctctgaaaaaccaagatttggtaattcgagtcaagttgattcctcagttaaacatgaggcaactctggaatcagccaataagaatggtggtgcttgtacaccaacaaactcagaaatgaagaaaatggccggtaaggccaaaaaggctaggaggttctctgagcacccaagatctgggaactcaaataaagtggaccattcacttccgtcttttgatgaagaaagtagccaaatgccagaactaaaagaaaacaacttaactgcaactcgtcaaaatcatctgactgcatctaggaagcgacaacgggaggatattgagtcattactttcatcagctcttgtatcatcaaagaagccttcttcaaagtgtccttccaagaaacaaaaatgagatcctgcagcaaaggtaagtttttcatgctaccttcaatttgctgtattataacaaagttaatctgttctgaagttagtgtttgctcttttttttaacctgatacagagggggaatccttccatttggaagtcagtattgttgactttagaagtttatattcttttatgcaaacgtttcttgcactctatatacaaaattccatacctgtggttgcagtacatttaaggactataaaatagaattggaagaaatcaccgaagcttagctagtagtggtagtagcctgtctgttatgagctacttcctccgtttcatattataatactttctagcattatccacattcacatatatgttaataaaatctagacatatatgtgtgtctagattcattaatgaatgtgggcaatgctagaaagtcttataacctgaaacggagggagtaatagttagtaccaatcatgttcctggtctatttggatttgctattattttcttctacatatatccccctctaaatactcgtatggaggctctacttaccctataactgttaatcagctattcctactaatttgaccagcccccatacagttggatatgcgtttgtactttggatccactaagctttatatgctcagttagacatgtaaatcagtgatcctggaacctcagcttgtgatacaatttccactttttttggaacgcatctgcgttccacctattggtggttcacttaattgctgtgtgctggatattttgacatgctatcgattcaattatctgaagctaatactcttatcttcaaactcaggtggcagcagatcatttatccgctcatggacccttgtagcttttttgacatgccgacgagttcatctcatgagttctgcggttgctgtaatgtgatttctccaccgacgccatggaggcacttggattttgagactcataagctaacatagcaagtgattttcagagagcaggaattcttctgacattgatagattgttcttcggagcttttctccctgccgaccaccgcccaatctggatgtgaaaaaccaaacaagacaacccatttagacaacatagaaggtcatttttggatgctgcttgtgtcttttgcctagttcagagatgatgcttgtagatatgcaagccaattttgcgctgtaaattatctgtacatagtgcacatatagcatgaacatgacggaaccatacacatgcttgtccatgtccaaaatgaaaaaaaaaggacgtggctcatcttccgaccagggtgaaagcttgatgcaatgtagctcctcttgtttggactccaaattcatcagtacttgtagtactttacaaactttaaaatgattgcgttccttaacatggtaaagcagtacagaataagcacaggataatcagtgtcaacattttcccagacagggtacggccttcagctcagtcccaaaacggcccatgggtcatcagaccgtcagctcagtcccaaagcggcccatgggccatcaggttaactgcgtgggacatgatcaggcatgcagtcagcacatgagacaggtgcattatccaatatctgggaagaaacttggtgcttaagtatatcactgacgtagggacatctcattgtacgtacaccctaaatatgaatgaaaatatgatccagacaggggcatctgattgtacatcctaattttgaaaaatagagaattccttgatagacataataggacgagtaaaaaagcttgagactgtcatgcactttccgtctctttgttttttctctactactttacaatgtcataaacttatataagaggggaaagaccagttcggttgtttcgaaggccgtgtttagttcacctctaattacccccaacttttaattttccatcacatcacatcacatctaaaacttttctacacacgtaaacttctaacttttttttttaaaacttccaactttttttaggatctcaccatctcaccatctcacgccgtatattcttctgaggtctcaaagtcgaagcccttgaagatcagagggatacaatattttgcatatttcttcaaacctttcatttcccaccagactgaagataaatacatgaagaaaattgccagcctgcgtcgcatggttaacaggaactgcgtaagcaattaggcatgaaataacttcaactgcatttcgcgaacgcgccattacttcaactgcatgcttgacatgtccaacaacatcacaataagtcaataagaacacaaccttcctccctccaaaaatgtaaggcgcataagctttttttacgtggtctctaacttaaaattttgattattgatttctttcataatatatcaccaatataaaaagtaattgcattagtgatatacaaacttattagatgtgtgcaatttaatatacgaacttgtaaaaagctcattttgagacacaaacctatctaattcgtgtgaactaggacaaacatagcttatcaaggttaatattaccaagttaatcttgattagtagtgagtatgcataagacatgctatacttatacttggtctctactttccttcgtcatttgaaatgctgaatttcatatttttctatcccatgtatcatagttctgttttcatatcttcctctgtaatcacaatgcctatctttttattgaacaaatatatatctaaattgcaacctatatatttatatagtatcctaagcaacacctaaataagattagcgattaatgttattttggccctagttcacacacactagatgagttcgtgcaccaaaacggacttttacaattccgtgcactagattgcactcatctcacaagttcgtgtatcgtcaatgcaatttactgtaacataaaaacactttaaaatatgacgtggtatgcatagtttaattattagccaaaagttagaaaggttgattttcttaaaataaggatgcatatgaggcaaatggattatagtttaactgacgagaaaatatactacaaaatgagttttatcacgaactttaactataacgaagatagatatcatatggttgtctggttggtttgggatatataatttgtgcacattttttttatgtaccgcaatatactgtatgtagtaggggtcgtacacacgtgtggttacattggtgtgagtgttgcgtgtcatgcatgcatgcattgtcttactccctctcccaatcccaacaaaaatgagttattctttttcctgacggaaaaatggagttgacttataaagttgtactgacctgatataatcaaggggaataatctttttgtggaagtccttgatgagcataatgatagtgattactgcaattggagcacgcgcatgccgtcagagatcttaacaaaaaaaaagttaaaataccaaatgacatgcatgtgttcactccgttctacattatagttttaacgtactctttactcttctaagattcactaatattcatatatatttaaacatacatacatgaagcatatatacatataaatacatatataaatctatgtattattaatgtattaaaaaaatcatacattttataatgtgaaagagagatgtggtagtccgctaggcttgattacaaagctactcccccgtttcatattataagtttgatttttttacttgtcaaactttgattaaatttatagtattaataaaatatgaagcggagcgagtaaaaaaaaatctaatatcgccattgtccattgaggcattggatcatgtagtacttcgaaatcaatagcgatcatgaactcaccgaacttaagccggatgagcaggtcgggggagaagccccgtcgccggagatccgacgccatgacgctgagcttgtagaactcgtacgccatcgcggcgtcgaggcacacggccggcgcggcgcgccacagctgccacagcgcgaggcacgccatggccgcgccgaacactacaccagattctcacatctctgacgggatacctgtgacgggcaaacgaaatggtcactgatgaccgtcacctttgacgggtcatacgggatgccgtcatcggtgaggcatccggctgcgacccgtcacaggtaactagtcacctatgacgggttgaaaatagaacccgtcacaggtgaggttacctcacctcaaacgggtttaagtcctaacccgtcacaggtgactagttacctgtgatggaaacatcataaaagtcttacataaatgcagcggaaagaaagaaagacaacaggagctaagccttgacttgaacggcagcgggaacaccactccacaggcatcctcgacggcacggacaaagcctactcctcggagaaaccttcatctgacccgaactcgaactctggggttgggaaaagtagagcaagactgagtactacccactgtactcagcaagtcataccggaataggggtatgatgcagggaatcatcaaagaagagctgaagtggttcatttgcgtaaagcgagcatttataaacagaaattgaaagatttaaacagttgtaataattaattaacatcaactatccactgtccaacgctaacccatgttgcgacaggcccaaccgtccacctgaactatccaaattcaaaagattacactaaggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgctacaagcccagccgttgcccacgctggcttgtggtaagtacgataagttcttccagggcatcccgcgaaccggtccttaactgccatgggtgcgaccagcaaaaccatgcacccacagcccaccatgtgattcattttatttaaccaacaccagagcggtggtactaatccaacattatcatataaacctatagtctaggttttaaatgagatttccccatagtgtgctagttgaactaagcatggctaagcaattcctagtccaaagtctaatcatgttataacccaagctaacaaggagcatggtgtccaaaaagcatggctgtaacaaaaggtaaccatcccatagtataattgcaaaacaaatgcggtatttgaaagaaaacattaggacatttgcaatataggatcaatatgatcaagtgacaagcatgacttgccttgctctgctgctggaggaacctcggcgactatttcgaagtacaccggagcgtcggaagagccggaatctagcgacatacaaggcaaacattgcaaacaggctataagactactgaaacagggaacaaaaccatttttaatggattctacacatttttcttgatttactgagacttgattgggcttaaacggagctcggatggattagttatgatttttagaagattcactgtgtttattactatacaagaaaaaccttaaactatttattgcgcaatatattccagggctgacgtcagcacggagggggtgcggcgccgacatgcgggccccactggtcagcgactcaagggtggccggtctaccgtggaccgggaccacgcgagtgatccaccgccgatccacgggatcgacggcccggatcggcccggggccgatcggacggtgcggcggcggtcaggctaggctcagctcggcacaaagccggccgaccggtcacggcgacggcgcgcgcacgcgcacgcgcgttgccgacgacggcaaccgacggcggagacggcggcgcaaagncggcgccgaagggcggtgatgctaaagcgacgactaatgggcggcggcgctaaaacggcggctaggagggagaggaagggaaaaagagggaggggggtgcctcaccgagggtggccggcgcggaggaagacgatggcgaacagcgacggcaagccacgggaggacgacgtcggcgggcggacgagcttcggggtgccctaaggaaggagaagagagggattagagagagggagatgagccacggagaccggaagccatggccgaaggcggcggtagaggtggtgctcacccgagtgcgagggaacgagggctccggtgacgaacctcgacggaggaggggtggacggggtggatctcggccacgcgaacccgacggcggcgacggcgcggcctggcggcgaccctaacggcggctagcggcggccggagtagcggaaaaggcggcggcaaggggttgcacggcgcgggagcgatgggaggctcgagagagtacggcggaatggggaaaaagtgagagggagcgacggggaagcttaaatagggagagagaggaccgggcgtggccgggagaggcgggaatcgccggccgacgtgggggagtgggggaggagagaaaggcgggattcgaaaatcgaatcccggccatctcgggcgcgggcgcgagcgggagagaaaggggagtgggcgcgggaaacgcggcgcacgcgcgggcgtggtcgacgtggcccgaaggaggcgaaaacgtgggcgcggcggcggttgcgagcgcggcggcgcgagcgagaccggcgggaggtgggggaaggacccgacaggtgggccccgcctgtcggcgaccccgaagaggagggcggcgggacggcctggctgggcctcggcctgcggccggcccagcaagggggagggggacggaaaggggagaatgggccggcggcccattcgaaaaaaaggaggaaaaagggagggaaaagaaaaagaaaaaggaaaaaggactttccctggaattacaatattgcttgctcaattttaattggttaaaattatttctagagctctgaaaattccactaaaaatcctgttaatgaatttcgacatgtagaactcaagaaaaattccacatgtcaaatccgattattatttgcattaccttcttagggttttcttttgatttgggtaccgagctcgaattcgcgctatagtgaatcgaggtcgtcatcaaccgtc

SEQ ID NO: 66781 - DNA, 2983 bp, Oryza sativa
agcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagtaggacatcacgaccaccagccgttcctatcgtcgcctgcctatataactataggttttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtctattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattactattcaaaacgtgctaattaacctcttatttattaaacagaaaggtagagctggcttcaagatctcacccatcaacccccccactatcagaggcgaagtgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgtttttgtcacgaccgggaaaattgccttttcccgaacgccagtgtattaatccccgtcccaggaaaagccggggtacaccacacaaacatgatataaaagacacatctttattatatcgataatatttacattattacaaaggcacttcaggcctgacaaacaaaaataaacagcagcggactagcgggcctacggctccatcttcataggcgctcaactggggtataagccaggactccacctaagacttcttctccaaagcttctcttactgaaggggggaaaagattgagcaagaatgagtacaaccacagtactcagcaagccacaccggagatgcataattaatgtaagggggtacaaggggtgataatataagggttaggttttgcagaaaacagcattcaaaagtcacttagttgcccaaagccatttcataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacatttttgttgttgagcaaattttaagaattaaaacactgacttgggtacattgctcggcttgcccataaccgagggcgcggctattcgaatagattatactctgatcagaggtgtacatctttacccacaagacacgtcttcctcacgtgtaaccacgtgccacataccaccacggtatacggacggaagacgtgacatagttcccaacccatcctagccataaacaagagtaccgacccaatcccacctacggccggaacctccgggacaggcaggcaggactgagcccctagcagcagggcaccaaccctctgccatgacatctcgactaccgggccgcagctcgtgtagccttcatttgccctggagaatgtccatcgacccccgacttcat

SEQ ID NO: 66782 - DNA, 2310 bp, Oryza sativa
tagccccaaattttagttggtaaaaagaaacacgaatattagaaaatgacctaatatcaaataataagaaggggtgaggtttcgaacccaggttatctagcctaccatcttgtgaagctagccggagcccgaaaaacctttaggtgtttctcaaattatagttggtactcaactgatttatgcgcccaggtggtcagatgctagccagtcctcaagttttaattgaagtctataacaaatcctaatcctgttatccaaggttcgattaagaagacaccaaagaaagaggcaaacaaattgtggacgagccgacggcggcacatctctgagcttgttcacggcaagggtgtagagattggaggaggccgagcgctgccgaggctgtcggccgggtggcgatggcagtgtctcggaggaggagaggctaggaaacccgctctcgctagtccgggcgccatttctttggcttctcgagggagcatggttgcgcgagacataaggcagcctaatcaacacgttacgtcagctaaaactgtcgtagaaaccattaggacccccaaaaaagaagtaaaaaaaaagtaaattacacccacagtacaacaacttgacatatggatgcgatatagtgcaagaacttgataattgaacgtccgagtgcaacaacttgacaagtggttgcgttctagtacaagaacttgacaatttaatattttggcgaatcaatttggctaagcatatgctaggtaaggtttttcacgatgtcaatatgccaatacacagtaatcctatggatattaccttataatattgagtttaatttttaagaattatattgcacatacaatttacattcagttacctttaagaatttttttgttttcttcaccttatcaaatatcaaccgaaatataatagtttctacatccagtttaattgactttcagttattaattattaggataaaaatataaatatgtttatacaaatccacgctagtatattgtcaagtatttaaaattttgaatttatataaaaaaatgctccaaataattaagttatcacaacttcttaatttattgtatcaaaatcgtacctatcttgcaagttgttgcatttatacgatcacttataaagatcttatactaaattgcacattcttgccaagttgttgcactataacgctcattttttaagttattacaccaaattgcatccatctgccaagttgttgtaccgtgggtgcaatttacttaaaaaaaaagtctctttcataatatctcgcagaatttctacatttctgttccccaaaaggggccatgaaactggcatgcaggaatccttcttttatgccaagcaacacggaacgcgaaaaagtaatcacaactcacaagcgcaaaacaagtgcttcattatttgaggaacaaagatgatttttttttgggacatggctcgttcaaagatgtcgtcatgattggtttcaagtgcagtttggtcgtaggatactttagcctaatctaaatcgtcgttgtccttccagccgcaattatcctaaattcccaatcaaaattcaaagccttttcggaagcgacactgccatccactggaagaagaggggaacaaaacaaaaaacaaaacgcagcaagattcctcgcagtctgcatcatcagcccatgccgagccaggcagctgaacccaaaatcattcgagcccgtacgcatcacgcacagcaattgataggttctcaattccagcgaaaactggtcggatcagttcaataagacaaaccactcaatatcctgttcatcttttttaaaaaaaaattcaaactgtttttcttgttttgacaaaatctatccaactctcaatcttgttttgccggtttaccaatgttttccgaaaaaaaaacccggagatatcggttcggtgaccggactgtcaatcctgaacccagctcaccaccaccacttgtaggcttgtggcagcaacaagctgaaaatgacaaggagaaatggaagaaaaaggcagagtctcgctgtgatcacagctcactgttggggagaatgaaaaacggttgtactcccttcgttccataaaaaaccaacatattaccagatatgatactccctccatccaaaaaaattaaactaacctagaagttggatgagacataatcttatgtcccatcgaactcctaggttaggttttttttttacggaaggagtacctaaacatatatctatattaggatatgtcacattgatactgatacgttttttatgggatggatggagtactaaaccatttgctagg

SEQ ID NO: 66783 - DNA, 666 bp, Oryza sativa
agaattgtgggtattcccagctttatttctgtagatgtttctttggacattatacagtaccaggaagggtatgtgcactttcatgttcttttctcagaagttatggaacaataggtttgtagacatgtaacattcatacttgtttgtttagatcacgaagaaggaactggatacagctgtaggcatacttttgccaggtcatatcccaagggctcaaaaaagactgatggtcaactatgagaagacccaagtagatgctgcagtattgtcaccatcaggaaatactgcaaggttcagtgtgcatcatatttttggcattggttctgttggaaatgacctggctctcccacaaataaaaaaggctcttcctccctcgcaaagaaaaaggaaacaaacttgtgacaagtaaggtaatgtgtttttcatggtaatcaaatagcactaaatactagtaatttactttatcatgatttaagtttctgcatgaatgtcgttgtctttagatactagtttattttgtattataaaaacagggaatgatataatttttatttttttttgtaaaatttggagggaaccttttaggaatctaacatttgtattggtatatatattgaactgaagttatgattgttgccaagttacgtttgcttttaaacttcactt

SEQ ID NO: 66784 - DNA, 5393 bp, Oryza sativa
  unsure (1)..(5393): unsure at all n locations
ccgtggattcgcatgcnatcaggtcaccctgcctgcatgtccaccgccggcactagcacccacgctcgcccgccggcgcccgttctgcctgcttcgcagccgcgctatcccgccgccgtcgcggcgactgctgcatctctctccgctgcgcgcgaccgccacgcccgctccgccgtcggccgcacacacgcatatgcctgcctgcgcgtgagaagttgagaagagaagagaaaataaaagaaaaaatagatgtgggcccacatcattttctctcactgacatatgggccctatatatttattttgatgctacgtcagcaaaatcaggcatctatactgtcttggaacctaaattagacagtttttgtatagtttaggggtgaagatttccggttttatggttaggggattttaaaaaatctcgctgttaagttgagggacctccggtgaacttattccaaaaaaaaggtggtgatcaccttgggccaagtgggctttgctcattgggcctccaaggtgcaaaccaagctgtgcctattcccctcctccggtcgtcggtgtgtcgccgccgccaacccatcgcctcgccgcaaccgcgaccgcgccggcgagctgcaccgcccccgtcgaagtttcccgcggagctcgtcgttctcgagcctcttccgatgctttctgcacggcgagccggcgccggcggcgccgccgggaagacgtcgcatgctcgcccctgcaaccctggttacccgcggcgctcgtcggtcccgatgaccggcggcgacgcgactagaccagccgtggcgagggcgcttcgccttccgggtagtgggggaggggcgggtttccagcggcgggagccccaccgatggctccgtccctgctcctcctcccggagtggagatggcgccgccgccgttctcgcctcgcgatccgggagcagcgacatgggcctcggggtttcttctttctcgccgtgctcgcttccccgccgcgtcgacgctcctcgccggcggccagtggtaggtgaaagtttctctcggatttctctcccgatgcagaaatgctgagttgctgcctctgcagtggtgttcgccggctgctcctcctcctcctcctcctcctcgtgtggaggtgcagagcgtccggaagaggcgaatgagcgaggaatgggaggcgttgaaggcagccatcgccgacatgttccggcccttgctgcgaaacctagctgacatttgctctctccgcagcgcctacgacttcgaggactatcaaatcggcatgctctttggtgtgtttgagttgagttcttaccgcaattaacaatgccgtcgattgtatatccttctgatcaccagaccacttatgttattcggtgaatgtgtatcaacatttgcaggtgcgtttctcggatatgtcgggtgctaccagctgtggaaggcggctccttccgtcttcgttgatgctgcccttgcctttgtgttttacaagctcagcgttgtgtcctcagagctgcaccggcagcgcaagacaaacagcttgatcacgcggcttaaattcggtattcattttcttcgtatttgatcagcagtttaagtcatatgtagaattgcatctccaaaaaaaatagagacataacattaataacctcaagtaagaagctggcctttttccaaggtttgatcactcattttgagtattgatgaatcactgatggaatatttaccctgtttggatgggaggatttccgtagctcaacagtgctatagtatcaagttgatacatcatgtagttggcaaaatcaaataaaagaaatggtataaacttacagtcccttttcttagttagaaggtggatatgttttggagcttgggtgcaagtagttctcagtttagtttgttctatgcctagaaattataacctcaggctatcttatttattgactactattcaatgcagggaccatacttatcatggttatgaaagacatcaagaagaactatgtactcctggacattattaggtcagtatctattttaaaactttttctttgtgagagagaggtaggaattctatcgaacttattaacagatgaaaaggaggttcaaagttgcaggacaaaatcactgctacaactgacaggtcaaactaaaatgaaagcaattgacaggcctaccatcaggactgccaggagatggttccttgttgcctgatactaatgttggaaagccctttgttcttgttatactacaagaatacttggtggcagtcgctagttatagactgataggagaatgctggcgctgatagtagcgtagtgctgtagtttcatggtggttttgatatgcttcctgcttttgttggtttttgtttaggcagtgaagccagagctggagattgagaatctgagataatattatgcccctgtgtttagaaatgaacttcttctcctaccatttggagctccttgcccctgggatctgaattccgagagccctcttaaacgatactttctaggactaaatatttttcaaaatttccagatatcctctaactatgaatttcaaatgttaatacgaaattacttattctctagtgcacatctatctaaattccatgtgtgatgctgtggataatagaggttatgttatgccatacacacagtggttgctagctctttctggcatcagtaaaatccttatttgcgaagattatcaccatcctagaagcaatgatggaaaattatgtttgcaaagagcagaccagaacaacacaattttttattgaacattttgtataattcaaagaggaatttacataaaagagcaccatatgctgtagaaagtgttgcatgtttcttagggccaaaaaagtgttgcatattgaggtcatgttacttttatactaagaatatgggtgacaaaagaagttaagttactgagaggacttacagcatactccctccaccctgaaaaaaacgaatctaggactggatgtgacgtattctacctctatccagattcgtagtactaggatgtgtcatatccagtactggtagtaggcaaaaaagaaaaaaagggatgggaaaaaggttaaagaatcacagggccatagggaagtagctggagtgttagaattttgccaattaacttgtgaatttcaaagagacaatgcttcttctacagttctactgcaataatactggggctgttttctcatagttattttatttctcttgttgatatttcattcgctgctaactaaactttgtttcatgatacagaatgccggttttcttcctctacatttgtgcgttcgtattcgatgttgctggtatgaagaagtatgccaggcgctcacttatttcattgtttaatctgctgaaatctagaggtggcatacaagaaatatataggattatgtggtatcctggttatatatctccatatgatgattctgctgactggtgatgcatttgtgtgagtggttcccacttaggagcttgttctaggaaggatggagcttgttctaggaaggatgccctccccttcacaaagttttgtaaagtataataacgaataaatagctatgaacgtatggtgagtctctacaaaagaaacattcttcactgtttaaacatcgacctctcgttgattagtactgcatctgtttccctgtggagtttccttcttgaaaagcctttttagctgaataagttgtgcttaagcttggaataaaattagctcagaatttgtgtgaccatgtgcgtatatatatatgcaatgttaaaaggaaaaataattactagtgagaattctgaataaattgtattgagtcatttgaagatccttaagcttgatactctcttttgatagaccgcgaattagattttcaagtaaattaattgcacattacactatctattactctatagctagtaccaagtatcaaagaaccttaggataggacagtttcacatgactccgtctacactagttttggagcaatttggtgcagagaacatctctcccaataggcgtcgagggaaatatccagcgaaaacccctaaaagctctctaaataaatgaaaatattacagatatagatataggcaggaaatccattaccatcaaatctccaaatcttaagtacaaacttgatttgggagtaagaaaaggataaattcaaggtgaataaatcaagatgaatacaaatagaaagatatattaaaagtaactcgtgcatcttccttctcatgtttcagtcttcactacatatcgatatatataagtcagtttcagaaacacgctggtagatcctccatcaaagctggaagagcatattttgcgtatttcttcatcccggacaagtcccacatgaacgaaagataatatatgtaaaacataggaagcctgattgcacaaagaaagcatggtcaaagcttgtataatacatagtgcatgcttaagcaaatacggcataaaaaatgcaaatccctcaagaacccccaaatgccgagatagagtttgagtggatgatttttttaaacacaaacctgataaaatcaagaggggatatcatattgcggaagtccctgaaggttatgaaaaagaggataactgcataaaagaacacattagatcactcgtgcaatttgaacatcatctgagcacttacgtagtttctttatatcacaataacatgagcaattgtatgttgattgttgcctttgtaatatttcccttttacatttttcacttcctccagttataaataatattgactaaattatactttgcactaggtttagcgcatatttctactttacaccagagtgttccctcgaaagcttaaaatatattcccacgatatatatgccttataggtacactttgcttgatataaagtgtgattattctaaatattttgtgtttaggacaagattatttgatcaaactcctgaaactttaacgagcaataatttcttaaatgcatggttaaaaaattgatatgcatagatttgccttgaagggcaccattataatgttataagcatattagactaagataaaagcaattaccaatatcaattccaaaatattcaatattatgactagatgaaagatcttgtaacccaaagaagcactacctccatttttaatgaaaccgtcttattaaaaaattacaaatcaataaaattataagtcatgcttaaagaacatttagtaacaaattaaattataataaaataagtgatatttttttaataagatgaatggtggaacgtttctttaaaaaatcaatggcatcatatattaaaaataaaagagaagggagtacctaatttaatgcgtatgaacantcggcgggtccaatccatttgcattcatggcacct

SEQ ID NO: 66785 - DNA, 8022 bp, Oryza sativa
ttcaggtagcggaactctcgttttctcagtgtgatcattcctgcgggaacatgtgatctcttgaatacagatgaaaactcgtcccaggtgatggtatgtccttctggccgtgatgcttcgtagctatcccaccattctgaagccagtccaaccaactgatgagttgcgaagacaacccgctcctggtctatgcactgaatcaaccccagcttcttctcgactgtgcgcaaccaatcactggcttccataggatcgacggcaatggcaaaggttggaggctcagttttgagaaattctgataacttgcactgttgctggactgtaggtacttgaacgttgtttgcccctgctgggttgttccaattctgtaatagttgaaaggctgttgccaacatgttggtttggttaaccacaatttggattagctctggcgaggtttcgttgatgcttttctcattcccattggcttgggttcttcatcttgtacttgatttcttggctgctgtgctggaacatccaaaggtacaatgccgatactggcctctatcttgtcaactggtggctggggctgaaattgagcattgacaccttgtggtaatgcactcgctggagttggagctgttgcaacggggactataggactgcttcgggatgcatggatgacaattcgctgaggagcaagcttctgattgtcgggagttgcttgaactgacgtgctggcagctatgtttctcggttttgggcacttgtcggcgaaatgaccccttccttgacaattgaagcaacagatatcttcccgaactcggcattttcttttctcattttgattcctctgtcctggcactggagttaggctgaaactgtaatcttggcgaggatttgtgttgccttgatgcttctctccgttggaactggcgggttggttggccatcttcttcgtcagcagaaaactgaattgacaatcttttggtacatgatcagttccttcacagaagaaacaggtgatcctgctcgtttgacacctgtcgggtggatggtcttcctcacaatgaacgcatgtagtggcacacgagctggcaacatgaccgatttctccacaacgagagcatgccttacgttccattttattctggttgaaactttggggagacttctcatcttcatcatctggggagacttgatctgaatcttcactatcagacactctacctccattagctaaaagatgctctgtcaactgtggtgcacctcggaaggtatttcttctctgacgtttggtcattcctggtggaggccattctgtgctggtaatgatcatcttacggacttcatcttcggttcgcattggtgtttttcttttctgctgaggacagttccttgcatagtgcccttgctcatcacacataaaacaaatgatacttgcttcttttgagtcaacatgtggcacgccaccatgggtcttttgggatgctggcggcatgctgacttgtggtgtgagtgattggactgcctccaactgcacttgagcttgtatctgactcaggttcagaattggcgtctgatgctgctgtagtatctctataagcaatcggttctggttaatcaggtgttggaccagtgtcacacaactggtgtctggtgcttcattcactagggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacacgctacacacacaagcaaggaaacacacgactaacgaaaccctagagggtggcttaggttctgcggctggttctccaagatcttaacttcggcttcacagctgacttcactgcttcctccacttcgctagcagaccctgcggtcttccggagcttcggcgaacaattggcgacatctttttcttcgcaaaaccaaccatgtagtactagttggaaatccgaagaaggaagaaaggagtaaacattttgcaaatagcattgaggaaaggagaaaaagggactttcgcaaatagtttcatttataaaataagtccttaggttttatctacttggcttatcctacagtcgagatggctctgataccatcttgtcgcgaccgggaaaattgcattttcccgaacgctagtgtattaatccccgtcccaggaaaagccggggtacaccatacaaacatgatataaaagacacatctttattaaatcgataatatttacattattacaaaggcacttaaggcctgacaatcaaaaataaacagcagcggactagcgggcctacggctccatcttcacaggcgctcaactggggtataagccaagactccacctaagacttcttctccaaagcttttcttactgaaggggggagaaagatagagcaagaatgagtacaaccacagtactcagcaagccacaccggcggatgcacgattaatgcaagggggtacaaggggtaatgatataggggttaagttttacagaaaacagcatttaaaagtcacttagttgcccaaagccattttaaaaagacgatcctaaagctacacagtattattaatcaaggccgtgaaccctcacgaacctgccttaacccaaggcctacgatgattcagaccgaactggcaacccgaccctgggtcccagctcgtcccaagccaacccaggccaaccattccacgttttagttattaagcaggttttaagaatttaaaacactaacttgggtacattgctaggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagaatgtccatcgacccccgacttcatccatctccatccgtgtacttttgtttatgaccgggctgagccacaaactaagccttacccactagacatgtggaagtacggtagtgctttgcaacagaggcccgaagaccggtccttatgtggccgaggtgctactatcaaaaccatgcaccccgagcccagcctaaaaccattttggggattttgaatagagggggcggggtgaatccgattccacaataaaccaacaattccaaagtgtccaggtgatatgaatatcccaaagtctagagttgtaaaaccgcctaatgttacctaattaatcagcgaagcatctacctaaaatcatactagtggtaccatgagtagagtgtccactagttggggttttgtttattctagggtgaacaaggaaataataacaataacaataataaggtcataacaaaggtaaataggcatgactagataaaacagtgatatcgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaggaaaaaggcttttactctaataaactccatataacaagcagaaacaaagcacaaaaatgggttcttgacttcttaaggaaaaattagagacttgaacggtccaattccgagttcaaatggtcaagttatggccatttgaagtttatatgctctttaaatggatatttgcgaatttcttcatttaaattttaatttaaaatcggatttattgcgtcagccgaggggaggggcgcgcggaccgggtccacgggagtggggcccacgcggcagcctcacggtccacggtggaccgggtgcacgcggcttacgccggccggcgccgtgggtcccacgcgtcagccgcacccgggggcgcgggcggctgacggccgggccccacatggcagccgcgggacgcgcccgaaggcggccacgccggcacagccgacgggaggcggcgcgcccgcgccccgatggtcgccgccggcgaccaccggcgcggcggagcggcgcccgagagaggggagggaagggggaaatgaagcggcggtccacggctcaccccgggtcgacggcgacgacggaaacggcgaccggagcggaggaaagcggcggcgcggctcgggtcgacggggtcgacggcgttccggcggtcggcgaccgaaatggaggggtggacgaggtcggcgaggatgcggcgaagctgaaggaggcggcgccgaggcgggagaaggtccggggcgacgacggcggcggaccggagctcggcggtgacggcggagagagagagcgacggcgcaagctcgattctggcggagagagagagcggcgagtggcggaaacggtggagggaggcacggggagtgtttatatagggttgggagggggagagagcggccggagggaaaggaaaccggcgtgacgctctcgggctccatcaatggcgccggcgggattgggggagggtttccaaacgaatccgagggagagagggagagaataatggggggaaagagggagggaatcacggggaatatttcccccctcttgattgcacgcgggacggacgggagcggcgggattcgcggcggcggcggcgctagggcacgggcgaggcggcgggagtggcggaaggtaggggatgacgggtgggccccacccgtcagcgagggtggcgggcgggcccgcccgtcagcggcgcgcgcgcggggagaggccggatgggccgcggggaagaggagagagagggaaagggatgggccgagccggcccaagagggagagggggagggaaagggaactttttagggtttttctttttataaaatcattttaactttgtttatttcttaataattattatttgtgctctgaaaattccactaaaatttgagggctcctttttgaccaaggagaatttaacaaaaattctccgggccacatttgaatttttcttgtacgtattttaatgtttgccaatttcttttcgaattttaattaattctattattccttttagaaaatgatttttatttcgggatgaatttatcaggacgtgacagatgacctcgccgagaaggctaatccctgtttgtgaatcgaagaacacaaacaagaacaaggtataatacaacaaaaattgcagatgaataattaagctcacaagttggggtcttacaaaccgatctagtggcgaaactgttctcgatagaataatctaaccaaaacccaaaccctaaaggtgacggtggctactgatatatagagtttagggttgtgcaaccaaccctttgatgcaaccctaatgggttccaacacgatacacggcccaaaggcccaaatacggtgacgcagcaccgggacagattctggacgttaatttgttcggtcgattcctgttgactcagaaataatttggatgtgggaccaaaaccattggaaaggttatcttcttagctttccatccatataaagaagccccaatccaagcacgtatgcgacctgagcgcccgttttagtgcagactggttctggactccgaattgacttggtttgggcctccaccttgatttggacgtcctcgatgatcctacatgactctaagtccttctccaagtgtttacttgtccactccattgttcctaatcacaatataatcattaggtagcaatttattctcaaattcgtacaaagaagaacataggaacgaactcacctctaaatttaattgtcgcacgcgagctcgtgttatcggtccttgaatgaccattggatgattgttgtgtgtatccgtaggagtgatgtccacatcagatgaaaccgacgagatcgtggtcgagaaattcgacgagatctcccggcgacttggctccgcgtactccggcttcgtaaactatggggggtgtgttggcggtagaattggatgccttgtatccctcccaaggtgtcctttttatactttggatcatcttgacccccaaggaaggtttgaggatatcgaacccggtacggtataacagaaactctatcccttccgagtaggactttggaaatcacttgactcgtagagattttttccataattcgggacattaacttagacttttgaaaggaccatcagcgcgaggcatcaactttgactttcccaattctggaaatctatcctttctcaagtgcaaccaaactaaatcacccggttcaagcttaacttcttgcctacctttactaccagcaattctatacttttcagtcatctttttaatgttgtgcttagttgtctcatgcattttcaaaataaattcagcacgtgccttaatatcattataaaccctctcactagtaggtaaaggcaagatatcaataggagcacgagggttgaaaccatacactatctagaaaggacttaccttggtagtagaatgtgttgcccgattgtatgcaaactccacatgaggtaaacattctttcaacatcttcaaacttttcttcaaaatagccttcaacatggtacccaaagtacggttgactacctccatttgtccatctgtttgtgggtgacatgttgtagaaaacaataactttgtacccaacttgtccatagtgtgcgcaaaaaatgacttaaaaattttgcatcacgatatgaaacaatagtagaaggtataccatgcaagcgaacaatctcatggaaaaacagatcagcaatatgaacagattcatcacttttatgacatggtatgaaatgtgccatcttagaaagacaatccaccacaacaaaaatgctatcccttcccctcttagtcctaggaaatctcaagacaaagtccatagaaatatctgcccaccgaatagaaggtataggaaaaggcatatacaaaccatgtggattcaaacgagacttagctttctgacaaatggtgcaacgtgccacaacttctcaacatcttttctcatccttggccaaaagaaatgcaaggccaaaacatcttctgtcgttttagctccaaaatatcccatcaatcctcctccatgcgcttcctgtatcaacaaaagatgaacggaaccaactggaatgcatagacagttagctctataaacaaatccaccattgatcacaaatttgttccaagtacatccctctttgcaatccaacatcacttctttaaaatcaggatcaagcgcatattgtttttaattgattcaagtccaaaaatccgacaatcaagttgggacaagaaaatatagtgcctagacaaagcatcagcaatcacattatctttccctttcttgtgtttgataacataaggaaaagattcaataaattcaacccattagcatgtctacgattcaaattattttgagagcgaagatacttaagcgattcatgatcggaatgaatgacaaattctttagaccactaataatgatgccacgtctctacagaatgtacaagggcatacaattccttatcatacgtggaataattcaaaacaggaccatgcaacttctcactaaagtatgcaacaggcataccatcttacccctaatgccaactccactagcatcacattctaactcagaagttttaccaaagtttggaagttgtagcaatggtgtgtgtgtaagcttgtccttcaaagtatcaaatgacttctcctg

SEQ ID NO: 66786 - DNA, 15992 bp, Oryza sativa
tttaaaccctccccgagctccgtctttcgtttccgccgctcgccgctcactctcgccgtcggaatcgtgctcgcgccgtagcaccttctctccgccgtcgccgccgtgcttcggttagccgccgccgccgctccgctcctcctcccgactcggcgacacctccctcggcatcgccgcatcgccgtcgacctcgtccgcgcctccgtttcgctcgccgaccgtcggagcaccgtcgtcatcgtcatcccgagccgcgccgccgtctccctccgctccggccgccgttctcgtcgtcgtcgttgtcccggggtgagccgaggaccgccgttcgccttcccccttccctcctctctctcgggcgccgctccgccgcgccgatggtcgccggcggtgaccatcggggcgcgggcgcgtcgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccactccccgtggacccggtccgcgcgtcccctccctcggctgacgcaataatccgttttttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtttggagtttattagagtaaaagtctttttctttttccgttggtcgtgtagacgccgcagcttcggaagatccgctcttcgtggaagttgaagccgtcgtttgggaaagcgagcaaggcaagacacatcatcttgatcatattgaatcccattttataaaattatgttgatttaaattattgcattatcgctttatttaaattcccgcgttgtcactgttttatttagccatgcctatttatctttgttacgaccatattattattgttattgttattgttattaccttgttcaccctagattaaacaaaacctcaactaggggacactctactcatggttccattagtatgaacttaggtagatgcttcactggttaattaggcaacattaggtggtttttacaactttagacttgggaaattctcatatcatttggacactgtggaattgttggattatgatggaattggacatacacctctattcctctttcaaaacccctaaaacctgttttcggtggggtttgggtgcatgccagttatgggaagtggcaccccggccactataaggactaaagctcgggcctctgttgcaaagcactaccgtaattccacatgtctaatcggtaaggcttagtttgtggctcagtctagtcataaacaaaagtacacggattggagatggatgaagtcgggcttcgatggacattctccagggcaaatgaaggctacacgagctgcggcccggtagtcgagatgtcatacggcgagggttggtgcccaatgctaggggctcagttctacctgcctgtcccgggtatcccggccgtaggtaggattgggtcggtactcttgtctaaggctaggatgggttggaaactatgtcacgtcttccgtccgtataccgtggtggtatgtggcacgtggcaacacgtgagggagaggtgtcttgtgggtaaagatgtacacctctgatcagagtaaatctattcgaatagccgagccctcggatatgggcaagcctagcaatgtacccaggtcagtgtttcaattcttaaaatttgctcaacaactaaaatatggaatggttggcctgggttggcttgggacgagctgggacccaggtcgggttgccagttcggtccaattcatcgtaggccttgggttaaggcaggttcgtgagggttcacggccttgtttaataacactgtgtagctctaggatcgtctttataaaatagctttgggcaactaagtgacttttaaatgctgtttactgcaaaactgaacccctatattattatctccttgtactcccttgcattaatcatgcattctccggtgtggcttgctgagtactgtggttgtactcattcttgctcaatcttttcccccttcagtaagagaagctttggaggagaggtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggaaaagccaagtggataaaacctaaggacatattttataaataaaaattatttgcgaaagttcctcttttctccttcccccaatgctttttgcaaaaggtttactccgttcttccttcttcggattttcaactagtactagatggtcaggtcagtgaagaagaggacatcgtcagttgtttgccgaagttccagaagactgcaggatctgcgagtgaagtggaggaagcagtgaagccggctgtgaagcaggagtgaagatcttggagaacccgtcgcagaacctaagccaccctctagtgtttcgtttgtcgtgtgtttccttgcttgtgtgtgtagcgcgtggtttgcatcggtgggtggtgatgtaaccatgctaggttgtttgcttaatcaacttgcagaataagcctaacatacatcataacagcaaaagacttagatctgttaaggtcctatccttagtttctaatctgtctctccccttcgttttccctctctccctctccaaacctttgcaacagatggctgacaatgagaaaggcaataaggtcaggagtcaggacattggtacctcaagctcccgagtgaatgaagcacaagacaccagttgtgcggcagtggtccaacacctgattaaccagaacaaattgcttatagagatactacagcagcatcggatgccaattttgaacccgagtcagatgcaacctcaggtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaaggtgaagttcgtaagatgatcattaccagcacagaatggcctccaccaggaatgacaagacgtcagagaagaaacaccttccgaggtgcaccacagttgacagagcatcttttagctaatggaggtagagtgtctgatagtgaagattcagatcaagtctcctcagaagatgaagatgagaaatctccccaaggtttcaaccaggataaaatggaacgtaaggcatgctctcgttgtggagaaatcggacatgttgccagctcgtgtgcctctacatgcgttcattgtgaggaagaccatccacccgacaggtgtccaacgagcaggatcacttgtttcttttgtgaaggaactgatcatgtaccaaaagattgtcaattcagttttctgctgacgaagaagatggctaaccaacccgccggtttcaacggagagaagcatcaaggcaacaccaatcctcgccaagattacagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccggcacgtcagtccacgcaactccctgcaatcagaagcttgctcctcaacgaatggtcatccatgcatcccgaagcagtcctatagcccgcgttgcaacagctccaattccaatgagtgcactaccacaaggtgtcaatgctcaatttcagccccagccaccagctgacaagacagatgccagtatctgcgttgtacctttagaagctccaatacagcagctgagaaatcaagtacaagatgaagaacccgagtgtaagaaagttattgtttgtcacaactgcagtggagaagggcattactccaaaaactgtccccgacctccacattttcgccaatttacacgaagcagacattccaatcgtattgtggtcactggagcaaacgccgtacccgtaaggcctcgtgttaatcagaacccatagcagaaacaatgcaccaatgctccacctgctgcacctgactcggcaataaatcttagcaaccattctctgcaacgacagcctcagcaaagaattgtcgtagatggaaggagttgtgtctctccccgacctactccaggccgagccaagggcaatcaacctccggagggcgataccaagcagaagaccgtcatccgctgcaaccaacaatcagaaggaagcttctcctgtgaatgatagcattatgcagtcctatcacatcatcacagaaccaatcaaggatgcagtcactagaacaatgccagctatatctctccagaatcaaaatgagcagccatgtttgtggttttcagtccgctacttatcatggtgtaatcgaaagtttgcagcaatcatgaaattcataaatataatcatgtctgtaaacagtgagcttgctatgtttagagatgattcatgttgaggatacaatgtaccgatgttaagcaccgtcccttttcgtttaaggcagtgcctcgtattcatgtaatgagggagaaatgtgtaatacagacaagttccatgaggattcgtttgaaagatgcggatatgtgatcatgtgtataattgtttactgacataggagacctagggtctcatttcagaggaactgtgttccaacctcgagttaataaccaacctgttgatggaaaagaaaaccaattaaactgtgttgggttaaaaagccaacgagacagtagttgaggataggagttcggatacgccttttacagatcaagataaggattgttggaggaaaccccgaagggtactcgtcatgcctctacgttgataagatcggatatacctgccaacagataaggagatccaggagacatcaatatttgagaacataatagtcgatggttggtaattagtttacctggtatcagaacaaggtcaaaggtgatgtggcagaagaacaatttggatgctccccatctcgaggaagcactaaagatgaccatcggcaattaaaccctagtggtatagatacagatagcaggcaatgtatttccctgaaggtagtcagtgcagctttttgacgaaccacatcaaggtttcaccgaaaggcagcaagccaaaggacctcatcgtccccagaagcgtccgcaatccacattaaagaataccacctgttagagataagccgaaagaagattgataaaagggattggcaaagatgctctctagcatgaaagaagtaggccgaaaggtgattgataaacagaagcatgctctgcatcgctcacggaagacccctgattgtaattgccccgcaacagtcaccttgtcattaagtaagcaagatgacctaggtaaaagtgtttctatgaaggcaaagagtgaaatcttccactcggtatcagatgctacacggagtgaaaaatgcaagcaccggttaccaggcaacgccacgtcctgggagatgatccaacgggaaagaactcatcaaggttaaaggtgtaaaggaatacgttgagtgctaactgatgacaacatgaagagaatagcggaaagtaaactgaacataaagaaagtgaatctgagttgcttgtttgtgggagctattcccagttatgaaccaagtgatatgttcgaagatagtctacagaggtcagattaagatcacctctaacaacgaagcttcagatctggcaggatcacgatcagacaataagaagtccagcagtaagactatttggggagacgtcaaagtatgtcaagtgggataaattggttctcttgggaagcataacttatagttagagtggttgaccctcgcatcgcatagcagaagtacctagcaccggagaccaggaaagctaatatgagacagttgatggcaagttagaagtgaatgacaagcatgatattcttatgatgacaaacatagtatcctagtaatgacaagctagtgttgacgcatgacgtgaagtggtaacttgtctgaggttgactccgaagatatgaatcatgagaagttctggaacggaagcatcactggactaccgcaacctagtctgagtcagccaaaaggtgcatcctggtccaagtcaggtgaagagaagattccatccgcaacaggaggtcaagccaagcagttccgagtggtaaagttttgctggaagttcgtcaagacgcaacggaagaagtcagacaagaagagaagaccgcccaacctatcttcttgctagcctcctcgaatctcggggacgagattcttgtaaggggggtggatttgtcacgtcctgataaattcatcccaaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgaaaagaaataaacaaagtcgaaaaggtttataaaaagaaaaaccctaaaagaagtcttctttccccccccttcctctcttgggccggctcggcccaactctccctccctctctctcctctcctccgcggcccatcggctccccgcgcgcgcgcgcgccgctgacaggcgggcccgcccgccactctcgctgacaggtgggacccacctgtcatctccctcctctcgccgcgcccgccgccagcgcccgtgccctagcgccgccgccgccgcgaatcccgccgctcccgtccgccccgcgtgcaatcaagaggggggaattaatccccgcgttcccctcccccgtttccccctctttcccctctctctctccctcggattcgttcgaatcaagcccgtaatcgtcgccggcgcaatcaatggagccgaatcttccgcgcgcgattcctccctctccggccgctctttccttcccccggcgctatttaaaccctccccgagctccgctctttcgtttccgccgctcgccgctcactctcgccgtcggaatcgtgctcgcgccgtagcaccttctctccgccgtcgccgccgtgcttcggttagccgccgccgccgctccgctcctcctcccgactcggcgacacctccctcggcatcgccgcatcgccgtcgacctcgtccgcgcctccgtttcgctcgccgaccgtcggagcaccgtcgtcatcgtcatcccgagccgcgccgccgtctccctccgctccggccgccgttctcgtcgtcgtcgttgtcccggggtgagccgaggaccgccgttcgccttcccccttccctcctctctctcgggcgccgctccgccgcgccgatggtcgccggcggtgaccatcggggcgcgggcgcgtcgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccactccccgtggacccggtccgcgcgtcccctccctcggctgacgcaataatccgttttttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtttggagtttattagagtaaaagtctttttctttttccgttggtcgtgtagacgccgcagcttcggaagatccgctcttcgtggaagttgaagccgtcgtttgggaaagcgagcaaggcaagacacatcatcttgatcatattgaatcccattttataaaattatgttgatttaaattattgcattatcgctttatttaaattcccgcgttgtcactgttttatttagccatgcctatttatctttgttacgaccatattattattgttattgttattgttattaccttgttcaccctagattaaacaaaacctcaactagtggacactctactcatggttccactagtatgaacttaggtagatgcttcgctggttaattaggcaacattaggtggtttttacaactttagacttgggaaattctcatatcatttggacactgtggaattgttggattatgatggaattggacatacacctctcttcctctttcaaaacccctaaaacctgttttcggtggggtttgggtgcatgccagttatgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcttcgatggacattctccagggcaaatgaaggctacacgagctgcggcccggtagtcgagatgtcatacggcggagggttggtgcccaatgctaggggctcagttctacctgcctgtcccgggtatcccggccgtaggtaggattgggtcggtactcttgtctaaggctaggatgggttggaaactatgtcacgtcttccgtccgtataccgtggtggtatgtggcacgtggcaacacgtgagggagaggtgtcttgtgggtaaagatgtacacctctgatcagagtaaatctattcgaatagccgagccctcggatatgggcaagcctagcaatgtacccaggtcagtgtttcaattcttaaaatttgctcaacaactaaaatatggaatggttggcctgggttggcttgggacgagctgggacccaggtcgggttgccagttcggtccaattcatcgtaggccttgggttaaggcaggttcgtgagggttcacggccttgtttaataacactgtgtagctctaggatcgtctttataaaatagctttgggcaactaagtgacttttaaatgctgtttactgcaaaactgaacccctatattattatctccttgtactcccttgcattaatcatgcattctccggtgtggcttgctgagtactgtggttgtactcattcttgctcaatcttttcccccttcagtaagagaagctttggaggagaggtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacagcgtttgggtgggttcgcgtattctgctgcgagaacttctgcttgagccttccttttcccactcttgcgatttttcttcttgcttgactcaggtgcgtccgtggctggtttcttttctcccccggtcttcggcttgtcgttcttgcgtctcaacgcatcgtcaacgtgggcacatcgctcaacaatttcgaataatctccgagtagttcttatgcgtcttgtcgccaactcctgggtagtatagtgatctcggacaccggacttgaaggcgcgaattacagaagcatcggtgatttcggggattgtatttctgcactcgttaaagcgccaaacatattccctcaaggattcacccgagttctgtgtcaacgcatgtagatcgtcttcgatcgcgtggcgcttgtaagttccttagaaattggcgacgaactgctgccacaggtttgcccacgaagaaatcgagtagggcgggagatgcatcagccatgagcgtgcagagccttttaatgcagttggcaaataatttgccaacgcgttgtcgtccgctccggcagcgtagagtactgtggagtagacttgaaggaattcttctgggtcagtactcccatcgtacttctctattgctctgggtcggaatctctcaggccatcggacatcacgcagggaacgaccgaaagctctacacccagtgctgggggcagtgggttgtcagcgatcatgtgtccttcgtggatgtctgtctgacgatgaggatgaagaagaagatgacgatgacgatggatcgcttggttccggtgtgggattacgaggtcgtcggctgggttctcgagaatcctgtcgtcgccctccgttgttgtcccggcgccgatctctgtcgtcctcgtcgttatagcggcatcctcgaccagtatcgccttgcgtccgcctctcgcaatcatcatgatcgtggcgattgtggcgattagtacggtctcggtcttcattatcgcgatgtcgtgaagagacgcgatgtcgggagcgattcccatcgtctcgtgtgcgtcgtgcctctcggcgaccattgaggtggtcacagagatcgccggtgccgcgaggtggaggggtagctcgagggggtgactcccgctgttcgggatttttgccattgacgccgccagttggtggctgttcctggtgcgtagcagcagcggcctcttcaaacgcgtggctgaggttggttactgattcccgtagccgttcctgccaccgcgcgagatcatcgttcagaacgggatcgtaaggagtctccctcagtattgtgttaagggtcctgatgtgttgggccggtgtagtcacttgattttccgcttccgcattagcgtgtgctgacttgctggtcccgttgatagctaatagctcgcttgacgtactcattggtgatgagccgtagtcctcgagtagatgtagaactgatggtacgtgggaatcgatgtcgataacgccaacgaaccgatctgagaccagcgttccttgttccttgtcttcatctctaagggatatgcctgactgctggaccttaggagatgacgtctttgtggtgctgagaaagaccttgcagcttgagaggttgtgattctttgtcttgtgaataagacaatagacatgacgagttggagaaatacgctgaattccacgctctttgcaggcacgaatttcggcgcggacgttgagaaaaacccagcatgcttgcaaagtgtgtttcctggttttgtggatagggcactaggaccttgtcgcgtcggaagttattctcgtcggctcgtggttcttgtcggaaagacaaggttcggccgcattagaatccttctcgagctcggatgttgtcaacgttccgttctccgcttcggcgggaggatctttcgacacggagtcgtcctgggttgtagctactgtgttctcgtttccggtcattgatggaccagctgagatcggcatcgtggcgtaaaccgggaataagatttcaccgacttgaggttggtgctgacgctgttgtcgacgaagctggatgacatagtagtagaaccttgagcaccaagttctcctacctggcgcgccactgtcgacgggtgatacccgtagactggatatagagggtattggggtacgttggtacaaggatctacgtaatacgacatcaagcaaacaaaaagacgaggattatactggttcaggccccttgataggtaatagccctaatccagttgatatgggattataagatggaaaatcacagattaaagggaacgatggaactcgatgacaccggcgagattgtaatcgagttagttcgactagatctcccggcgatttggctcctgcaggctccgacttcgtaggctgtggtcgttgtgttggctatgacattcgatgccttaagtcctctcagggggtcccttttatatcgcaggtcaagcggtttccaaatagaactcggagacatcaaaccctacacgatacattgacgacccagtcttgtccgagtaggactcttattttctgcaaactccgtcaaggatttccttagtgtatgtagagaatgtccatatatgcgcgggcatgccatatcgatatgtaacgtatatcgaacggtaaagggtctacctaacccgtaaccctgacatacatatacatgtctagacgtatataaagtttgtatacgtgtataaaagtttatttaaaaattgaaaaaacagaaaaagaacctaaaaaaaaggaaaagaaactagaaaagaaaaaaaaaggaaaattgtgccatcctccatccgccccctctcctctctctccgcgcgcgccacgtgtcccgtcgcccgaattaggaaatttcatagaatgaggggatattgttacaacagacaatgcggccttccatcccacgacaatccatcgagccttttgaagaggaacagcacatccgtaggacaagcccaacaacagcccaacagcccaacaacgtctcctagcccagacccatctcgctgtctcttcttgtgcctttgctcgtcctttcctcctccccaaaatcgatcaccggcgcacgccgattctccaccgcttacaggttcttgagctccaccatagttgccaggtcgctgggggatgggaggctgaatctgcgcggggaaaactgaggaggcgtgatgatggatggggctgctggtgtgtcgtcttcgcctctcctctccagccccctcatcgagtctcatcctccccccacggagcattcggcaatggcgtcaggaaggatggtaggttgcgtctgtggcgatgaggaggaggaggaggaggaggggtcgactagtcgccggcggcaatggcggaaagtgcacgaggagagaagtgatttttttccctgactcgtctagttgcatcttttcagtttcattttaaccattcatctgagccgacgtgtatgaccatctccctctggctagtttgtcgttttctgaatccgatggccaatattcattgcatgatgtggcacattccaactttcacttagagagatactcccttcatctacttttgatctacttttgatattaatattttatcttttttacggatgttgtcgaaatgacaactgcatacgtcgaaagacgtggttactcaacagtggttggaaggaaacgaagtgtattgaatcttgaatttcttcctttttttctggattcccccattacatggccctaggggactatttatagccccattacaggttcttactactagggtttaggttgtacaggagaatttacatgattacacttacaaaagggacatttacaggggtacataatgttataagggctcatgggcccctgatgggccgtctggcgatcgccggccctatagcccctaggcttgatgggccggaaaggcttcttcggccctcgcgggggcgaacttgccatggcgaagtcgtcttccttcggcagatagtcttcgccttgcacccttcgcctgagacgcctctggcctggcaaggcactcgtacgactcttcgcctcacgccgttcttgctccatagctttcgccacgggtttcggcagatttggtcgaagggcctcatgccatccgccaacaagccccttacgggtaagggtgagattggagcttcggccgagaccgtgcaaagtatgtggtatggtatgcggcgccccctttcaaccgatgctcctcccgaaacctacattattcctgcgaatgaagtttgctacttgtgcgcctattattattttgccgcgcttcgcctcctgcgattggtggttatatattttcttttcccgggccgaacggaacagtattggactttcccttcgtggggtttttactgtgccgctcggttggtgggaatttaccgtttcgcctaccattgcgacacgtggcgctttattactggtgggtaggcgaacggtcgcccgggtgagctatatattcccactgctctttccttttcaccgccacacttgccattttaccgtgtgcgctcttttcctccgtttctttcttccacagcatctctcgacccctcaagcatttcgcccattccacgcaccattcgccatggcccctcgcaagccaaaccctgcttcggcgaaagggccggatcccagccgagtcgatgatgacagcaccgcctttttgggggtctctcttgtggacgacgtcgagctggcgaagctggtcagctctggggcgttggtcgaggggcaggctttcgccccagggaaagccgtggtgccgaaacctatcgacaatcggacggtggtattcgccgtcttttttgaggcagggctacggtttccctgcaacgtgttgttgccggagatccttcgcctcttccaggtggaacttccacagctgagcccgtcggcgcttgttcgaatcgctatcttcgactgggcgtgccggacttccaggtttgagcctaacgccgagctcttcggcgccatatttttcgccaccgtgaactcaaagacggtgattatctcggctggaacgaagaagatagtgttcgggagcttgaactttaacgttcgtcccgagcggtccgatctctggccggtgaacgctgccatatcgaagtgggaccgccattggatggctaggtggttctatcacaccatccccttcaaggttggcactgactcggcgaaagccctccgttgccggcgtagggcgatcgcgcctaaccgaaaacccaagatcaccgtggacggtgctatggaggcgcggttcgttctgctgcgcaaggtttgctcccgccttagctgctgtgacatggtggaggaattctgtatgcttcgcatctttccgctctcccagtcatggcaagtcagagttgatcaaggcgaagaggttgacggtttgccgaacctggttcttcctgaggggatgaacagtaagactgttctcgtgctatacactgctgtgctttgttatcttgccttgtctaactgttaacatagctacacactttacttttgcagcgttgaccctcgaccaggctgaaaacgaggcccgcaggatgatcggcgacgtgtcggtcgtcgagtatagccagttgctaacacgacaagaggctgggcgggcgaaccgggtttacaacggcgaattgcctcctcgggcaaacccccacaaagctgacgatgatgcagggccttcgcgaaagcgaatgcgtggacaagtgaagcttgctcctaggaagcgaagggttcctgcttcgtcggactccgacgccaacgacgaggacgacgccgaagaacgcgacggcgaggaggaaggagaggagaaagaggaggaggccgtggctgataaggccgcggacgaggcgatcgaagaccgcgtcgacacccccggctacactcctaccccaagtcccagtcacaacaagactggggtagagtcgaacagctcccctgtcacgcccggaaattcactaataatttccgaactaatttgtgcataaaatcctcgtctaggaatcagccgaggtacacaaactgacaatttaatatacaaatccatcataataata

SEQ ID NO: 66787 - DNA, 7100 bp, Oryza sativa
ccctgtggccgagctcggcgaagccgtgcgccaccttgttcccgccgcggcgcacgtgggacacagccatgtcgtcgagctgcgggagcagcgcggcgatctccctgcacagcctcaggtcctcctccgactgcacgtcggcgcggtcgcacaccacgtcgaccaccgccttggagtcgccctccgcccagacgcgccgccacccgttccgcaccgccagctcgagccctcgccggagcgcggcgagctccgcgacggagctcgtcgccgtgccgatccgctccgcgtagccgagcaggaacgcgccgtcgtggtcgcggtacacgccgccgatgctcgcgatcccggtcgagtgcttcgacgacccgtcgaagttgagcttcatccacccctcctccggcttcctccagatcctcgccgacgccgacgagtaggcacgaagacgcaagatccgccgccctccgccgccgacgaggatgcaacccagaacggggttgcgccgccgcagcacacccagatcagcgcggtgcacgcgcagcatcaccgatcccctcgcagaaaaaatcgcaatctgttcgtgtatttagccccaagcggacccaccaatagggcaaggttgggaaatggctagacccaccggcgccggcgaatatccgccttccccggacttgttcctcttgagcgccgccgcggcgcaggcaaagctcgagcagcgctcaggcgcgccatggcggcgccggcggcgaaggagaggagaagggtttgcgttgcgtgtgttgctgtacttgataatgggctatagtcctatgggctacatgtggatcggcccatgatgacccatatttgtacccaggcccaggcgtcaattcattcatgggcttcattccaggccgtgtttgtgatcggtacgcagccatctcttccttggggcttttaactatttgccatttttagatttggcaaataactatttgccaccccctatctcaatgatatgtgggtccacatgtgtctatgacatgtgagttcagtggtaaaaaattaattacaacatctaaatgtggcaaatggtcaaatgcactgttctgactgcagaacatcacaaatcgtgatgaaacattgaaacacacacattaatcactggtgttggtagtcagcccactacacggtccatccatccttggacaaaagccgacgctgcggcccactacacggccccgtctcctgcgtactcaggtgactcggctacagcctacagagcagagctggttactctgcttcgtagcaaaagacgctttgcactttgcagcttggtgagcgtttacgacgtacgacaacgcgtcgcacgaagggaaactactaccgtgccgccgcgcgcattcctctgccaatttctaaaggcgacgaggaggctgtgtgttgcagtctcccggttaagtttccaggcctttttctgtgtcgtgtataacagctagatcaaggctgaggcagcctgcaattccaattcgccatagagagagaaaaggaggtttggctttggatagctaatatgctctctaagtaagcgattaactgatttgtttatgaacaagtgtggatcgtttcctgcgtatcagatgatcttggggataagaacaagccagcaacgctattttccaagcatatataacccagatcaatcgactggaatcagattccttcgatctcaatgcgtatgcatgcgtacgcattggaaggaacctttgctaacttcgaagagaagaagcacatcgtagcatctcgatctgcaactgtgtttgcaagcagacagagcagctagcacaggttgcgcaagcagcagtttgctgctaatcaggagacaccagactgaaaatgttgtgcccctttcaccggctcttaacccctggagattctgcatctccaatcccatattcatattcttcaacaacttgacactccataacactagttagtccagtatcgccactgattgatctagagcatggagagaccaacctagctgtgagatgagacatgcatgcattgcatgctccgttgctgacctaggcagctcgtgatccggtaccacacttaattaacaagctaattgattatttgattacagtactagcacttaattaaatcagccatggcgatgtaaccacgttgcagagaagaatcctagaagctagcagcagctagtagaaatgagcacagctgtgcctcctcgcagtggacagctcacctcaatctgtagcacacaaacactacgatccccaacaatccaatctacccaatttgcagcaaacaaaaccgttaaatcttttttctcagggagcaaggctcacgtgtgcatcgacagatcacagcgtgaagccgtggagaaaacaccaagcccagcgtgcagctgctttgaccgggcgtacgtgcatccgatcgatcgatcgatcgatccgagcagatgccgctgcggctgcgccctgtcgcgggggctccgcggcgcaacccgcgggcgctgccgccaccggcaaggggacatcgtgccgagaatctcaggcgcaggggagaggcagcacggcagcagccagtaggcaggttgcagttgggtttttttttctgaatttctgaactggccgtggatggaggttggggattcagaggggagaaaaaaccgagaaattgccaggcgtgaggtaggtgcacaggcagcacagctcagtgccactgccaatcatccgatgaattgataaaatatttatcatttgaaggcgtggcagatcagggcagtaatgaacgaaacattactacagctcatgacctggctacagttcacgatggacacctcatcagctaagaagcatctaccaagaatcttacttccatccacatcaatcagttcgatcaattctcaccggcaaaattcctggagatataactgatgaaccagttcaagtgcaacgcacacagatacatcatattaattcaccgcaccgtgcactaaacttcacgacggatctccgcccggttcgttgcaccttgcagacgtctgattttagtgattcgatctccaaagtctccgtcggcgctggaccaaaaatatcaccggagcagccacgatattgcaccaaatcaacacgctactagtgcccaaaaaaaaaacggagtacgagttggcagtagctgtgtcaaccgggggaaattccgtgaggtcacgaacgccgccgatgttggacaggcgagcgagacggcgacggcacggtgaattcaagaggacagtacgggtacagtggcatatggtgtactagtctgtcttgaaaaagggtaaaccctcgtaactaggattgattttttttatttttttctaagacgaaggggtacgtggtgatacttgagagaggcgaaggcagcaaacctggagatcgaaaaccgtcgctttcgagcccttttctcgtgcggatctccttgccgcttttgaagcttccggccacattttcggaagctcccggcccagcttactgctgaaaaaaaaaatcatcgcgtccccgtctcatcagttcgttggtcacggatgaggcaaacgcggatgaggggaaaaaaatcgggatgattttgatgggactcaaatcaacctgagaccgggtaaaacacacacgctatacgagtgtggctgtgtgggtgacgagactcgccagtaaaatttgacaatttgacatcgccttcgccgtgttgaattgggcaatctccagacggacggagggaggcaggccggcacgcacgtcggggtggctccgtgtgttttgacctcgccaccactcggagcaggcaaggaggctgctaattcttgactaatcatagtcatcaatcaagaagacaaaaatgaatagaacaagtattagctgatacagtaagtctttggagggcgatgacgtctgcgcccgtttgcaaaattgttcaagcgaacttcaattccttaatcgatcgactgattatgtatgaaaattgcaagaatttgggaggctgttcgtttccttttcagagaggaagaggcaatgtatggatgcacggacagtttgtgaaacgaagaagcttgctgatcaattaattcagattccagtttccacttggaacgaagaaacaagcagagtgtagtacatgagagtacaaatgcgattggaatccgcgaaccaatgagcagtgcccttgatgaatcctgatgctatgaacaacgagaagaaagaagaaagaaagaaaaaaagaagaagaatcctatccatgtcgaactttctaatgaaagaggaactgtgaggcctgggcgacggcgtcgtcgagccaccggcgaggctcgtccatgaggtcggggctgagcctgaccatgaggacgcagaactccatctcgctgagggcgccgtcgccgtcgaagtcgccctcggcgagcatcccccggaggtcgtcgtcggacatcccgccgaggccgagcagcggcgcgttgcggcggaggctgtcgaaggtgatgagcccggaggccgggtccatgagcaggcggaacccgcttgcgagctcctgcatcagcccttcctcccccagcctctccgccatcaccggcaggtagtcctcgaacccctcctgcatcatctgctgctgctgtctctgctccgccgccatgagaatgagtgaggttgactgatcgatcgatttgttgtgttcttgtttgcttcttgcgatctttgagaggaggagaagaggagagggatgatttgatgtggtggggaggaggcgggaataaataggggaggaggaggtggtgggcttcagagaagttgcgagagaggacggtggatgtgggggggtctcacgtgtgggtgcgtggtggattgtttggattggattcctggacgcgcggggacaggttggacgcgcgcgcgtaggggggaggatgggatgagttgggcgtgggctggagggaggaaaaccgcggcttcctgcgcgcttcggcttggacgtcgcgtcgggtcgggtcgggttgggtcgggtcggcgcgagcgcgtggctgcggccgcgtgggtgtgctgtgggtgcgtgtggctgggcaggtttcgggtcgtagcagcgccgacgcggtgacgtggtcggggcggcgggtggatggtgcgtgtcacgtcacgcttcggggtggtggacagacggacggacggtgtcggaggaatcgtgggaccatgccgatacgagatcagggatcatatttcttcgcccacgtataaatcaccagacaaaatttttcatcatatcacattgagatatcacattgaatgtttgacacgtgtataacgtattaaaaataaaaaaataactaattatacagattgcgtgtaaattatgtgacgagtcttttaagcctaattgctccttgatctgataatgttgtgctacagtaaatatttgctaataataaattaattaagcttaataaattcgtctcgcagtttacaagcggaatctataatttgtgttattattagtctacgtttaatacttcaattgtgtgtccgtatatccgatataacacaccaaaactttacgcccctatatctaaacacagtcgagaaaaatgctataggacggaatcttgttcgaacagaatgatacctctgagctattgttatctgatacctgatagatatcgactaataccccgttcggatggaataatatctttgaggtatcgcctgatacctggtagtggtaggtatcggctgatacccaggtatcaggtgatacctctaagatattatccggatcaaacgggataccgtctagtagcattcccctatttctaaacataacactaacatttcatgcttacgacacacgcatactcacatctatgaacatatatgcacaccttatctttatgaatatttttgaaagattaagtcggcatatattgagattgacgaagtcactacagatatctcgctgttgatgagtacataacctatcactgaaagaagctatgaatgtgagcattgtgtcgtagtatttttgattgaatggctccgatcaaacatgatttctacgaaattcatcacgaactcaaaaactttgatttggtcaagactcaggagagtgatttgagtttatctcgttgtgaaattcaggggttcctgacgttggacctcctctgctgcgtcgactcgacttgcttaggtctgatttagggtcacgattgagaagtttcgtgtcccgttttttggtcgcccatgttgggcacgtttagccgtaacaggacgaagtgtcacccatcctttacccaaagtttccatggaagcttcggtcagaaaccccaaaaaaattttgacaccaaggaaggatccatactccacatcgctttctcgagtccaagtcgcgagtagagcagggccagaggctgttcctacttggggatctcgtacggttctcttcctttccacagattgcttttgcttaggacgccttttcttgggtttcttcctctttgtttgctaaggccctgttttcgggcggtgaaaagttttattgtgtcacatcgcatatttgaagtattaaacatagactaataacaaaaaaaattatagattccgtcagtaaactacgagacaaatttattaagcctaattaatttgccattagcaaatatttatagcaccacgttatcaaatcatggagtaattaggtttaaaagattcgtctcataatttacacgcaatctgtgtaattaatttttttatctatgtttaatactttatgtatgtatcaaacattcgataaacattggataagatacggtgaaactttttgcgtgggcagagtaggactagtattttactcgtaccagcagccgggcctatctcacttcgttgtctgcctttcacatctcgaattctcgactccaatctccatattttccatgtgcttttcctctctgactactaatatcactttatttctgctgatgatgctgtcactttcacactgaagctctcagctcaagggccaatgggccatgttggtgactacttagtgagcaactttctaaaggaaacatgaagatacaacaaactaca

SEQ ID NO: 66788 - DNA, 660 bp, Oryza sativa
  unsure (1)..(660): unsure at all n locations
cgtgtggaatgattgnctgtcgtctcncttccangccngcaggtcgactctagaggatccccagtttgtacagctttgttttactccaggttttttttttgtttctgttcttcttaattttctcttcctccttgctcgtgaagacgcaattcatgaatgaatccgtgtcagctctctgatagttttatgtcatgtcatggcatgccctgatttagtgctgtatactgctacttcttcttctgagactagttcctcatgcacgtacgtacatacgtgagcttttcagacgtttgatgattgaaattggttgcgctaacttattatgcccattctgtacaaatctatcttgcacgtccatcctggcatcatattgattaatttactgccaaagagtacgtaaactctcgagtaacaataatgcaatcagctagcgtgcacatactggtcgaataatcctcttccatccttgcatcatcttgattaatcccggaacgtaggaattttataggattttcacagaaaacaggtcgatttctccaaaattcccgtgaaattcctccaaatcgaactagccttaaactttggttgtctatgtgcctatacccctcacaatctcacagcggagcactatccatgatctgatcactaatatataaggtg

SEQ ID NO: 66789 - DNA, 13374 bp, Oryza sativa
  unsure (1)..(13374): unsure at all n locations
cctgtctataaagctggccagtgttggccaacaattacaattaaagcttgtgagaagtttgaagaaataccggaacctatatgttgtacagcaccggatagaagggagacttatatatccagaatctttaagattcttgccgttgtacattctgtccatatgcaagtctcttgctcttcgtggtggttacgcagatgtttctcttgatgaacgttgtgctgctggtttcagcatgatgatactgcctgcaaaaaagctgctcaattttatttatccttcattgtacagggttgatgaagtattgtcaatggtatgttatatttccttcatatacatcttgttaagttaaaacatcaatactctgtaaataaaatatgaaatgaaaaaaaaaataacttctagtgttagccttttttggatgggaataatcagcacaataacttattagtgttcaacaattagtttggaaggtctttactttgtggttttgagaggaaggttctgttttactttgaaactttagagctattaataattaataatgaaataaatgcatcagtcaccgagctgttttcgttggtacattagaaacacgcctttttcttctgtttagcttaagcactgtttgctaatgaaattgaattttccaggaaccagataggatcggtggatccttgaagcggttgccactaaccatgcagtgcttagacactggtggtctttaccttcttgatgatgggtttaccttcctagtatggttaggtaggatgctcccacctgaacttgtgaacaacattcttggagtcagcttggcaaacttccccgatctatcaaaggtacactttttactctctagtcaatggcaatgcttgctataaattcatcaagaagggcagagcatatttccattttattatgtcctaaaataaagtctcaagtatctctgctaggactgaacactttgttccgtaaattgaatctagttgttaatgtgggtaattccaaactagttttgagttacaactatgctaactgggatatcttgcaggttcaattgagagaatgtgataacgagtactccagaaatttcatgaaaatactagggaccctaagggagagggatccttcttaccaccagctctgccgcgtcgtacgtcagggtgaacagccaagagaaggctttttgcttctatctaacttggtcgaggatcagatgtctgggactagcagttacatggactggatactccaaatccaccgccaaacgcagagctagtcacgatgaatcaagggaatcgccgttccaaatttttggcttattgtaaactgctgcagattcagccgctgccagttcctaatctctcgaaacagttggaactaattcgcaagtcagatgtccagaatgtcttccccttagcagcagcacgctggcaagcaaaagttttattgttaatattcgtccctgtgattattttcctcgtgagtgaaaatacagatgttgtatgagaataattagggcaacagtgaccattggtaaggtatacaacttggtgttcttggaaatgtgctgtacgttttttttttccatttttgtttttattattgttcacatttctagtttgtgccgtgtcggtctcctggtatttttagttctccaaagtttgtcgtgtaaaactcatttttgactgatgatctagctgcatgtaatggggggagggctcccatttaactggtgttcttcggatgtctgttcgtgtcattcattttctgataccctgttttgattctggatgtggctactggttagtctcatcatggtttacgttgttacgaattgtagtcgcatttaaattcaaatgaaatttgctaagataaactcagtaaaaccaactactcgtgcaagagttactgacccatgaatgaagtgacggtgtctcgttgctttgtttagttccgcgagggcgaagctaatgatgttttgatattgagaaaacaaggtgaaaagcaaatattttgtacagggaggtttttttttttaaaaaaatattattgcttatgagctgaatacaccacttatatatgaaaaataatttgagtagggtttctccctaagaactttaggtgcaaaaagaccaaggaaaacccatgcacaaaattaaaaccatgcctcatgacatgtggttttgtgaaatttaatcttataattacggtcatgtggttttgtgaaatttaatcttataattaaaccgtaagttcttaactcaaaccgacagagctacacaaaaccagaactatgcggaaaacaatttaaacaaatggttctattaacaccttcttgtaaagaacattaaaaaaaggtattttctacagcatataaactagtgaaaagaaaaatggagaaataaaatatgtgaaatttcacataaaaaattaaatagtaatatgtactatgtagtactttaaaagaaaccaatgatagtaaccgtgagactcatatacttcatctttttttccttggtatcgtcaactcccaaatcacatgcgctttctcttgaaagtatcagttttccttatctccttttccgttgcaaaggcactgagtttatatttcgtagttgcaaaggaatagaaaattagtaaagtgagcgtagctcaactggttaggttctgtctcatagaagccgtccacatggatgcgcgcttattttcttttttaagaaaaaaaaagaggagagaggttttggactcgtagaaggaaaggcagccagcagcccagcgcagcaaagcgctgtggtaggccctttcccctcctcctccgaaaatgatggcggctcgccgtttttccgccgccacgccctcctctcccctcctcctccgccgccgcctcctttcctttcagccacagcccacggcggcggcggcggaggccgacgcgggcgcgggggagtgggtccgtcgcgcgggggcgctctcgcttctggggctcaccggcgccgtcgccgccagcgccgtcagcgacctctccgtcttcctctctgctccaggtcaaaaccctagaatcccttgcccaatctccattggagtattgtattgagcgcgtgattcgcctgttcgaactgacgattaggatggtgggggggattcggatcagctaacacctatcaacagcaatttgatttgaaacgcatgaccgatgaatctgtgcatccttcctggggagtatgagagctagcattcgcaacgtgtgatgatgatgttttgcttcgcgatttttttgcatcgagttagtgagagagagatggtttgggggctaactactggtggtgctcttgttgcagccaggcgatagagaaggcctcccagaaccagcaaatagtgaatgcgatcggcgcgcccatcgtgcggggtccctggtacagcgcttccatcgccgtgaatcacgcgaggcattccgtctcctgcactttccccgtgtcggcgcctcaaggaaatgggcttctcaagttcaaggctgttcgctcgggaggtagtatgtgatatattgtttttactacttggatgctggctggatagttgttaaattgacatgaattttcttttctgcactaaacttgaattaccaccacttgaacttttaatgcatactctgcatgaatgttcatttacggatggaatagaacatatttttttagtctgcatcatttatgaagtgcttcatatcatgttctcattgcatttggacgaaaagcaaatcatattagcagattcgtttatgatttgccttacctgatagcataatgatataggtataaaaactctctgactataggtacaaataatagctataggatatgatgaacaccacgtatgcatcaatagatctcataatgctaaggtctgaggtgaacttcataatagtcattatccaccatccaaatggaatattatgaatgattggccctgatctttcatggtaatatgaatccagaaacctcctcatttgttggcatagcttgcctcctttgatgcaccagtcaaaaacctagataacaaattcttatttccccctgcaaacactcagtgtgcaaaggtgaaaatagggattgtccagtgattatattcctacacctggtacaaaaccaaagatgaaccctagatgattcctcaagcacactcacaagtgctgccaatgccatggtggtttcctggtattttttttactcaaaatattcaatccaccctcttagacgcccattggcctatgacatttatagcctagcaccagcttccctagtttaagatcatatttgaagtcccttagaaacaaacaatatgagttctcctaaaaatcaacaggagtatgctattttgcacaagattggaggctgggttggccacactttttggatttggataaggttccagccacactcctaaaaatcgaagttgcttggacttgtgctcaaagtactagcgagatttgtttttatgggcttggttgcagtagattttatcgctgtgtttggattcattctgtttttgtataatctgttggattagatcagcttggaaggccaattactagagtactggacttgtggttggttcaatcctttgcttggtttttacacatttacactctgcctaaacggttaagtattactccttatgggctgataatacttgtcgttttggacaaggacacggttttcaaaatacaattttgaccactattttttattataatatatatagaaatatcaataaatatatgattttattgaagtacatttaagatcaatctatagatatggtcaccatatttctaagacaaatattttagatgttatttatagacaaatagccttgtccaaaacgacaagtattatcaacccggagggagtagtaaggtagttcctttattcacaaattttgactaccagtagagcttgggtagatgaaagatctatggtggcaagttgagagacacaccatgcaattattaggtgcagaatacaactgtgttatttcattgttgaacagtaaaacaactttgcagctacaaactagcctaccaaaaattatgaggttagagctattggatccttgcttaagtgtacaacgtagcaataaaaaaaaaagatggcttgtcaaatttcaagtagttggcacttcatgtttgaactttacccgaagcgctgcaaatatactcgcaccggtcagaactcagaaatacttgtccttctggatataccttggatccaatctttttaaaatattttgattgtaaatataaaaaccgtgcatgtagatttgtttgaaaagtattatcataatattatatatttgttttattttacaaatacattaaaatagaaattaatggtcaaagttgcattttgaagatagtgacaatgtccaaaaggataagtatttgtgactggacggagttatattttggtatttgaactaataagcaaactctaaaattctagttctcttaaaaaggttggttccactagggctaggtcagcattgctgtgatgcctacattggcctagtaatgctctttttctcactcaactcacagtaataaacttttttctgtgacaagaactatttagactaaacgttgaatgtagtttgtaaatttggtcctgtcggtgtttctgattgctcagtggatgattttcttggtatcgagacttaatgctcatgctaatgtgttgctactgatattgcattcctccgggagctgttagttcttaaatttatcacttcgagatatttcctccaatgaagtactgtctaactaaagaaatttttgttagacaactgatatcaatacttttgagtggctattaagtcttgatccatgttgtaggagcctaaatcttatcccgtcatgttcttattcttgcagatgagtcgtggttttcatttctgcagcccaatgactgggaaatactcctaatggatgctatccttgatgttcctactgacgatgggaaacaccaaacaattagggtaacaattccagacaacacagcacctcctccagcaattgattgcaaggcatgcaagtcccagccaacgctgacgccaccaccacctccatatccgtcacctccacagaagtgaattcgtctggagaaattcttttggtcccgaaatacctaccttggattagtcttgttcactctattcctcattgaccatgaaagaaataagtactgcagttggaccgagagaccacagattctttacttttgtttttgcaatgatacaacatagaataggttacctgattgttccccactcagcaatactttggaaggtggatccatcaatcactaaactagatttgctttaggacttgctagcgaggcagcgttttggcactcaagttttttagggtttatactacatgatactccatgagaatctaggttggttaattcagtgcttcttcctggttgtccaagccttctggttggcatgtggaaatacatcatactaaatactgatattatgtagcagtttgggtaggaatgtacgatttgaagttcaagaaatagcacctggggtcatttgttaaagctaaaaccaacgtcatcatacgtaaaaaggatacaaaatcaaaagactgaaaatattttagaagatcgttatcttgacgcctcttgtaggcattggagccatctttttcaacatattctagaactctgacaactgaagggaacattttagacaagcccatcaatgtttcataacgagagctccaacaagtgtcacctagcctctgaagagatatttcttgatagtcaccttcctgtaacaactcttcccttccaattgttttcctcacttaactcttcccttccaattgttttcctcacttctttttaatgatgctctcgaagtttttcttttctcttgtaggaactaccaacacattcaacaaaactgatatcatataaaaaaatcaccaacatcggatatctcacaaccaccaagttaagtttatgaccaaaacaatgaatataatatgctgaattattctcataattttagcttgccaaccattaaattcacctaacatattacttgctccatcataaccttagcctctaatttcttttagacttagaccaagatctgcaagtaagagataagaagccgtcatgtcctccacatgaacaataccaacaaattttcttttaacacctcacatttattaacataccgaagaaccaccaccatttgttctttgttggaaacatctaagacactcatcaaccaataagctgaacacatcattgccaaattcttccataatacttcccaataattcttttgcaaagcacttagtgatttctttgtgaattgttggagatagcatgtgattattaagtgaggcattttttaatgccttggcaacaacatcgttttgcttaatagtatactccaacaactacaaataatttcctttatttttggactgttttgattcattatgcccacggaaaggttgtctctgatgcaacaagtatcgacatatatcaattgatgcatttaaccggataagatgctcatttttttccgtttgggtttgtctgtgaaaggccacaggaattgactggtcttgtttcaatagatgctcacaattcttgagtgcctttatgtgaaaactattacagtcaccaaaatgagtcactaatatctctgtcttgttccaagagttgaagtcttatatgacaaatacatcatgcccatggtgattaccttttatgctaacatgagtcaccaatatcactgtcttgttccaagagttgaagccttctatgacaatgcttcatgcctatgatgattatcttttatgctatccctaaacaaatagcagcataaacagtaggctttgtcatccttttcgctatactgtagccaattagcatatttatcaaaccaacatggactgaatcgcctcttattcccaatcaacctatacggacactggaaataccatgtggatgatatggtccccatactaaataatttctccttaatgtgaccaagctgccatattgctcatgtagacttgcaactcctttgcggcaagtggcctaacgaagatggcggagaactcgaggcgctccccgatggaatccgccgacgccatagtgttcctcgtcggtggtgcgctcgctggagatctcgccggagcaaacacaagtgcgggagggggattccccaccagatgcgcaatgcgtgggagacggcgatcctcgacaattgtccacgcgcgtatcgactcggcttgggcccaaggtcggcaatggcgatacgggctctcgattcacagcccattcctgtagcaatggcctctctatccgaccgcgtcaactcgcgcaccttgactcctgtctacaacatctgtgggggatagatgtgagggagctagggcttcgtggaggttggaggagaggtgaaccattacacgaggagagggaggtagaagagtggcctaggcttgggattggcggtggtggcaggggatccaagtggaggagcacaattcacggtgattctcgccgcttcgcgaatgtggtatgaggttggtggcaaggcatggagtatcagggtggaggatagcgagggaggttctagcccaagcaggcgttctgcagcgacggcaagcatccttcggagccatctccacaaggcggccatgaccaagtggactggggtaactagcacaaggcctcgggaggaggagaaggtggaggtcaagctctgcccatggcgtccaagacaggggggatgcagtacaggccagtgcagagggcgtcgacagccttaggaggaggggaaggtggaggtcaagctccgcccatggcatccaagacagggggatgcagcacaggctggtgcagagggcgtcgatagagatgctgcccacccatgctgcagaaagcaagcaagcaaatccctaggtggaacaaccccaaatctaggccaatccccacgatggtatgcccctgaatactcaaaagactttttttgcaatagatgaaaaagctttggtcatgtggctagggattgcattgtctcagtttactgcatcaattgtgctaaagctactcataggaatgaggattgcatttttgataagcaacctagattggtagccaaattggttagatatgagccccaggtcttggttgtattctcatttagaacaccaaaccaatccctctcaaggaacaagctaatccaatggctcgtacacgtgctgcgccgatcgttcccgtgaacgccttgtccatgacattgaggctctgcacggcgcggcgacacgacagctgcacctgcgggtagctccacgagtggtgttgcagcaccttcaccaccaggtcctctacatagtcccacacctgcctgacaagatcgtgcgggacgtgtgcaatgctctcgatcttctggtttagtagattgtggagcaccgacctcagcatgacattggggaggttgatgcccttggtctcctcgagcacccgcatctcctctgccaagaatggctcatcgtcactcaccctcgtgcttttcaatgacgcgcgctgtgccgtggtggtggcggtcgcccgcgtacttgttgaaatctcccctgatgagcaccttctccagcatagatgatgtggaagaactccctcaccgcatctgccacggtacagagtttcggtggcatctggctgagctcgtcactgctatggctaagcttgtcgttgatctgcttgatgttatcgtttagtttatcttttcaagtttgtgctgcatttgtataaacatctgatgatgttttgtaagacattagatctataatacactatcatttgtgtaacatagctagtcttggataggggtttaatgcacaatttagttctgaattctggttatgaatatctgggtgtgacaattgtttcctggccaaggattaattcctccacctggagtgccttgagtaatgctttattcatggtggatttctcaagatccatgggtggattatgagaaagcaagattgttgtggaggttagggttcgttcttgggctctgggagtttgaagatgatggaagacaaagaggccaatgaatgagtaagtttattttttcgacatcatagcttctcgggtgtgctagagttgtcagcattgaatgagcatttgcgtagaggtcgagggttactgttagtgtcatagataaggtatacctcatatacatgtacttaccatgtctaggaatactgcatactgtcaatggagtagattcaacaactatgcttgtagagtatagggaatgttggtaccagggtatacacaagataggaataggaaaatgggagacccgagatttttacaggtttgggcccctggatgatgggtaatagccctactactattggacgaagccggtgttgcctttatatatcaatctctcgagtacaaagtatatagaggaaagcctaatctaggctgccagtatattggcgtaaagctcgagcatggtggtcggcggctagctgtagttggcttcctcgagtagtgactctacgagattgatggtggcttgtattggtttgtatctctcttggcttgttgggatgtgttggcttatccctcccttccttggggtcctgtatttataccctcaagtgtccccttatctaagtagaactaggaagacaaatatgtgtacgattcgagtagttctggttaggcccaaataggactatgtttctctttatttgagactcctctcttatctacttaagagttttgccatacgtatgaggtttgattccgtacaggatttggtatatggtggtccccgccgagctaagtacacatgtataggatatcccatatctaggacactgataacaatctgaaaattacacgcaagacgcgcgagtggtgatggatggaaggaaagctaggtagctagtggctacgctgatatccttttaaattttttttatagctatttgaataacatgtaaccaacgagggagggaatgtctcatggagagtattattatgcgtggcagctacacgcgaagtggagtactaggtggagtagtagttatcagacatggtcggtgcttgccgcgttaatctgtccatgatattggcgacgacttccctggattcccggagcagtttgatgcttttcttgagacagtcacgcttggcggcggcggcgggtgtgggcaccaacatccgctccactccgtccatgttattgcccatgacctgagcagcgagctcatcctcgagatccttctcagcgaggcgcttgatgctgtaaaggacgtgcagggccaagccgtcgatgacgcggagcacgacgctgttccagtacgcggcgagtcgcgccttgaggtcgaaggcctgcatggcgagctccacctgctccggcggcagctggtggaggtgcgacacgtcggtctctccgaaccccgggagggcgaccgccgggggcttggagaaagagcgaagctagcatcaaaacaaggggggtgcactaccattgagaatctagaaaatttcagtacaacgctatacattctagtgtttttaagtgagaaattaggaatttagggggttcatgtgcaccccccaaacactatataccttcgccactggcttggagcggtcctccagggcctcgcggagcctgctctggccatccatcatgctggtccaggtcttgatgtactcggggttcgccgtgtagttggccaccatctccatgtcgatgagctcgttcacgtaccgcgccgaccgctctcgcgccttgtccatgaagctctgcacggcggggcggcacgacggctgcacctgcgggtagctgcgcgagtggcgctgcagctccttgagcaccaggtcctccacgtagtcccacacctgcctgacgagatcgtgcgggacttgcgcgatgctcttcaccttccggttgagcagaacgtggagcgccgacctcggcatgaagttggggaggttgatgcccttggtctccttgagcacccgcatctcctccaccaggaacggctcgccgtcggtcgcggccgccgccgggagcctgcgcgcgaagccctcgagcatcttggcgaggcgcgccgtgccgtggtggtggcggtcgttggggtactcgtcgaactctcccctgacgagcaccttctccagcgacgcgcgcatctgattgacgatgtggaagaattccctcaccgcgtctgccacggtgcagagctccggcggcatctggccgagctcgtcgctgctgcggctgagcttgtcgttgatctgcttgacgatgtcggggagggaccgggcgatgattctcgcctggatctgcgtcagcctccgcgccagcgtcgggacgcccaccatggacttgtcgatcctggagagcagagggtgctccgcgaacagccgcgccttcgccttccgggccttcttgtaagtctcgtcgccgatgcggttccggacgcagacgtagcccaggccgatgcgcacgtcgtccacggtgaccttctcgagcaagccctcgggggccttgtcggacttggtgacgacggccagcgtgcggatgccggtgcggtccacctgctgcgacatgcngatggactcgcacgtcnggaagtccacggtggcgagagcacgtngaagattatgctttccctgggcggatgtacgccttgatgaatgcacgatctggtctagatggtttccgctggcctttacggcaccccggtgaagcccgcaagtcaacaggtgaagtcgncaccgccttctggcaacaacaggtgaatggccccttgaaaattccttgcccaaccgggaatttggggtgggggttttaatggcttgccaacctcgccttgaagaagcacccaccggccgcctttactcagacccaagcaagttctttttgtccggggtttgaaccaataaccagggcaccgtgtaaaatctctcccccccgaaagtttatccgccaaacaatcaaaccttggattgtcgttgaagggccccacccacacaaggtggggagttttccccccggtaaagtaaattccaaacggcccccggtacaaaaggcgggatttgttttataaaccccctggggcttctcagagccccctataagcccccccaattttccgtttgcccccgtggttttttcggttttggggggtgcaacactccatcggggaaacaataaaaaaaacccccccacccctttttttataaaaacataggccgggttttttttttttgggaggagggggcgcgtaaaatattgggggattaattt

SEQ ID NO: 66790 - DNA, 655 bp, Oryza sativa
ttcttccgtgttttgggttaatatgatgcatttttttgtgttgtggacatgcatgattgttctattgattcaccacacaatggtgtttgggccatctgttctgattgagacattgggtactttagggcatattactgggtaccttggtagtagcttaatgccccggtgaatattgattgctctcttaccttgtccattttacagggaatggtttggatggcattttcctgagttggtcaaaattgtcaatgacaactacatctatgctaagcttgctgattatataaaggacaaatctgagttggcggaaaaagatatttcgaagttagctgatctgattggagatgaagataaggcaaaagaagttgtcgaagcagcaaaggcttcaatgggtaatgagatatgattacatttaacttccgttgtaatataaatctagtagtttctttgtagtagtttttgtggtttattgatccttttgcttttcaggtcaggatctgtcagaagttgatttgatgaatgtgaagcagtttgctcaaagagtcatgaatctgtctgaatatcgtaaaaacctttatgagtatcttgttaccaagatgaatgatattgcaccgaatctaacatcattaattggtgaaggtgttggagcacgcct

SEQ ID NO: 66791 - DNA, 5648 bp, Oryza sativa
  unsure (1)..(5648): unsure at all n locations
ggtgtcagaagtccgccacgaggcacgtcggctaagcgtgaagnagaaggtggcgtagtcgagcgggaactcggcgagtcggactgccgggccgagtcgacggtggggcccgccctcgccgccgtggctggcgtggtgacgatggtgcagagcgccccgtgggtggcccccagcagtgtggtgtccaacgccggtatgaggtggccctgcgccatgagcgggacgaacacgaagtgcgccgccgcattgatgcagatagctcgtgttctcgctggcgatgtattgctattgcttgtgcagctagctgctgatccatccatatgtgtgtgtgcatgctttaaagagagacgtgacggccggtgatgtgttggatcgtttgtttccatatgccggcgcgcgccgccgctgttgccaccgacggagctggcggtgacgacgtcctcaatgtcctgcagccactgctcgccctcggccggcggtgtccgacgtccggtcgagcaccaacctcgcctcgccgcgccgccccttcatcgccagccatcgccacgacggcgtggatggtccgcatggcgtcgtggaagcgggaggtgcttcgaggccattgcggacgagctggaaggaggggatagagagagaagtgagataggagagctgacatgtgggcccaagggtatttttgatattttacgcgatttctctctcctcttcaaccggaaattattattttaatcagcgcggtgtccactggcaaattaccacgtttatggagtgttttccccccaaaagtgagtttggacttatcctagagataaaacacacacaagcagtgtcctgtaacaatgcctgattctaatctctaacagaggttagtatctctaaccgttataagttcggagcctagcaaagcaagaatacccagctcctcaatttgtttactgaaacactcttgctaagcgccctcccttcagattaagatcgaccgtccctcttctccatgtcaatagtgagcaccgcagtcggctctgctaccctacccaagtgccgcctacgcgccccccattctcgatagccaccaccactactacaatagcaaatttttgcgtgcggttgtttcgcccgtctggaatgattcgtctgggaaaatcacgaaaatcaaaatccaaaaaaaaaataaaattacaaaatcctaaccctaaccctaggtcgaacggcggcggcggcgctgctcccgcccgccacctcgtcgtcgttgtcggcagcggccccggtccgcccaccgccacctccccacgtttgtccgccgccgccgagctcgctgcttcatcttcgtcgtcggcagtggcccacgtccgcccgccgccgccgtgtgcacgacgctcccggccgccgcgtcgtcgtcggcagtggcccctgtccgcctaccgccgcctccccacgtctgcccatcgtgagcccgctgccacgcgcatgccgctcccacccaccgccgccgcgagcccgccgctcccgccagccgccgtcgggcccgccgttgagagccgccgggaggagaagaaggaggcgtcggccatgtggtgagaagaagaaggtgagagagagagagagagagagagaggaaaatgagaggaggagaggaaagtgagaagataagggggagagagagaggagagaagggggcccagggggagagaagaaagtcaaaattttttttaataggatgggagggaaggctatttttctgtgcgggtagattaggaggcccgcacgcgaaaatagggtaatttttgcgtgcgggcctgttaagtaacccgcacatgaaaattgattttcgtgtgcgggcaacgacccggcttcgctccccccatttttccgtgcagtccaacttatggactacatggaaacaaaatggggtggcgtccaggaaaatcaatcctgtagtagtgcaccgccacctcctcccccatgtgagcactgtgatctaccccccacctccttagcatcgcccaccctgatctagttatttcgacctccggggtgccaggtccggcctccccaaggcagcgagaagggacgacgacatgcctcctcattccccaaccacgtccgcccttttcacagcgatgaggagggatgctattgtggggtcacggtacccgggtacccacggttgggccattgggccgcataacatagagagggccgcgtaggtctgagtttatgcagtgcatgtgtggctagataaggcaaccgatcttatctcatgtaaatagatggtaggttcctatattataagtgatttgttacctaccataattggccgcctccaagtatatataaggaggaccgaaaaccctaattcaaggaagaggacgatacgttctacgtgctattcacacgttatgctgcggatacttagatacaaatctaatctcatacaactggacttaggggcgttggcgcgcgaccagccccactccccctagtctctatactactactatatactctactactatgatatatactactattcctatatacatatgtatatacatacatgtaactttgtatacgtacatacaaagtttatatatatgtatataaatataattttctatatgtatatattttataaaaaatatatacatgtatacaaactttgtatacatacgtatacaagctttgtatacgtgcatattaaaaacaaaaaaaccgagaaagaaaaaaacatgtatacaaagtttgtatacgacatatacaaactttgtatacgtcgtacaaacatataaaaacaccgaaaaaatgaacaggaaaaccaaaaaaaaccaacaggaaaaccgaaaaaaaaccaacagagaaccgaaaaaacgaaccggtgccatgtggcccttccccatcgcgccgttcagccctccccctcccccatcgcgccacgtgcccagtcgcgcgcggggggcgccaattagcaatttcgactggactagggcattacccctgagagcctgaatcagtataaactctgtgtaaccatatctccttaatttcgtgcaccctataaattatattgcggatccagagaatcgactgttgatacgccaggtagaggggcgctagatcaatcatcaggaggagatggcttcaatcaccgattgataccgtcgacgagatcgcgttgatggcataagcagcgcaggacgatgcagtgcacgcctgcgacgtgctatcctggccggggtggcgatcgcgcaagtcgtggacgcgtcacgagctggcgcgaccccaggctgttcatgtcggggcatgcaggaaggcgcggtgggcgacgcagctcgccgaccgcccttctcgtcccgtgcaacctcccgcatcatgattcatgcttgcttccccgcgcggccccggttgatgccgcaccttgccacgcatccgcttgaccgtcgtcggagctgcttcaatcacgcatatgcgtcgatggatctggcgtcgatgcacgagattgatcggcatgcatgcacatctggcaaacagagtgcatagttgatcgatacatgcatgcccattgcatctacaaaattagtttttttaaggctaatctgagattgttttgcttgtttgcatgtcccatgcgacctacgcactactggaaaaagcattttcgccgacgttggcaaaaaattttcgcaagcggacatacgcttttgagcaaatacctcgccggtgaaaactagaaccggggaggagttggccgtccgcctacgaagatcggttatcacaggtggaccacataaggggccgcccgcgataatcatcttcgcaggcgggatacttataagcgccgcctgcaatcttcgcaggcgggcagcttatgtgcgccgcctgcgaagattgtttttcgcaggcgctcattatgtgcgccgtctgcgaagaataattttcataggcacccgttatgtggtccgcctgcgaaaatgtcactatatagtcttttttctccccaagccctgttcattctatccggtgtttctttctcctaaaacaactaaaatatagagggggggggggggaggttttgaacttcaaatattggggaatttttctacggtggttagatctactcatttccactctatgtatacattttttaagcttttaaacctcaatttgtgatggatctatgcatgcaaaattgtgaaggaaaagctccatgtttttttatttactttattttgatatgtttgtgtaggcttttaacttcaaatctcagggggatttttctacgatggttagatctactcatttccactctagatatgtaattttttttatgcttttagaccttaatttgtgatgaatctatgcatgcaaaattgtgaaggaaaagctccatctcctaggtctagatctagacacatagagaagaaaattttttatgtatgttaatttggtcgattaaaaaaattatttgtgttatgatgatatgattttgttagatttttctatgatattaatttagtatgaaattaaataatctttgttcttatgaatagtgctatgtcatttttagtgaaccctagaaatttggtatgaatagtgtaaatatttgttggtcattttttgtagagatatggacaggcggcaatggatgtatcattcgccgaggtatttggctttatatagggaagaaatgtaaatttattagtattgtgaaggcacacgctgaacagaacaatatgacgaagataatttgtctatgtgctgattgtaagaatgaaagggcctgggaagatgttggtaaagtaaaggaacacttagtaactcgtggatatatggaaaaatacgaaatatggacacgtcatggcgaacaagaagtggccgggcctgaaaaagaagttccgacagaagttgaagacatggtgtacggcgttggttgtggtgaagacaaaattgatctagaggaaatgttacgtcatgcagaacctgaggtgctgattgggtcggctagaggtttaaataactttgaaactttacagaaagcagcgaaggaagttttgtacgaagagtcaaagggctgtgacagtgagttctcaacactacggccagttcttgaacttatgaggttaaaggtgagatatggattgtctgatagtagtttcgacagtctacttgaactttcgaagaacatgcttccgaggcgtaactcattaccatacaacacatatcaagcgaagaaactcatatgtcccctttcacttggtgtagaaaagattcatgcgtgcgttaatcactgcatactgtacagaaaagagtacgcttctttggatgaatgtccaacttgcggtgctagccggtacaaatcaaatagaaatactttcctagaagcgtctaacatattcaagggaactaagagaaaaatcccgcagcgtgtgatgtggtactttccagtcaaagaccgcattaagcggatatgctcaaatctaccagatgcagatctaatgcgctggcatcaagaagggcgcaagaaagatgggatgctccaacaaccgacagatgctcatcagtggataaactttgatgctaagcacggggatcctctaaaatcaacctgcnggcnntctnggaaggagaatgatcagtttcagtggcgcgcg

SEQ ID NO: 66792 - DNA, 5811 bp, Oryza sativa
gccattaatttttgagggaatttgatgctggtacgcagaaactcgcctgtttaggagcaaaagctttcaacttcgttgttggtaattcaagtccacataatctacaaagagtttccaggtccagctcctaaagaagttccaaaacaagaatcaacatccagctgatgattttagaactgttcactaaagctgcaactaaaatgcacaactgcagtaaaaatatatgtcgaagggtggtgtccgcgtacctcgatcattaggatttctgataaatgtgtcaaagggtggtgttgaagtttgtagccactatgattgaagtacattaatgctctaacacgagcctttggcagcaaagcaggcaaaaaaaattgatatgtcagaacgaaatatatccagcaatattaaagcttgtgaataaagaaatgtgctggtaacaaccactagcataacacaaacttgagataattctcattcatactgaaaggatcagaacacaattttaaaacgggtgaggaaaatttaactaaccattgcagcaattcgtttttttgcacaaacaattaaacacttcagcagtatgtgggcaactgggcacctactttacacttaacaactatgtttgtaaaagctagataacagataccatatggatataacaggctcaaatgtacatacagaaggcaaggatatcaccttatcattaaaagggtcaaaattgctgttcggcttacctcattgagaaaaggttctaacagacgcagctgaagatcggttccttcagctgctatggcgcagaagaaacgcttgaagtttcctaggtggtagaatctgcagaaagaagatcagaacatatatatatcaattaagtttaaaatgatgtgtctcaatagttagcacttctgagttgtcccaaatcatactgctgtgcacaaagaagactcaagaagcatgatggctcttagagcatgacaaaaatgaaggctctatgtatgttgatacaaataatatgcataaagttaccttaatatagatctagcaaataccatttcctttgattgtataattgaagcagatagatggccataccacaaagagagtgaatctacctggagataaacaggaaattaggctactattcactagctggagtaagaagaaagtattgggaacaagagaataacataaattagattatttagaaggcaataaaaattgggggcaaaccattttgggtatcttgcagcccaaatgtagaagcacgtagaaggaataatattcagtctctttactactctgtgaattgttcttgtgaattacatcatacatatcaaacagagaaagaaggcacttcattagctgctccatgtttaggtaacacagggaagaagcatcagaatcctgggaagacctagaaagcttctgatgggatagaatatgaaactttatctgcagaaggcaggggcatgcatcagataaagctgtgaaagaggaataatctaccctatatgcttgcacttgaagcaaatatgttcctccaccttaacaaaatgacatccggcagcataacatcaaaagataacagcatctaacgaacaaaaaggaccacttagtggctaacacagatgccaagtagaaaatgcctgaaagaactaattcatgcataatcggaaaagaaacatactttctcccaaaccaattagagagaaaaggcgagaacctcaacaacattttatgcatatcgagtattactctatctaacaagagtttggatgagtgaattttctggcctcaactacttaaaaaggatggaacataaccttacaaggaaaacaaagagaaagttgttgagtagtagttctgtgatagagtataaggatgctcaattctataatgttaaaagttagattccagacacaacaatctaaaccagacaaataagtaccctaaaattcagaggtctatacaataagataaaaacatggatgatatgagtgtaccacatcctcgtatatttgaattgcttgggcattcactatgttctgaatactgaggtcttgcctcacagaccttgtcctatcaaatataaaatcatgaactatctcaaactgatgctctgaggaatccaataaatgcaaaagataatccattgtttctcgcaggactgggagagggcgtatatctgatgcctgtacactcgtggaagagatagttctgcaaaactagcaggaaaccaagtgttagaaaaggaacggagatacacagaattctcaaatagctacctgattctcttaaaacacacgcggttcatgaaatctttcagaccacatgaaactgtagtgcaaatttgtaattataacagtgttttcaggtggcaaattggctattctatgtggttggtaaagattcattatcttacacaccttttatgatttttcagtggcatttttactcaagtttgcagtggcaagtaaatgaattccgacagtttcacctcaagtgtgcagaacatgatatctcattgtataactattattttcgttgatacaagctctttttacctaataacaatggcatgctaaataaataatgtaaaaaaaatcataatctgcttttgcacattgctttcttttatctgcaaacatgaccacatattcaagataaaaataagtattaaatgaattgataatcctgtcctttcatcatatcttcacccctgcaaaaatactagtacaaggtaagtactaagtagggttatatttcatccaataaactataaaaagaaatcaaacaaaataaatataaatctgacactatcgtacattcaatctcttgaaggctaggctacccgaatagcttccttacactctggcagtgattggacaagacaagcgtagatcagatttagtgctgcattgctgttattgcattattggtggcatatgtaactatatagctacatctaacataaagtgttgattgttccaacacatgcttaacggcaactgatcacccttttaagcaaaaatacatgcacagttgcatgcacaaaaaaaagcttccagctccatatcaaatccaatcaaaacagactaaaccaccacatggaatggaaccaagctatagcctgtccatttgcatggagagaacaatccaagcagatacgcaccaaaaatgaccagcagtgaagcatcaccacgacccaaccgcaagttcaaaaagaaaaaaaaaatcaggaatggcctccacatgagtacggagaaaaatggatggctcaccttcttcacggcgagggaaggggacgtgcgcgcggggtcgccgcccacccgctcgaacaccgccaggtccctcagccgctccctctgcgccctctccctcgctgcagcaggaaaaaaaacagtagcatccatgagctaaaacgcgccaaccaaatccatccaattaggggccaactgatcgcgcaatttcgtcgaacaggtggggggcaattcgccccgccaaacgggggtcaggtcaggtcagccagcgtcggcgtgagcgcacgggaggcttggacgaagcgcgttacctgggcacatgtcggggcagctgcccacgatcggcggggcgtcgccgccggtaccagccgcggtggcgctggccgccgccgggaaggaagaggtggaggaggaaggaggaggtggcggtgaggggccggcgccgcggctgagaccaaggccgcggccttctccccgacctcgccagcctcggccccatccgtggccacgagtggaactccggccgcggtggctcgccatgtcccggcgatccatggcggcccttggcctcgagctccgaggggtagtctggtaatttggtggttagttgaaccgtggagtggaacaatggagcttcaaacgaacatgcttttttagtggagagagagagggggggaggccaagatttttttttaaccttttaaaattttaattttaaagtaatgtcctgttttccaatttttttttcaaatttctaacttttccgtcacatcgaactttcctacacccacaaacttccaattattccgtcatatcgttctaatttttttaaacttccaattttagagtggaactaaacacagcctaaatcataacaaaacttatttttaaactgaatctttcgaccacgtcagcaagagtggtgtcatgaaataccgttgccatgtcatctagaacaatactactccctccgtcctctaatataagggattttgactttttgcttatactgtttgaccactcgtcgtattaaaaattttttggaattattatttattttttacttactttttgcttgcaccgtttgaacattcgtcgtattaaattttttttggaattattaattatttttttgacttactttattatctgaagtactttacgcacaacttttcgcttttttatattttcacaaaatttttgaataagacgagtgatcaaacagtgcaagcaaaatatcaaaatcccttatattatgggacggagagagtatcacactaccctggctagtgtgacggtgttattttgccacacgcactctggctgacgtgggcacgtggcaacgttctcttgccaagccattcatattgacatgacaaagcaaaattttcacatcaataaatcgattattgatggtgtgacaatattatttcgtcacgcacagacgaagtggcgtggcaacaaatattcaggtttagaaataagtaaagagatgatttatgtttagaattaaaagattaagaatcataaaaattcaaaaacctaaaggcaagacggtgtaccggtgtttgaggttcaaactgagatgtgggaactttttttttcaattacacaaaaaaatgtatattcacgttatatagtctacgcacttgtgaatgcatcatctataaaacacttgccgagacgggggcataaataaatacaagaaatataattggaagaatgagcagttctttttgaaagctctgcatttctgtcagggttacgggtaaagtataccctctactttttgatatacgtcacatatcgatatggtatacttgcgcgtatacggatgtttttggcatacgttaaggaaattcattatggagttcacagatggaaggaatcctactcggattgaactgggtcgtcattatatcgtatcgggtccgatgtctccgagtcctacttggagaccagttgacctgcggtataaaagggaccccccggagaggacctagggcatcgaatcttaccgccaacacatccaccacagcctacgaagccggagcctacaggagccaagtcgccgggtgatctagtcgaatcaactcgactacgatctcgtcggtatcgtcgagttccactattccctttgtaatctgtggtttccatcatataatcccatatcaactagattagggctattacctatcaaggggcctgaaccagtataatctttgttttctgcctactcgatgtcgtattacgtagatcctcgtaccagtgtaccctaataccctctatatccggtctacgggtatcccccgtcgacagtggcgcgccaggtaggggcacttggtgctcaaggttctactactatgacatccagcttcgtcgacaacggcgtcaacaccaacctcaaccaaggagttcctacttcaacaacactggtgtggactcaagtcggcgaaatcgtcttcccggtttacaccacagtgccgatctcagctggtccgtcaatggccggaaacgagaacgcagtggctataacccaggacgactacatgttgaa

SEQ ID NO: 66793 - DNA, 14782 bp, Oryza sativa
aaatctttccactctccagtgccaaccccgacaagaccgtcaagatcggggcattactaggccaaaaataggaactcgcgctcatcaccttcctccacgacaatgctgacgtgttcgtttggcagccgtccgacatgccgggggtacccagggaggtgattgagcacaaactcatggtgcgacccgacgccaagccagtaaagcaaaaactgcggagatttgcactagatcgaaaacaagccatacgagaagagctcgacaagcttctcaaagttggcttcatcagagaggtactccatccagagtggctagccaaccctgtcatggtgcggaacgccaacgagaaatggagaatgtgtgtcgatttcaccgacctcaacaaggcgtgtcccaaggatcacttccctcttcctcgaatagaccaactggtggactcaacagccggttgtgagttgttgagcttcctcgacgcttactccggctaccaccaaatcagtatggcgaaagaggacgaggagaagacagcattcatcacgccgttcggagtattctgctacgttaagatgccgttcggactaataaccgcaggaaacactttccagcgcacggtccagggctcacttagcgaccaactcggaaacaatgtcgaggcctacgtcgacgacattgttgtcaagaccaagtcaagcgactcattgattgatgatttgcgggaaacgtttgacagcctccgacgatatcgcctcatgctcaatccagagaagtgcacgttcagagtaccatcaggcaagctgctcggcttcctcggctctggcagaggaatagaagcaaatcccgagaagatcaaggcaatcgagaacatgaagtcgcctacaagactcaaggaagtacagaagctaaccggatgcatggcggcactaagcaggttcgtcgctaggatgggagagcgaggacaacctttcttcgctctgctgaaaaagcaagacaaatttgtatggacacagaaagccgaagaggcattcattgcactcaagcgctacctatcaaatccacctgtacttgttgccccctaacctattgaagaattatttctctatattgccgccacgccatatttcattagcactgtcattgttgtcgagagagagaaggtgcaacgaccagtctactatgtcagcgaagctctccacgacgcaaagacaagatatcaacagatccaaaaactgctctacgcggtaatcatgacattaagaaagctacgccactactttcaagcccacagggtcacagttgtatcctccttccctctcggtgaagtagtgagaaacaaagacgttgtcggccgcattacgaaatgggtagtcgagctaagccagtttgatgtccactttgtgccacgaacagtcatcaagtcccaggtacttgccgactttgtagccgattggactatgcctgataacaggtcagacaaccaaatagacaacgaaacgtggacaatggcgttcgacggcgcactcaatagccaaggagcagggggcaagattcatcttgacatcacctttaggagatcaattcaagcatgcaattcacctcaacttcagggcgactaataacacagccgagtacgaaggactactcgccgggataagagctgcagctgcactcggagtcaggcgactaatcatgaaaggagattccgaactagtcacgaaccaggtgcataaagattacaagtgctctaaccccgagttatctgtcacaccccgaagttttcctcccaagccaaaaattgaatttacaaatgaccccaagaaaatgcaggtgaaatcaggagaaaaccctaataaagtaatgcaaataataatcggattggacatgtggaatttttcttgagttctacatgtcaaaattcattaacaggatttttagtggaattttcagagctctagaaataattttaaccaattaaaattgagcaagcaatattgttaattccagggaaaatcctttttctttttctttttcttttttcctctctttttcctccttcttgtcaaatgggccgtcggcccatttcccttttccttcccccccctctctgttgggccggccgcaggccgaggcccagcccggtagccggctgcccgcctccctcctctcggggtcgccgacaggtggggcccacctgtcgggcccgtctccctcctcccgccgatcccggcgcgccgccgcgcccgaaaccgccgccgcgcccacgtctccgccttccccgggccacgtcgaccacgcccgcgcgtgcgccgcgtttcccgcgcccgttcccctctctctcccgctcgcgcccgcgcccgagatggccgggattcgaaaaccgaatcccgcctctctctcctccccactcccccacgtcggccggcgaatcccgcctcttccggccacgtccggccctctcttcccctatttaagcatcgccggcaccccctctcgctttttccccatttcgccgacccctcccgagctcccaatcgtccccgcgccttgcaaccacccgccgccgccgtttttgctacttcggccgccgctagccgccgctaggctcgccgccgtcttgcgccgtcgccgccgttagattcgcggggtcgagatctacctcggccgcctcttccccgttgaggttcgccgccggagacccgtccccgtcgtgcgccggtgagtgacgccatggccgcggccttcggccggcgctctcgctctctcgcgctctttcctctccctctaatccctctccttttgttcgttaggaggttccggagctcgtcccgccgtcgccatcgtcctccgtcgcccgccgtcgtcgaccgttgtcggtgaggccctcctcctcgttttctctctctcccgcaccgtttagccgccgcgtcgccgcctagctgcgtagccgccgctcctcctctagccgccgctctccgccgccggtcggtcgccgtcggccgtcgccttgcgccgctgccgcatgcgcaccgccgccgcgtgagcgctgcgccgccggcgccatggtcgccggttcggcttgcgccgtgcccgcgcgcccggccgcgagctcccaccgccgtccgatctacccttgggtagatcggggccgtcggttcggccgccacgtggagccgccgccccttccatctcccgtgccgctgacagtgggcccgcgagccgccgcccctttctctctctcccgggtcgctgaccggtgggtcccgcatgtcggcgccgcacccctccgtgctgacgtcagccctggttaatattgcgcaataaatgatttaaggtttttcttttatagtaataaacacagtgaatcttctaaaattcataactaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccggttctttcgacgctccggtgtacttcgagatagtcgccgaggttcctccagcagcagagcaaggcaagtcatgcttgtcacttgatcatattgatcctatattgcaaatgtcctaatgttttctttcaaatatcgcatttgttttgcaattatactatgggatggttaccttttgttacagccatgttattttgataccatgctcctttgttagcttgggttataacatgattagagttaggactagggtttgcttagccatgcttagttcaactagcacacaatggggagatctcatttaaaacctagactataggtttttatgataatgttggattagcggcaccgctttggtgttggttaattaaaatgaatcacatggtgggctgtgggtgcatggttttgctggtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgagcagtgggggtgaaacctgaggtgtggtgtgcttggttagagggggttatgtgaagggtcctgtcacggcctctttccggtatgtcgtggtggcatgtcggcgcacggaaacgtgtcgtggggctgtgtcctgtgggtacagttgtacacctctgatcagagtaaaactattcgaatagccgtgcccgcggttatgggcggtcaaccagattcaccgtgattagtctcaccctagtgtaatttgttgaacttggatagtttaggtggaaggttgggcctgtcgcaacgtgggttagcgttggacagcggatgtttaatactgcttaattattacaactgttttcgcattaaattcctgtttataaatgccagtatttatgcaaatgaaccactttagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagtttagtcaaggcttagctccagtttcttttgttttccgctgcatttctgtaagacttttatgatgtttgtaagacgtggatctgaatgtcaacattgtcgtttgtgtaccccggctggtcctggacggggagtttaatgcacattctgcttggaattctattcgggaatttctgggcgtgacattatccaagtatctcgcagaagtcagaaagctagaaaaaaggttcgatgggatcgaggtccgacatgtataccgcaaggacaacattgaaccagatgatatagcacggcgtgcgtccagacgagagccactcgaacctggcacctttctagacgtcctgacaaggccatcagtgaaagacgcaagcggtgaagatagcccggtctccctcaacaacagctcgggggctacagaggtagagcgcgtcgttgccgatatcgagaccacagacgactggcgcaccccactcatcaaattcataggcagcaaagagttgcccgaggacgacgcagaagctgagaaaatatcctgtaaagcaaaggtctactatatgatcggcaatgatctatacaagaaggcatcaaatggggtactcctaaaatgcgtctcgtccgacgacggcagacatctcctcctcgacatacatgaagggatctgtgggtcacatgccgcccggtcggacattagtcggaaaagcttttcgacaagggttcttctggccaaccgccctcaaagactcctgcgacatggttcagcggtgtgaagcctgtcaatttcacagtaaacacacaaggctaccagcgcaagcactcaagactatccctctcacttggccgttctcgtgctgggggctagatatactcgggccattcccacgaggacaggacggctacaggttcctattcgtggcgatcgacaaattcactaagtggattgaagcgacacccacgggggaaatcaaggccgacaacgccatcaaattcatcaaagggatattctgcagattcggattgccccaccgtatcataacggacaacggctcccagttcatcagtgccgttttctaggattactgcatcaggctgggagtcaagatctgcttcgcctcggtttctcaccctcagagcaatggacaagtcgagagggcaaacggcatagtactacaaggaatcaagacccgcgtctatgacaagctcatgtcacatgacaagaagtaggacgaagaacttccatcagtactatgggccgtgcgtaccacaccgacaacatccaacaaggagacacccttcttccttgtgtacggctcagaggccatgctccccaccgagctacgacatcaaagtacacgagtacagaaatattccgatgaggatcaggaggagcagcgaaatgacgatgtgaatctgtttgaggaacatcgcgaacgagttaccgttcgagcagccagctaccaacaggcccttcaccgttaccacgagaagcgcatccgagcacgcacgctttcgatcggcgactacgtcctccgacgtgttcaaagccaagcagggcgaaacaagctctcacccaaatgggaaggaccgtacacgatcacacaagttctgcggccaggcgcattcaaaattgcagatggcgattgtcgcgagttggcaaattcctggaacattcatcaattacgtaaattctatgtataagtcaatagtatccatacttgtaagacatcttacagcttcaataaagcctatttttcaggtccagaccaaaatcaaagtgttccttcccgatgatcccttacctagatgacacctagcgttgaaacctaccctcatgtccctttacgctgtcttaacaaggcctccgaggaacctaagggaacttcagctggggccgcccagagccgataagaccttgtcggatcctgtagagacaaaagaccatgtaagatctggtcgtgtaagagttctcgccatgcgtattaaccaagccgtgtaatcggaaataaactttccaacttcacggctgggggctaggatcagtgcttgttcaaccgaggcaggtcaaaggtccaagagccttatcttccgagaagaattctccgatgacaatgctgggggctagggagagtgtataactcaaacgactaatcgaagtcgcgaagtgagaagacactcatacacaatacatccagagtaagaaagcttagttggatagatttcttttctatttcacaagtacttcttacaattctataaaaatccaaaattatattacactcttcccctaggacatttgtcataggacacggagactaccaggaaggccaatgctagtccatagactggaagaccttttccgccagcggcgccatcgacttcgccaggccatctatctccgtaggagttctccgagaacgagaaaacccttcatggaggaactcgaggtgcagctgcggacgatgatctcatatacaggccaatacatgcccccggcatattggctcgatcgacgacactcctgcttcagggcctcgtcgatacgctggctgatgccctcaagctgggcgcaggccccattcagccacgggatgtatccagtcgccgatttctcgggatccccacggggtacccggagctctctacagacccttgacatggaggtgcagaaactcttcagatacgagttgaaccacacctcgcggccccggagtgtctccacggcctggtccttcttcacttccagcatagtcctctcgagttccgcgacctcaaacttcgtcctccaatactggatgcgacgatcctggtcagcaagcgcactctcgaggtctgctcagcatggaaacgactaagtcaaactgctcttctctcacgagaatacaacaaatcaagtcgatccagacggaagagtaaaggagatgaaaacaaagataaccaacctaagggagtcgtcgccatgctcgtttccacaggcgaattttgagctacatcgccctccggcacatgtggctcgaacgcaagtgccggaacgatcactggcaactcaggctgcccgcgctgctggacatcctcgacatcaacatctctacagacgacaacaaagtactcaagatcaaaatgctaaagaaagctaaggcgatgactgcatacacaaaggcggttggaaccaatgaaagttttacaaagcatgactaaggagtacaagagagtcaaaatcctactcttcaaaaagtgggagaacagactcccccagatcgccgacttcttccatcacatccttgcgcgcgtcgctagccgccccctgatccaagattttccgcagatcgagtttagggtgcgccagtctcacacacgcaaggacatggcacgccccggtatagatcccgttggacgtctcctctccaatcctagccgcgtgcttggaggggatctcctccatcgccgtcgccagctccgcaagagaagtcgtcggcgagaactcatcgggattcgccgggatggtagacttgataccgcactccccggcgagctggtgcagaccagtataggtgactcgcaacgagccacggatttccgacaagttgttctcgcgctccgacatgcggtgctcgagtccctgccgttgtcgcttattgccggccaccagctcccgcatcttctggaggtcctcgcgaacctccgccaaatcatgcgccagccggtcggcgcgctcattcgccgacgccgccgccgccgccctcgcctccgcgatctcgcggctaatgccgcgagcaccagcctcaaggaggcaccccatctcaacctggagctcctcccaggtgaggatggcagccggcagacctcgaccagtggcgagattgctagctgggccgctaggtgttgcctcgcggctcctgggcacgaccacgacatccgtcgaggccacgataggagacgcgctggaggtccctccagacccgtcttgcgccgccttcgcccacgccgccctgcgaaaagctgcaactgagacaggctgcaacagtttgacgaagtgacaaaacctcaaagtcatccacttgcttctcgccaagcgtcactagccgttgccgacgtggaggcgggggagacgcgtccgaggcctggagtataacggatatgatgtgaggtggaagttttctgactacgtgatgaaagaacaggagaacttaccgagggggtgggtgtcttccgacgatgtccgaccacagaagagaatttcctcccctttttcagaacgttgccgccactcgttgtggcagcagcagcaacagcgtcagacacctccttggcgactttcttcttcagcgacgccgccacctgatggtccacgagcggcccgatgatatcagtcagagggagagcctacgcttcatgaagtcataatgcgatcccggaagaaaaatgcaaaaggaccgctgagtacacttacattgatggcaacgtcgcgctcggctgcccctttctcgcaaagggggacttggacgttgctcgccgttgtcgggccagtgatcatcagttggccgacacggcgctccacggttgcgctgtccaagcctgtagatcgagaccagaatccgataagtcgggaagaacacgcacataagggagccaatttaactaaaaagaaaaataccccgaggagaaacccgggtcgcgtcctccggcccagaataatcaaaggctggatgggctcgagcctggagcggctagatccgcctaccaatgaagtcggcagcgacttcataccccgacaatccccgtactcggaggtcatcaatgatatcgatgaaagattggagggatggggtcaaggcgagtttggcggtccaagatgaaatcttgtctagttgctcctcaggaacaataaaaaccggatccgaatcttctatctgaagatagaaccacctcccccgccatttgctgcgagatgaggggcactggaagaggatgtatcgcgacttcaggccatcccgaagtcggaaaccgacacatccagacacctttttgggttccatccaactcaactcatagtaaaagcggaagaggtcaagaaacggctctaccccaatgtaggcctcacaaagatgcgaaaagatactcatgaaggcgatggaattggggttcaaatggagcaaggaaagactgtagaaattcaagaccaagagaagaaattcagaaggcggaggaagaaaaccacagagaataaagtcctcgatcacaaccatgcgacctaggacaggttggggttcagtacctcctacttctctctccgcggtcccgcgaccgggaagggcgccatcctcctgcaacttctttagcgacgtgctggtggaggtagacttgtcgagatccattgccgccggggatcgccggagaaaggaccgagatgagctagctagggttttttgcgggagcggagaagacgagggacgcttgggggctggagagttttttcacaacaggcggacttcaaattggatccccaaaactcccttaaatagacgcacttccgacggtgcgaattccaaggaaaggagagagatggccgtcggaaatttctgggtccgttacgcgcggcagtttttcggacttcaatttaaattcactcatgaccgttgagcttcacctggcgttgtcgatcactccttgtctctcagtcctcacaccgagaacgacgacaacttcgacatcagaagtcgcgatcggtttcacgagttcatataagcagaagtcgggggctactgtcagggttacgggtaaggtataccctttacccttcgatatacgtcacatattgatatggtatacttgcgcgtatacggacgttttcggcatacgttaaggaaattcattatggagttcacagatggaaggagtcctactcggatagaactgggtcgtcattgtatcgtatcgggtccgatgtctccgagtcttacttggagaccagttgacctgtggtacaaaagggaccccccggggaggaccttgggcatcgaatcttaccgccaacacatccaccacagcctacgaagccggagcctacaggagccaagtcgccgggtgatctagtcgaatcaactcgactacgatctcgtcggtatcgtcgagttccactattccctttgtaatctgtggtttccatcatataatcccatatcaactggattatggctattacctatcaaggggcctgaaccagtataatctttgttttctgcctactcgatgtcgtattacgtagatcctcgtaccagcgtaccccaataccctctatatccggtctactggtaacccccgtcgacaatttcaattataacaaaaatgttgcaagaattgagaacgttgattatctaaaaaaaattgagaacgttgatatttagagccggcttttggcatacctttatcctaaaagctatatatcttaattttgaatttaaaattacattttggttgccggccttatttccatttttacaagagaatgacttaaatttaaaactgatatataattgttataaaaaacatattttacaattttagatattaaaaataactataaaaacaaagatatttaaagaccccgatgaaattgacacttgtctttgctttaatttggactcattgtgacaaactgaattgaattgtttgagaagcgatactttttaaaagccaccaaataggacttggacaccctactccctactaagggtggacaaaaaaaaatcaagaccgaagaccgacaatgaaaaaaccgtatcacgattaaaaaaaacagataaattagtcactggtctcctgttcggtcttagctgtgagaagaccaatcaaattctcggttcttagctcttatttattggttacccggatggccgaataagaccgcagttggtccaatgcaagggaaacatatcatttgcagtactatcctttgactttgagtgactgacatatagacccatgctcattaggcccacgtgtcattgacccaagtcagaggttaataccgcagaggagattcaccccaatgcgagatctgccacagtgccactgcgcggtcagcttggtttagaccgaagatcaaactgcggttcggttaaccggaacatggttttttagataagttcggtttttcccatttgcgcgattgcccggaccgatttctcggtgaggaccgaaatggccgccctcgacagcttgacgaggcaaccacgtgacgggacatcccatccgggccgtccattcctcccaccgacggccgatctagcctcgtattccgtggctccgaatattttaaaattcccccgctccacatcgtccccgacgcaaaatcccacccccaccatgtccaaagcccacactgacacgtgggcccgaagcgcactctggccccacatgccagtcactgcgctggccccgggcaggccgtgggctacggggcgaggaggcatctttctcgcggcggaaagcgagggggacgacgcggctcaggaatcgaggcctgtggggcccacctcccccctgacgccactgccatgtgggcccgggaggacagcgtgggcgccaccgcagcactgagaaggggaggagagtggggctctcggcgactcgagtgggtataaaatatggtctctctggatccatcccctcctcttcttccaatattattttttcgccttttctgttcgtgtgttcgtggtggagttcatctcgccttcccctcttccggtcctcccaccgctcctcgccaccacaaaccgccgccgcctcctcctctcctatctggtatcgtaatcgaaccagcggaaaccgctattcgtgtgcgtgttttttttctattcaatttgtttgctcgggccgcgtaatcttgggagttatctgcaatcagttttcttttctttctttttctttttttttttcattttgaatggagtgaatcgtgtggaaaaggtggctgttgtagagtttttagtcttaccatgaactgattgatctacgggcgagtgggaatttagcctgttcttggattttagcctggttgcagcatctagtgtaattgatccagtttgatttcttttttttttttgggaataaatcagtgtgaggcagcctatgaaccgaacataagtatctagtattagtctgtgagacaaactatccctggctctataagagggaaacctgatgtgtctgaaagaagttgcgagttcaagaattcctatctgaaaaaagcaaagatcaggcaaagatcatcagtttggatcatgtataaatttcccatgttgcagtatgtcttaattaggaggattattcattaacaaatgtcatgcgaaaaatttatatcttcggaaacaatcgctttatcattcatgagcgaattattacttcgattaggcggatttgtgataattgatgaataattctaagtaatccttgacagttcagtgatttggactggtactggatggtaggtgcccatctgtgtgcctttttgacttgtctatatgccttggtaccattgtgaaacttcatgtattcagtcttgttggattttgtaagttgcattggaatgatatgcttatgtaacattactagtggagctgttgccctgatatgttagaaattgtgccattttttgcagtgcggaggaggtataccacacctttggattttggggaagcagtacgttgattggaagaaatgtcaggaggtaggcaatcatactggtgctaccaatgtagacagcgggtgaggccccgcggccaggatatggagtgtccctattgtgattccggttttgtgtctgaaatggatgatgttgatgctctcatgcgccactttgttgggatggatcctgatttccatcgtgatccaagattcggtatcatggaggcaatctctgctgtgatgaggcatggcatggcgggaacgaaccgggaagttgatgtgagaggaaggccaaacatattttctgacctggagatggagtttggctcagggccatggttgctcttccgtggccagcttcctggtcatctctcagaagacaatggttttgatgtattcatcaatggacgccgtggtgttggcatgcgcagagcaaacattgcagactactttgttggacctggactggatgatctgattgagcaattaactcagaatgatcgacgagggccgccacctgccactcaatcatcgattgatgctatgcctactgtgaagattacacagaggcatctcagtggagactcacattgccctgtctgcaaggacaagtttgagctgggatcagaagcaagggagatgccatgcaagcatttataccactctgattgcatagttccttggctggaacagcacaattcctgccctgtttgccgatatgagttgccaccacagagctctactggtgctagctgctcgcgcacaagatcaaccaaccaaagtcagagttcaagtagcaatgggagaaccaatggacgtcaaaggagaaggaatccgttctcgttcctatggcctttccgatcatcaagctctagctctcgttagattagcctggtaatctggttggagtcctcaagactgtttaatcgaagatgctcataaaatgggtgttatgcatggcatcttatcgtccaatctgtaatgtatggcttgttatgatcaccacggaatgcttttccttgcaagtatatccttccacagcttcatatcagatacttcttttactattctgtttacataaaaggttaacgatagtatgatacttgtttagatagctagagaaggttattttcttaatgttgtattacttaatgttctacagcagaatatacttctgtcaactgtcattaagacgtttttttagctgtaaatctcaagggatcaatggtagcaagcatgatgatataatatagaagcaagttgcctgaaatttcagttaaataagtactagttaatgctaggttgtgtccttgtgtcatccatgttggcatattctgcctgattactatttgcctgtgcgttt

SEQ ID NO: 66794 - DNA, 7651 bp, Oryza sativa
  unsure (1)..(7651): unsure at all n locations
tacttgagagaatacttcacagtgaaggccatcatcttcgtgatcattaacgattaccccgccatgttttcagtttcagggcaaattaaaggtaaaacaggatgtgtgatctgcttgaatggaacgtactataggtaccttccgggttccaacgagtttgtgtacatgcagcaccggcggttcctacgcacagatcacaagtaccgcaagatgaagtcagaattcgatggcattgaagagagtgatcctccacaaaaatatacatccggggagaaagtatgtgaaatgacagagaaaatagtttgcgaatttggaaaagggactaagaaaccttcaaagggtacaaagcgcaagaaacctgacaagaccaagaaaccagaagatagaaagaagccaggtgatcaactccctcccccattcaagaaacattcaattttctttaagtacctcccgtactggaaagatctagaggttcggcatgccatagatgtcatgcatctagaaaagaatgtgtttgacaacgtaattgaaacattgttggacataccatagaagactaaggatggtctgcaatcacgacttgacctagtcgagatgggaattagtgaagagttacaccctcaagaaagagagaagaacggcaaaatatatatttcaccagcctgtttcacaccgacacctgaggagaagaaatcattttgcttatcacttcgtgatgtgaaagtgcccataggtttctcatcaaacatcagtcgactagtctccatgaaagatttgacgttatctagttataattcacacgactgtgctgatgcgaaaaacatatactggcctgggagatctgcttagctccagtgcatgtccaaaggttgatgacatgcgagcgtgccagtcagtttgatcctgcaactgacaagatatgtaaaaaacagataaaaaaagccgattggctgacaagccgatggagtaattccagccgatagccgaaattagccgatgccgatttcagtcgatgtcgatagggtttttagcaatcggctatatgtccaatgtagataatgatataaaggcgatcggctgatgatgataaacaataataatatagcaatataatccagtagaaaccaatctgattcgaagggtaaataatacgctggaggtccgatgtcataaaatctacaagattagataaatcaatgaaacttttgttgtcatcggctaaatccaacttttatatatatatatatatatatatacatatatatatatatatatatatcatatgctatccttataagctgatgcaacatccagataacttatcggctagcaccccgataaaacactagcatgaacctatcggctaaacaagacttatgttatcaacaacaatctagtaggtcgaacctaaccgatgcagcacgagattgtatatgataatctaatactagatgagccgatagatctgtctaatgtgatagatataacaaatctatttagaacaacattatgattgtagagatatatcagctaagatagaagatcagacctaaccgagacagtcccaactaaaccgatgcgtctctaaacacaatgcaattagagatggaattgagatatcaggtaggcaaatatatcaaccaaaccagagcgatccaagagatcgaagcagccgatagattcaccagggccggcggaacgtaggacttaccccttcgccggagatcgaactgaaccgatgcagccccgtgtcaggtgccaaatttcaagtaaaaacctcaggaaagagggtggcgatgcgccgagagtattattgatcgagagataaattacaatgaccccgggtttacatatttatacccatgggtagatactagtccttgtaggacaagaaagaaactctcctaaagataaaaggaaaacataaagtcctaatcggacactaaacacactttcctaaagataaaaaggaaactaacagactattcctaattaatagataactgccatgctgcatcctcattgaactcggttactcttggataagctttctttaatagattaatttccttaaccgaatatagtaagaatccgactatggcgacttgataactcccatcgactgattccaggactctgaagccgatactgattttaggccgatgacatcctcgaggtttaccaaatttcactgttaacagactgtcatgtcttgctcaccgtgtttcttgccattgcaataagtgccataaaaccagaacatttgaaggttgctatcacaaggttgtgctgcttttttaatgcaatctcacagaaggtcattagtcatgatgagttagcaaatcttcgtacattcgcacatgagacacagtgccaacttgagatgtgtttccctccatcattttttgatatgatagagcacctcatcgttcacatagtgccccagatggatgcacttggcccattgtacctccatcaaatgtggtcatacgagcgttacatggcggttttgaagggctacgtctgaaatcatgcccatccggagggatcaatggttgagggttacagtacagaagaggttgtcgagtgctgtatcgattacctcaaagatggaaagacaattggaatacttgctgtcgacgtttgatgtctcgactacggtatttggacagtatggggatcgtcggtgctaggatatacgcgagactgaggtaaaagagacggagacgaggatttttatacaggttcgggcccctgagcggtcaggtaataaccctacatcctgttggccggagccggagttgcttttattcaccataatcgcaccagtacaatatgtggaatagcctatctaactgttgtcgacatggcggtctgaaggtctgactcgtaatcgacaacagggtagccttgctcctcgaatccgtgtccggcgagatcaaagatagcgctttcatctctcctgacggtatccggagacaccgtaggggaatagccatgcctatccctgaagtcgatatccggcggcgtgtcttggcgtatgttggcttgtatgctgtggcttcagttgttccgaatattgtggtggttgttgattgaggtggatctcgatcgtggtgaccatgttgatcgtgttgatcgtctcctggtcagtcatccccctcctcctagggggtcttgtatttatacccataggtgtccccttgttcaagtagaacttgggaaaccaatatggatacaatccgaatagtccttgtcgtttccgtgtagaactctggttgcctttccttattggaactcctcctatatccgaaggttgcttccgtataggacatggtatgtggtgagccctgtcgagatttagtcaactactattaggtatgtggtatccataaccctgacagtagcccccgacttcaatgcacatgaacggattcctattctcgaccactgaccatggagtaactattatcgagctcacgtgaccgttctcggtgagtttagagataacgttagacttcctttatcagcctcgtgcgggcaccgaaagggtttgtctgagtcaatctctgatgtcaaccaaggaagtatagagcagacgactaagtctcccatcttgctgtaatcgaaaatttggattgaagtcaagaaattttatctcggcgggtacaccatctcttcattccgtattccttgtcgagatccagcaaccgttctcgagcgatcgagaaggcgtagagtctgcgacggagccttgtcaacatttgtcgtactcgccttagtcgatcttggtgtagaactatagagacatgagttttcaacaaatgtcgaatagaattttcctgaaatcaatactcataaaagaatatcaaatagaaagagcccccgagcgaatgctcaaagggtgacatgttataatatgtatggtaaattaaaaatgaattaaatttaccgaccaatgttttgtgtatgagcgtcttctcttttaccgacttcgactagtcagtttgttgagttatgcactctccctagcctctagccttgtcgtcggagaatcgttctcgagggacaaggctcttggacctttgaactgcctcggttgaacaagtactgatcctagcccccagccgtgaagttggaaagttaatttccgattacgcggcttggttaatacgcacggggagaactcttacacgaccacggctgacatggtctttcgtctctaaagaatccgacaaggccttatcggctccgggcatccccagccgaagatcccttaggttcctcggaggccttgtcagcatggcgtaaagggacagtaggataggtgtcaacgctaggtgtcatctgggtgagggatctctgggtaaaacacttggcgatcttgtgtacctgataccaactttgttggagtagaggtagtaggagagtcgctgcaccactggtggaggaccaggcagtagtcgtgactcgaccacttgaagtggaaacagtgggtgaatcgctacaccgctggtcgagaaccagaggtagtctaaacttgaccactagaagtatgggtagtgggagaatcgctacaccgctgattgagaaccaggggtagtctaaactcgaccactagaagtaaaggtagtgggagaatcgctacaccgctggtcgagaaccagaggtagtctaaactcgaccactagaagtaaagatacgagagatcgctacgattgactggttgagaaccagtgagcaggtgtttctcgatcaatttgaagtcgtccgaagtcatggtgcgaggactgctactctgctgccgttcgaagatcaatcgtagtcgtacctcgaccatctgaggttgcggtgcgagagattgctacgtactggttcgaggaccagcaaacgtgtagagttatctcttgaacaccaatgaagtttgcggtgcgagagattgctacgtactggttcgaggaccagtgagcgagcagaattatctctcgaacaccgatggaagcgctagagttggtttgttgcaagtgtatctcatgtggccagcatgactcacgtacccaacttatagcatatacggatgtccgttcgcaatcatgtcaggtgatcaagccgacggcgttcacgaggaattattcgttaacaaccttctctcgagtagcccagcgatggccggtgctatgagataggtcgtcggtcttcgttggcaggttgggcgcgatggctctgcatttgtcgagatcgttctcgataatgcggcgtactcgaccacatcctactcgagtgctcaattgttcctttgtagatacatgccgggtgtattttgtcggtccagccgatgtcgtaggcggaggtctgggcagttgattctccgcggtgttgacgtcttgaagtttggtcgatctcgagagaacgagttgttgacgacgatggttccgatctcgtcgggagacgtactgtggtcgagttagatctatccatagtcgaagtcgtcgagtagcttgttgtcggagactccatctcttgaacccatctcgtggaaatcctagagcaccaaaatccccctacctagcgcgccactgtcgacgtttgatgtctcgactacggtatttggacagtatggggatcgtcggtgctaggatatacgcgagactgaggtaaaagagacggagacagggatttttatgtaggttcgggcccctgagcggtcaggtaataaccctacatcttgttggccggagccggagttgcttttattcaccataatcgcaccagtacaatatgtggaatagcctatctaactgttgtcgacatggcggtctgaaggtctgactcgtagtcgactacagggtagccttgctcctcaaagatagcgctttagtctctcctgacggtatccggagacaccgtaggggaatagccatgcctatccctgaagtcgatatctggcggcgtgtcttggcgtatgttggcttgtatgctgtggcttcagttgttccgaatattgtggtggttgttgattgaggtggatctcgatcgtggtgaccatgttgatcgtgttgatcgtctcctggtcagtcgtccccctcctcatagggggccttgtatttatacccataggtgtccccttgtccaagtagaactagggaaactaatatggatacaatccgaatagtccttgtcgtttccgtgtagaactctggtttcatttccttatcggaactcctcctatatccgaaggttgcttccgtataggacatggtatgtggtgagccctgccgagatttagtcaactactattaggtatgtggtatccataaccctgacacctgtacctcaacacgtgggtagattgactggcagggggacaataggaaagaagagatttgtcacccatgattacaaatcattttgagaagctcacttcagcattcttcatcagtttgctatcattgagccttacatcgatcaacatatcgaattactaagagctaacaataagggacgcacaaccgaatggataatgaaagaacacaagcgtgtcttcatagattggttgcgagacctagacttacctgatggagaaacaaccgagcaaataactatgaagcggttggcttgtggtccatcaactacagtcaattcttgggagggatatgacattaatagatacacatttagtacaagagcctgagatagtaagaccgtaactcaaaacaacggtgtttgtatgaaggcaattgattcagggggaaaaacaatcatactttgggtttattgaagaaatctgggaaatcgactatggactcacaatgcaattcctcatatttaagtgccagtgggtaaaatacccgaacagggtcagtattgataagtttggtattactattgttgaccttgcgaatgtgggtcataaggatgacccttgggtactcgccaatcgcgtggcacatgtgttctatgtgacagaccttgcaaatttgaagaaagaaatagttctatcaggaaaacaaaagatcttgggagtagacggggtcgaagatgtcgaagattacaaccagtacgatagtatgccactttatacgtaatttgtacaaaagattaagcttgtagaggcatcaactcagaagaccatgaagccttacatgcacaaggacggtgtggggaaaaatgttaaagagtaattgtttgttctgtaataatggtatgtagggggctatatgtactcatattgcacattattatgtttttactcacaatgcaattgttatgtgcacttatcatctttattataatatttatatggacttaccatttttattatattttataaaatcaattacatttttaaaatgttttttattaagtttttaatattttgtaacaatttttgggaaacttatcatctttattacaatttttatatggacttaccatctttattatattttagaaagtcaattacttttttaaaatgtttttatcaagcctttaatatttcgaaacaatttttgggaaacgtaccatctttatcacaattttaatatgggctcaccatctttattataatttataaagtcagttaggggatcctctaaagtcgtcgtgcgggcntgctcggaggggatnctcagtgaggtgaattcaaagggcg
